United States Patent 10,233,495 (METHODS AND COMPOSITIONS FOR SCREENING AND TREATING DEVELOPMENTAL DISORDERS) - sequence listing, part 59

SEQ ID NO: 507 - DNA, 33862096 bp, Homo sapiens (residues 31,745,716-33,862,096 of 33,862,096)
ctaaatagttgcttgaaaagtacaagtaaatgttgctcaagttggtgtgatagttatttaaagaaattaatgctagccttaaagcattgaaagtccttgagacaaaaacaatttttacctccctcattgccacaataagaaaaatatctggctaaagaatgagatatgagttgggataggaagggaggttacttgaaaaaaatctgaaaaaaaatccatgtcattttctgctggagaatggtattccactgggggagttaaatgtttaattaaattacaaacttgaagtgtcttacatttgttaactgcatttattcatattcattaattactatctcagtctattttgttactactgtaaactaaattttctgatctacttagtgagaaaacgaatttaactaagttgccttaaggcatcacaggtctagtttaggataaagccatttctgaaaataagttattctaaatccaaatccagtgttccttattcatgtcaagaagtgggaaaccattttctgagttaggcatggaaaaatagtgttatataaggatctagaagtgaaattggagggagttggggacaaacaaagcaaaaaagctattatttactaagatatgttctactatcatcctacagaagattagtgcaatgttcatcttctgcaagagctttattaatatcatctaatttaatcttcattgaaaatgtttaatgtatacatcatcatttctaccttggctacagtcatggttctttatgctcatcctgctcctcttcctggtactgccctgttcctgggaaaagcaagaaggtcattagaagtagcctgaatcttgaaaatgatgaagaagcagtggaaggctcaaaagttgaaaattataatgataattgaacacaggtgaaagtaggttaacaaaaaattggggataccaaagtgaagaatacatatttgacaaacaaaaactctccacatatacaataaggaccaacatgattgttatcaaagaagatttcaacagataatatcttgtcaatcaagggtacagaaatctttgttgttgaattccaagatgctttattccattatctttaaaattccaatcttcatgtcgataattttatgtctgttccttcaaacacagtatctctaccctatggtaggccaattttggatgtcttattattattgtagatcttagaggcaggcacacatttggtctaaatataaatattttacatgcccacacataaaatctaaaatacaaatatttgaatgctcccacacactaggattatgttttcatcaaaacattacaattattggaagagagggtgagctagaaggagacactatcttcacatatatttttcctgcaggtcttgatcggctatttgttactagacttctactagacataatctactcctggaatctaggaagcaaaagaggttggcagagaaaaaagaaagctgtgtttcaagtcagaatgactatgaattgaacacatcaagaaatggtcaatccgatcaataaacttgaactagattatctcaaaaacaggcacaggacatatcagtggaagctagttagtaaaatgtttctctgtgcaattaatttagtctcatctatactgtcttaatggttatcagcctgtgcagagaaaatatgtttcccagctaacagtaggtcttgtgtgtagattaagcaatcagattctatggtaataatcttgctaaaattgcactacatttacaaatttaaaaattgggtttccaaaacaggaaatctgtgtgggcttgtgagagagagagagaaaaaaagagaggagggaagagaagaactgaaggaaggaagagaaatatttggaatagaagataggctttaaaagtttataaaatttgcctacttttttcagttagtcagtggtaggatagaaatcttaattcaggtctgatgccaaagtctctaattcatgctgcctccacaatttatatcactgacataattcccacaatagattattcctactatttctctctttctctgaagttataatcttctttagggttcaataattatatgtattatataagatcattattataatcaaatatttatttacatgttagacaagaaggcttcaattgttttatatgagctccatatcctcaaagttggaattttttaacaaattttctaaattcttacacttctgaattatttttgttattcagattatttggtattaataggacatcttccgtaaggcttccaattattcataacacagacgaaatcattgataatctactaaatgcttattgaaatccaattagtaacttaaataatgcttcaccagcttgcaaagatgaatggtggcatctattatgaggacattaaaatgtgttttacattctaattatcatcagtaaagtaaggaataagcatttttattaatcttgtggaaatagcatgaattttaatatcaatgaaatataaatattaatatctgcactctgttcgtggtgtttattaaatgtcccccaaaaccgaagttctgcatgtttaatttcattggtaattccctgccaggttttagatgtagcacattcttcaaaaagtgatcatttctacttagacattatttatagtcatttaatcacttatccattaattcaacaaatacttattacacttctttgggccaaaatttcttcttggtacctagtttatagtcatgaacaaaatagaagaggatggtgcccttttagcactgaacgaagctataaacaaataaataaatattattatttttcaggaaatggtatagagaaaaatcaaccattgcaggggaatctggatagtattcaatatctttaacaactgattggcaaattatattcaataaatgaccaccagacttagctttgaagcagcatcttacagatgcccttctaggcagatttttgggtccttgggagtaaagttgaggggtctgggcagcagaggttcatttagggcacttgggaggctcttttctgacccttatgggaatacaataaaatcccaccacagcatgctatgtgatattcaaaattttaatcacataaagtatggtgttatgatattgtgagtttaacaacaacaacaaaaatgaatatgtttttcaaacagcctgaactgctaaatgcaaaagaaaagagagtaaaacttatattttacttaagtgactatatactaaacctaggaattctgaaagaatcaggtgtccatcactttgtaaccctcctattttccccattctccatataaaattttttcccagttgcatttaagaacaggttatgaacagaaaacagggtactatggtttgaatggtctccccaaaattcagatgttgccaatgtgataacattttttatagtattaagaggtgaggcccttgcaaggtgattgggccattagggcttttttctcattaatgaaattaaagctcttaaaaagtggctttatgcagtgttcagatagcatgttctcttgtttttctgccatgtaatggtgcagcaagaaggcccccaccacacaccaaatgccagtgccttgatcttggacttcccagcctccagaactgtgagtaaataaatttttgtcctttataaattacccaatctcaagtattctgttatagtagcataaaacaggctaagacacaggtgttgggagtgccaatcacctattgtgctatatccagagcacattattattgagttctgctttatatcaatgttttaacttctgaaatatacttgaacatataatgtatacttaagttgaaacaaagaataccgtcttgctacttctactctttgttcctaagcttcttttctgaagcaacacagctctctaaagacagttataatgtcttagacttacttctgtgacttatactatgaagaatgcacacactattgtggcaatcatatgaatattacagaataaatttatttttaattcaaatagtgaccatgaatttatcttttcatggttggcctgggaaatcgtgacattaaggaacacacaaaaatcaagcatccatgagtgagatagttttggggatgataagaccaaaaaaatgcattgtatcaatgcaacacattatacattaaacattaatcaaccttgtccataaatgtccttcaccatatcagtgctgcagacctttggctaccccaccccatccatgtgggggtagtttcctttcttagaacacacacacacatcagggcccttatcatggtgctttcctcaaggaatatgattcctgttaacagaaatctgggctattcagaatataatgtgttcactgatacatattatatgcaagctgaaagtatgtatctgggttcttcttcctaaattatttgagaagtatccagttttgttttcccccacttgacttctgtctatagtctcagaataataccatgattttgttttcatgaatggtctcttttcccccattttgacagcttattttcttctgaatagttcttctttgtctcttattactgggtgtttttgaaaaagaaaagcctattttttatagcttgctttcatatagtttcccaagcaaaacatgtaccaatgatcacaaaatcatcaccatcagaatattttcagattgtctgcacccttctaaggaggtggagaatttgttgattgattgctgccaagttcaatactataaaagtaatttgaggtttactgggatggaaacaaataaataatttctccattactgctagtaaatctgcttgtgttactagcaagtaatatttaaatgcatgtcaacagagggactttgaaaatctggagaaaatcaaaagacaatatggtctctagttaattttaaaaatattttaacagattaatataagatccatacagaaagtaaaatacgtaagtacttgaatcaagaaatgtaatactacaagatccccaagagctcccttaccaatttcatgcttcattatttcttcagtgtgtgatcatacattcctacaaaaatacactttttcctttatctatttttgaaatttatataaataaaactacacaattcatatccttttgtgtttggatcctttatataaagtttgttgaatgcagcagtaatttatttaatttcattgctgatgatgttctatcaaaggagtatgctacaatttatccattctacttttgataaatgtttaaattattttcagttcggggctattataaaaaaatgctgaaataaatatttttgtatgtacatcctggtgtttaaatgaatgtttctctaaagtatatgtttaggcgtagaattgcagggccatgggatacatgcatctttaaaattactgaataatgacaaactgttttctaaaatgggtttacaatttaaattccacacaagagttcataatacttttcattgctccacattatccccaccaattagcattatcctacttttgtttcaacttacctgtgaggtatagagctgtcatgttgtatgtttaccattacccttgaaactaataaggtaagcacttaatatattttcactggctacttgatttcctcttttattaactgctcaaaatttcgccaatttttttctattgagttgtctttttctaattaatttgtaagagttctttatacaaattgattgccagttgtatatgtggcaagtttattttcctattctgtggcttatcttttcattttttatatcttttaatgaccaaaagttcttaatttttatattgtcaaacttatcaatctgtttctgggtattcagtgccatttcatcttatttaagatatatttactttccagaattctagaagacactatattacatttttaaagttttattaatttgtatttcacatttagagcactaatctatgtggaattgatttttgtttattatgtgaagtaggggttccatttggttttatttcttaaggaaaaccaagtttctgagcaccatttaagagtaccgtttttttcacttttatgcaagtactgtgtctgtcattaatcaagtagctgtatatacaagagtcattctggatctctgtactctgttcttttggtctattagtctatctttgtatccaaaagacttaataactatttttcgtaactatatttctagaattgcctctctgtatctggcctgttctatttcaagtgcaatggagaaacagcatatcaaattttataaaaattctggctggttgtaatggcatactcctgtagttccagatacttgggaagctgagtctggaggatcacttgagctcaggagtttgagacaagtctggacaacatagtaagaccctcatctctaaaaataataataataataatacattgaatctataaataaatttgaggataattggtatctttgtatcattgactctttcaatccataaacatgatatacccctgcatttacatacattttcttaataagtctcaataaaaccatatggtttcacatgtagacatattggatgtcttttgttagatttaatcccaggcaatttcaattttatgctatttaaattaaagtcagatttcactcttttgttttcttgttgatatatagaaatatcctatatttctatgcatgttatatatataaactttgttaatgtcacttatagatacagtaatttatctgcttattattttagatattccttatacacaatcataacacttgtggataatgacagtatatttttgattccttacatatattttttctttccttattatactagctaaaacattgcataaaaaattgtataaaagttgtaataatggtagtttttatgtcattcctgttttctaagagaaaacttttagtatttcggaattaagtatgaagtttgcattttggataatttctatggtttgaatgtcccctccaaaactcatgttgaaatttaattccctatgtggcagtattggaagtggggactttaagaggtgattaggtcatgagggctttgtcctcatgaatggattaatccattaataaattaatagattaatggtttatcacaagaatgggactggtggatttataagaagacaaatagagacccatgctcttcccccttgccatatggtgccctgtgccatcttgagactctgcagagtccccaccagcaagaaggccctcactggatgcgccccgttgaccttaaacttctcagcctccataattgtaagaaatgaattccttttctttataaataacccaatgttaggtactctgtagtaagaaacagaaaatggaataattcaataattatacttgaccagattgaggaagtagccttctattcctagtttgccaagtttgttaaatcatcaatgaatattaaattttatcaatcgtgacttttatattttttaggttgcttgtataacattttttaatgtaatgaatttctgaagaaaatttgtttaggatttttacatctatgttcatgacaaaatttatctctaattttgttattcatacagtctttgttgcatttcagtatcaaggtaatttagaaaaatgagattggaaatgtgccctgttttctattctcttagagtttgtataaaattggaattatttcttttttgaatattttagagaactcatcaccgaaggcatttggctcaaaattttctttgtgaaaaaatttctgattatcaatttgattctgtatttttaaaattactatgatacaaatataaaataatagacaaagggaacagaatagaaaggcccaaaatagcactgaaataatttaagaaatatgataatttctcttcagttagttttgataacttagctctttggcagtttgaacatttaatctaagaattcaagttattgctaaaaagttctttgaatatcttattttttaaataacttcaagcattatggagatattcccttttttattattgtggttatttgtgtctcacatttgcaatttgttagtctcattcaattttttatatcagtcatttcaaatagtccctagttcttggtccctagtagatgtttgttttctatttgttaatatattatcattaccatttgcttctagattatttagcctattgtactgactttttccccaccaaattgacttggttatgtagtttattaacttttaacctttattttatttatttaattactttttttgagacagaatttctctccgtgtgtgtattgcccaggctggagtgcaggggtgcaattatggctcactgcagtctcaacctcctggctcaaatgatcctcccacttcagtttctggagtagctggaactgtgccaccacacctggctaatttttcaattttcttttgtagatatagggtcttactatgttgccccaggttgctcatgaactcctgggcccaagcagcctcctgccttggcctcccaaaatgctgggattacaggcatgaaccactgcatgtggctctttatttttaatgtatacatttaagactgtaaatttctactaagtactgcttttacaacattgcaaaggttttggtatgcagtatattttgtcaccactttgatattatgctcttttctaactttagttactgttgagaaatcagctatgatttctgtaactgttgttcattgaagacaatattttcttctcacttattttaatatatatgcctttgtaattttaaagttttactgtaatgtgactgtggttttttaatttatatggtttgagattcattggatttattaaatttatggattatagtctcataaattctgtaaaattctcacacatagtcacatcaagtactgctttggtcactttctttctcatctaagtttttggattccaactgaagatatattaggccttctcattgcatgctctatgatttttactctttttgttccacctttattttttgtctctatgtgctaactttttgatatagtatgctgaattgatttttagttcactcattctctcttcagctgtttctaatgggttttttgtatttaattgcaagtgaagtttaatctcatttaatcttcctaataacctttgaggttgtttctaggagtagtctcattatatagagagggaaattatgactttcaacgattatggaattttcccatgttctcatagctagtgacagtaccagcattatcatcagctgatcagattacagaagtttacttggaaataaacaagtaaaattgttaatagaggccagacacagttgcccatacctgtgatctcagcattctgggaggccgaggtgggaggatggcttgagcacaggagttcaagaccagcctgggcaacaaagtgagacctcatttctacaaaacacgaaaacaaaaagttagccagctgtggtgctgcattcctttagtcccagcaacttgggaggttgagacaggaggatcacttgaccccaggaggtcgaggcagcagtgagccgcgttcgtgtcaatgcactccagcctgggtgacagagggagaccctgtctcaagaaaataaaattgtgaatggaagtgtaaactgaagcttaggtcataactttattaattcttttttctgccatgaaaatattgtccatgacataaccagctgatactaatatttgacactaacatattaaatgttaatgttttcaattgcctggaatttgtatactatatgttatgtgtacatttatttgtggtctacacattatctctttctgtatgcttaggtgagaatgcacaatttttttaaccctgatatgagaaaattgccaaagtatatgttaaaattatattggttttactttaactaaagttttatttactatgaatccaaaaagaggaaaacattaaaattcagagcttgatgcatatttactttcaaaaagaagaaaaagggagagggaagtagagagagggaggaggacaaggaaggagggaggaaaaggggggaggaggaagaggggaacaactaccaaatcactgaatactatacagccataaaaagaatgagatttgcggggggatttgtggcaacatagatagaattagagactattatcttaagaaaaataactaagaaacataaaatcaaatattatttgttcccacttataagtgggagcaaaacaatgggtacacatagatatacagagggaaatattagacactggtgactccaaaagagagaaaaggggaggcaagtgagggttgaaaacttacctattggatacaatattcactattagggcgatggatacacgagaagcccaaatctcagcatcatgcaatatatccatgtaacaaacctgcacatgtaccccctgaatctataaaaaaatgaaaaagagatggaagccccctcaaaaataaaataaaataaaggactataaagttatcaaaaaaataaaacactaaagaacatccggtataaatttcatctctttttccaccttgtaggtaaaccaggaactaattccacatgatacacctgatggggaaagaggcataggcacctctaaaatcagaagagcgaaaaaacttataagccctcacctatctatagctaactgaattagcacatattgacacttcagcagaaacatgctaaataatagatagcaaagcgctcctgagaacatcctcatgttctttgctctgctgaagctcactgcggatacgcattttcagaactctcacctaagcattttttcagcacattaaaatgttgctgtaaagcaccttactaaaatatcaatttacctattcagagagtccaagcctatgtcccacatttttgtgatatatagcaaactctcactgtaatagacaaaactagttaagtagaaatacttgttcttattttctaatatgtgaattaggtcagagtttcccagaacagtacttgtttagtgaatgccgttatgtcatagcaagcaagtttacccttattcacaccaagaccataaaggaagtgtcattttggaaggaatattaatacacaggcatttataaagctgattataaaatcctatttaagcaatatgattgttggttccagtataaacacattgtttaaaactgggtatgatctaaataagaattaatcgtgaacaaatggtacatacaaaacaactcatattaatagaaaattttagaattatgagtttatttaaattgtggataaacaaaagcttgaaatattaggatattgtacagtttttgtgatcaatgggtaaatgcatcattcaaaaacaaggaaagagaaagattataaggttagaagtgttcttaaaatgttaaaaataaaactcaaatttggacaactacatttctgaatattagtaacaaaataataaatgagaacaaataacatttttataattggctaagtctggcattgtaatgttataaaatgaaagttcatcaagatcataccaataacatgtgccagtattttaaaatttattttaatatataatatatttatcttgatagtctcattcttttccatctttcgtccaatgaatgaatccgaaaactgttttcagtgtaaatgagaatatcttccaaatttgatattggtcgtgctttgacagtaaactataacctaaaatgtgaaactagcctaagaatatatgattaaagatctgtagaaaaattcaagtgagtcattgtacagaaatctaaatgaaccatacaattttaattttctaagtgtaaaagtttgcttgggatctatagtctatttcaaataaaagtggaaattatccttacatcatccacttaaaagacatcatgtcagaatgtagatatgcattattttaactggaatgtgaagtagatttttgtttcccaccatgactgtgtatgtgcagagagatgtgagggaaaataactattttaaggaaaaatggtgtatgccacatgtcaccaaacatgcaaccatctgaatacttataatttactgacatttttcaattgagaacagcacataggtaccctctatggtaaccctttgcctgttgtaacctgttagggcttcatgcttacgttttgtgtgaagaaaggctgtagctttaaacccttagaggtaactgactgaatttaaacataaaaattttgagaaataaaaaaaggtagctgcacaaaccttttaaagagagaggcagagagaaagagagagactcatttatgaagcagcatctggataaaaagtcattacagaaaattccataggtttttaaaaattcactttaaaattatccactctgaatgctaggtaactctctctgttttctacgtattattatcaaagtctaagccaatgcacacaagtcagattgaatcagtagaacatggtcaatcaattattcacaaatgttttaaaactaaccattggtttcagcaatttaactcatgtttggtttacatatacttaggcacagccaaagcaaaactttgttgtgctctgatgtcagactttattttgattgcattctgttagattttaatagcctgcagctgtgtgactataagggcttccttcagctttcctaaaaaacaaactctacatggtagaagataatttcctttggtctcacttggaactaccaagtaagaatataaaatcatagcatttagccccaacttccctccactctctcagttctatagaaacaataaattcaccagagaaatggtacgagaaacaaaaattatgtgattctcaaaaggcacattgcttgaggttgctgtggcaattattttttagaataattttcacacaatttgacctaaaagaagatacttgaagtcttaaaccctattgattgctttggagctgttttactttatttaccccttgtgggttatttcttgtcattgtgaaagcacatccaagaagagtggcaaccatagatatacatttaggctaagtgtccagcagtttaagtagtatacgtgttatggaaaaaaaagattattaaattatatataagttttaaaattgaatttaatgctctaaactttgatataaacttatattaactaatatttttggcctcactttcttttcagattctctaggttgttgaaaaaaacatttttttaatactaagcatctttctttttctgttttgttccttgtcatgttgaggaaatcatttctatagggattatgtgtccaagataataattaggaggctggccaagaacgacccttgaggcagatggatttccttttttgtgtgtggctaacttcattaccttctgtaaacgatttagtatctctgttctttattttcccaacttgccaatgggactagttcaaggaataattgtgaagacagaatgtccttcaagacttctgatttaatataataaaatagaattattgccatatatcctctctcaaatcttctcaaaggaaaatgtaaagaagaaactggagaataaacaatacaacgaattatattttcagttgcacatgataaacagtgagaaatcagagctgaaacaatgatgtgagtttccagtgccaccccagatcttgtaaaagttaaaaatcagtattctgaaaggcataaccaatgtccctttgattagaacaccttgagttttaaggtcacaggaaagattgtttaggtcactgcagaggctgcggcatgataccacagagccacagggagggggaagtaaagtaaagaaaattatgcatttggcagaccacaagccatttctgttgtttacaattttgtcttttgctagggaaggtgggggtgggatgggtgttaagtggaccaaggatggaggaaggtctgtggatgccaaatactagtatggagaaacatctgttctataaagctttgcatccaacgtctaagcaatgtatactaccaggataaatagctctttgtaggaagaatgtgaaagaaaagcccaaatagaaagaatggactgttcagttcacttcacttcccttccattatttgtcagcatgtagcctgcttcaatcaaagatgaataggaaaggaaccaaaatagtacttatttataataactgaaaaggcaaatatagaatacaaattataaaaaaagagctgcctaaataaatatagaaatattcaggacaaactattttgcacaatctctgaaatattacagacaaagtgatttgtgtaaaaaaagaacataaagagaatataagcataagtactcaaaaagagattgttggaagcaatcttctatctatagccaagtagggaagtcattgagtcttctccctaaaaagcagttataaagctgaacaaaactgatttaaaacaaaagcattgtcagcactcttgaaattatccaaagggaaacaacaaataatctgagtaatttcctccaatgcaaaaaggcaataaggaaattgtcttagtccatttggctgctataacaaatgctataacaccttagagtgggtaatttataaacaaaagaaatttattgctcatagttctagaggatgagaagtccaagatcaaggtgctagcagatttaatgtctgattatggcccattcctcataaacagtaccatctagttatatcttcatatggcagaaatggggaacaagctccctcagattacttttataaagtcactaatcccatttataacacctttgcccccatgacctaataacctcccccaaagtcctcaactcttgatgctgtcacattggagattaagtttcaacatatgattcagggacaacataaacattaaaagcatggaagggaagaaggagggaaggaaggaaggaaagaagagtaagttaaaggtaacaaaatataagaagaagaaacgggccgggcgcggtggctcacgcctgtaatcccagcactttgggaggccgaggcgggcaaatcacgaggtcaggagatcgagaccacggtgaaagcccgtctctactaaaaatacaacaaaaaaaaattagccgggcgtggtggcgggcatctgtagtcccagctactcaggaggctaaggcaggagaatggcgtgaacccgagaggcggagcttgcagtgagtcgagatcacgccactgcactccagcctgggcgacagagcgagactccatctcaaaaaaaaaataataataatgaagaagaagaaatgaaaccatccatatatgaagatgacatagtgacatagtcccatatgtagacaatgccacaaaatctggaaaaaaaaaactggacctagtaaatgagtttagcaagattgtattaaatggcatgtgaaattatactataaccatcaattgtattcagatgccacatgtggtgtttaaaaaagaaaataaatcattgtatttctatatattagcaatgatcactccagaaatgaaatgaagaagcagttttattcacagtaacatcaaaaaggataaacaaccaaaaatacatttaccaaaagcggtttatcacttgtacactaaaaactacaaaatatttctgagatacataaagtgacatataagtaaatgaaaatgatcatgaattaaacgactcaatattgtcaagacggtaattttcccaaaggtcatctataagttttctggcaattggtatcaaaatcccatcaaaatttagaaattggcaagcttatcttaaatttataaagaaaatcaaaggacttagaatagcctaaacaattacaaacaaataaaacactatgcaatttcaaaacttaatagaaagcaacagttaacaagtaaatgtggtattgccaaggataaatatatacatcaatggagaaaagttaactgtctagaaataaaagattaatattcatggtcaattaattttcaacaagatgacaatacaatggggaaagaataatcttttcaagaaatgaaatgatgctgggacaatgcattatccataggcaaaaaaaaaaaaaaaatactttagactcttatctcacaccatacacaaaacttaatccaaaatggataatagacctaaatgaatgagataaaactctcaaaatttttagtgtttttttttattgtggtaaaacacacgcacacataacaagagatctaccctcttaacaaaattttaaatgttcaaaacagtgttgctaacttataagcaccattttctacagcaaatccctaaaacttcttaatctagcataattgaaatgttatacccattgaatatcaactccctattttcccctaggcccttcccttggcaactgcaattctactttctgcttctatgaatttgaataaattagatacttcatatcagtggcatcatgcaatgtttatacttctttaactggcttattttcctcattctttattttagtgatgattcccacctcttaaagagacataatttcccctctactcccaccttcctttacagaaatcttttagggcctattatcttcttatggtggagaaaaaaaaaaaccctgcatcaccacaaggttaacaattcttcctatttattttaattcccactcccccatcaaattcaagcaaattaaatataagattgtattagtcaaaaatgtttttttctgactaaatagggtctaaaccataagaccattatttgtattcttaaccagaagcctaaacatgagcagttagttatgaaagccaccaaaaactgtggcttttaaattctttctgtctgccacccttaccatattcgcttttaatcctcagattaaaatttgtgacttgctgccatcccaggcatcagggtctcataacagaattccaagcagaaagtaaggagaaaggataaaagttcttcccctctgagattgttttgttatccaagataaaaatctttcagaacgttcacagcaatattgtcttgggtttcattatccaaaatctcatcacatgaccattcctagctgcaaaggagagtggaaaattagtgtctaacattctttgggtctgggcacaaaaagtgccagggtattatcagaaagaaataaagggtggatagatgttagatagaccaatgtgtctgccagaactgcttttaattaaaatagcattttattatgatccaatatttcttaagttgtatctatctaaagttttaccaacattcacatagagatacaagaaattaaattcaccaaatgctgatgatgtttatttctgaatggttgaatttgggataatacttttgcttttatcttcatccagtgcttggatcatttttgaacatgtatcaattttataatattaacaaaacaattattcttttaaaacactttaaaaatattttttgtgaaaatcaaaatgttttcaatgatggtgtattgttagtccattctcacattgctataaagaccgacctgagaatgggtaatttataaagaagagaggtttaattggcacatgattccacatgtacagaaagcatggctagggagtcatcaggaaacttacaatcgttgcaaaacttcaaggggaagttggcacatcctacatgactggagcagaaggaaaagagagaagggggatgtttcacacacttttaaacaactagatctcatgagaactcactcactatcatgagaacagcaagggagaagtccacctctatgatccggtcatctcccaccaggcccctcctccaaaactgggtatttcaattcgacatgagatttgggcagggacataaattcaaaccatatcagacagtattgttgctagtaacagatctatctggaaaggcattaaaaattagttttcagtctgtaacatactgatatccctgaagttatctagtctttgagaaaagtgatctgagcacaaagaaatctaactttctataataaatgtgtattatgttacatttttaagaaaatgttgcagagaactggtttttaaaatacctttgcagtcaaggctgattacttcagtaggccaagaaatatataagtgcatgacttaatagttccatatatatatatatatatatacacacacacacacacacacacgcacacacacacatactaacatgtgtgtgtgtgtgtgtgtgtgtgtgtgcatcttggtttgtgttgctctgaaggaatacctgagggtgggtaatttataaagaaaagagatttatttagctgaaggttcttcaggctgtacaagaagcaggatatcagtatctgcttctggtgagggcctcaagttacttccactcagggtgaaaggggaaaggcagctgatgtgtagagatcacatggtgggaagcaaaagagaaaggaggaagatgttaggccctttttaacaagcagttctcatagcaattcatagagcaagaactcactcattaccatgtatatggtaccaagtcattgatgaaggatttgtctccatgacccaaacacctctcaccaggccctacttccaacactggggatcaaattccaacacaaaacttgtcagggccaaacaaaccatatccaaaaccatagcaatatgacatatagattttattaggactctatcaatccaatataaagaagacagaaaatcatacagaacagcagtccaatgctaaattcataaaatccttgtatgttcaatgaatgtttggtcccattcctttttctgcagaaagtactaatacttcagacttataattatttcttcccatatcataactatgtctaattgatttggcagagcctccagtaagacatcccaggattgagtagctccatggacaatttccatcaaagagtttcctaaaaagaactattaatctgctgggcgcggtggctcaagcctgtaatcccagcactttgggaggctgaggcgggcggatcacgaggtcaggagatcgagaccatcctggctaacatggtgaaaccctctctgtactaaaaatacaaaaaaaacgtagctgggtgtggtggcaggcacctgtagtcccagctacttgggaggctgaggcaggagaatggtgtgaactcaggaggcggaggttgcagtgagccgagatcacaccactgcactccagcctgggcgacagagtgagactcagtctcaaaaaaaaaaaaaaaaaaaaaaaaaagaactattaatctacaccagtaactggtcaaaatatttctgctaaccaaagatgttgcctactttcacaaagagtgagacagtgaaaaattaggcaacactcaacatttgattttctgcaatcccttcttcctcttttatttttcccatgaacagatgaaagaagagggaggatgaataaccaccaagcataattaacatttgtgtcatcactgaagatttaaaacaagagtactacgaataagttaggaaacattgattacattaaattataattaagccaaataccctagtccaatggttataaaactgtggcttccagactagtaacatcagcatcacctagaatttgttagaaatgcaaattttggggtccctacagggcctactgaatcagaaacttgtgtgggtagagaccagaaatctgtagcttaacaagccctctagatgattctgtacatccctaaagtctgagaacccctgttctagtcctttagcctactcggttttctccaagtctttatctttttttcctttctcttcatcttgtgctttactctaactagtgggtccagagggaatattacttgtcctcatattagaacttagcactaagcttctatttttgcctctacgattatgatatacatcaatttaaaattatatatgcccagaaaaggggaaaccaagaagcttccccaatataataatgtgttgctgttgttgttgttgttgttgagacagaatctcactctgtcacccaggctggagtgtagtggcacgatctcggctcactgcaatctccacctcccaggctcaagggattcttatgcttcagcctccccagtagctgggactacaggtgtgcgcccccatgcctggctaatttttgtattttcagtagagatggggtttcaccattttggtcaaacttgtcttgaacacctggcctcaagtgatccgcccaccttggatttacaaagtgctgggattacgggtgtgcctggccaaataatggatttttacaatggaatgcagacccctaaatatctaaggtctagctcgtcctagaatgttccaaatgaacaacactgcactgaaatgtattagaaaattagagctctcaaattagtctcatctagggatgcctattaatatacagaagcttctaaaatatttctccatttgtatttaaggtctttacaaaaggcaaattaaaatttaagcaactaattgatctaaaaaaaaatataaatctgccttgcactctttgctgacagctatgggtgacaggattagacacatacaggaccatggaacatggggaattttttgtctccccaaagggggaaacttgggggcgtatgggaatgctggaaaagatcccttcatggatggcaagtggctgtctgaacttttgattcagtgttgctgcaatgagtgggtctttctctggtctccccgaggttcttgccttccccatctcactgcaggcaatgcttttctctctctctttgtctcttttttctttcctatcttttctttactcaggatgaccaccatgcccagagaccacatgttaaaactcctttaatcttctttgaagggattaaagatgacagagcccaaccagtggcaagtttaagcctggcccgttcgatattgggcactaagcagagtggctaatgtctatgttttgtcacatatattttgctctgactggaatggaaagtgttaatttgggtcctccatgcagctggttgcgtggcaacttacaaaattgataagcttttgcctatggttccacgaaaccaaaaaagatgattttcctttgtgttgtgacttgggccccatggctatggagcagctggcagggttgctagtgccactcaaggaaagggaacccgggcacatgtcagcaaaaagggtaaggatttcttagcagtcagacttctgacctctctgtctctgtgcaaactggttgaatgaatggtaaaaatcactgtttatctcctctgtaaagttttgactaatgggaaaaaaagatttgtgaggttagttttaagctgtagcaaatctgttgtactttgtgctatgaatttgttcttccccattgttctgtcataaaaaggggtaccaccacaggatagaatgcaggcctaggacccccagaagctcactgttcaagccagcccagcaaactagtcagttgcaagtccctgaaacaacaacaacaacaaaactggataaggttttcctcttgtcttgttttaaactcttgggagcttgaccttgtaaccacatggtggtactttctctgccatccagggaacaggatttgagggtttatgtcatagttagctctaaaaatcatcttgagcaattaaaagccattgcaacaagctcaaattttactgctctaggctccttctgggaagagtaatagaaaccatccaaatgctgtagcttagcagctaaggctttgcaattttataatggtgacctaggttcaatcctggcttagggaataagtactttctgtgtgacctttaaccatttattgattctgttcttctccatgagcaacttctgacttcccatcttgaagtttcctttctctgagcacctgggggtttacttctgggtaaagtgcaaaagccagaaatatttgctatttttagtttctttctggctagagtcgggtaataagatatttggttaaaagtcagcttaattaaaagcagatattcaatctatagacatatttttaaagtttttatgttttttctctcttcttagatcttggagttttgtgtgttttttttttttttaagtgtttttcttttcagtcaactgaattgtttttctccattttgtcttcttacctctcttgatgcacacatgaggggacctaagataacttctaacgtgttgtaactccttggaaaaaacagaggagatgccacagatcccattttgggaaaaaaactctgttttcctcatgaaatcacagtaattgaaagcaaatagatccctctcaaaatctaaggctaaatatacttttgtgggtggcaaatggcagttatggggtgatacatttaggctttgtgtccctacccaaatctcatcttgaattataatccccataatgcccacgtgtcaagggagagacccagtggaggtaattgcatcgtgagggtgatttaccctatgctgttctcatgacagtgagtgagttctcacaagaactggtggttttataaggtgtttggtagttcctgctgcatttattatccttcctgctgccttgtgtagaagacgccttgcttccccttcaccttctgccatgattataagtttccctaggcttccccatccatgctgaactgtgagtcaattaaacatctttcctttataaattacccagtctcaggcagttctttatagcagtgtgaaaattgattaatacatggaggggatactcagctctttgcatgtttgaataaaaaaagcatgctcttggccacctagaaagtatgtaaatggccccagcccccactgagagataagactcccatgggaaatgagctaatcacagaatgggctgatgaacgttgggttgctttgcaatgaaatgcacagtaaaatcattgcattgtcttgttccatagcatttctcttttgaggatccaggatccagtataaaaatggaaccctattaggtcagtttcttcagctagtggaggtgggtcccacaagttcaacctgtaaggttgcccttggaaggagaaggaatcaaagcctggagccaggtcagggcttacctggatcacctatagggacaaggggaagtgaaccctcagaagagccaatgtcacagtgcaggagatggggatgtacaaccatccaaaacaacttgtggctttaagtttcaagctttaagaccagaagggtcaatttttatgtttatccaaaaacaactgtttatgggactattaggttggtttcagtagctacatgtagccactgagcacctgaaaggtggctggtctcagttgagatgagcagcaaccataaaacacacattagattttgaagcttggtacgatggaaagagtgtatctcactaataagttttttatattgataacatgttgaaacagtagtatttttgatgtattggattaaataaaatatattattaaaattttaaaaaatgggactgtgaattgttggggatgtgtttagccttccagctgtgcttgctaattaagccctagaaactgcatgttttccttgacctcttcctagaaggactccaccctgaaaccagtaatgcaattaagaaacttagagactggcaaataaaaaattgtacaatcactggattttcttctgtctttctgtgtatttatatgtgttctgtgtgcgtcatttacctatgaaagagctctgattaattggcttgaaaataataagctctttaatcaaatattttgttaggaaaataaaaacaatagtaccttttagttcatgtgactttagtaggccttggaaaacaaagagttttaaagattattggtaaaataaagacatttggtctaaattaggcaggtcagatattagatttgctaaatgctttaaggtaataaactgcttctttgacttttgacagttgttcaacttacctgatttggagccattagcctaggtaagggctagggacatgtggagttagccaaggctactggctatgctgtaaagagttagactttatctgcacatctgtcttgtgttctaggctccacacctaatacataattaaaatcacttagcaagcctttcactaaaaataaaaattgctaagagataacattgtaatgtaattgagactattgaaaaaacagttttacatgcaaagtgtgtgaggaaagtgaaatgtgcttttggcaaaagatgataagaaggcctagaaatacggatttttttgcttggattaaagggttaaaaggttattttaaattagaaaggataaagctgaaaatttgaccaagttatggaaggttgtgagagattaatcttgtaaaagaaatatctagtgaaaattaaaggggtattattcaatttttctgtaaattgaacattggggtaaaagcaaaacaggattttcttagaccactgatatgctttttaataaaaattcataaagggttataaaaggtttatgagaatctcactttatggtctaattgtataagactggatatattcgtatataaggttttattaaaaattggggttgacattaggagtacactaatgcaagcctaaaattcagctttcttgaacaaaattttcatgtaatattgaaggataatgaaatatttttatctgccatttgaataaactacaggaaaaagaaagaaaagacaagacacaatttttctggaaagctaagtcttccctctatcaatgagtaaaggtttttgcctttttaaaatttttgagtcattattttggctaaatgaataacttatggtgacctggaattatatttttataatatcaagtgttttaatccttcaacatatttgacaggcttccccaaatcaaatttcagcttcaaaattgtcttttctaatctctaactttgggatgctacagagggcgcctgaagcatccaaaagagaggtaaataggattatttgacatgttaagttacatggggagcattgtcaaaataaaaaataatgtttaaccttcttcaggttatattttagtgaatggtgttaatgtatgttccaaaattttatggaatttttaaaattctaattgtctgattatacgttattaatcataattatggttattaatgttaagttattgtagaccacagaaataaccaaatttccttgtcaattgtgtctttaacgatgagtgtttaaagtcatttccacagttaattgcttaattctgatgcagtttctaaaaaaacatcacaagcactcagaattctagaatatggtgtcttttaggaggttcatgaaagaatggaaagaaccctgaaaagcactcttgaatacgggtttctggtaactttagaatcatatcatttagactgggtaagaattcctggaactataattaaaagactgactggtttataaacctactaacccaaggagaacaaaaattaaaagaataccaaaaaaatttgccagattttcatgctaaatcagcgaatactgaaattgtttagatatacaacttgaatgaactccatggtctaagtaaaatgacctatgataacccatcagttatcagtgctatggacctaaattggagaaacaaccggtattcaagaggacataagaccaatgttaagcatggactcttggagaaccctgacagcagccttgtccttcctgagtccttaaatctttcgtattaaaggttctgcgttccatgactcatcatgaaaaagataaaatgatccaaattaaatatatattggtgtggtgacttctaaattgctgaaatcgtttataaccaatgtttggtttgtcaaacccatattcctgggaagacaatcaaagctctaggtacatttggctacctgatgggccatttaaacatttatagagggattaaattcagttgtcacattcagtgcattttttctggttgtacaaaagctttcccatgcaagagggctgatgttataacagtagatatgttatgccacagggtattttcaccaggtaaaggaagctttttatgcctgaggacaatcaacttcttcacaatctagaacctgaagattgcatcttctgagaacatcagagaaagactgccctttccatccacactacagaaaaactttgcgaccttgaactttgagattataatttcacaaccgagaaggttgcctccacaatcttggaactgtacacccattggaacccttaaggtaaagcctaccagggaagtttctccccagaagaagctggcatctttgatgtgaacagcttttcccaagatcatggattaagacttctctactaccatgaggctcttaccttttagtattttttcccttgcttatgtctctaaggacaatagaagtgaaaaggggatcagttgtgtgcactcatggggtatacttttatttgtgaaggattttgcagccagccttacacatgcataaccttataccttactagatggaagatgaaggcccaacgtagatgataaatgttaatggtacatactttgcctcataatcagtcagaaacagaacactggttcacccctcttaacctacatcatgggctaaagaaaaaatctctcagaggccttgacttttctagaaaggcatcatttgtgtggtcctttttccatggtttggagtaaaagaggcgatgattagaaatgtatccctcatgacaggctgtatagcagactctactataaaggctatggttacgcaacagactttaaattatcttgcgaaagttatgctaaataatggaattgctctagattagttactggctaaacagaagtatctgtgcagctgcgggcacttgtgccctatggaaaaatacatcaaatgtagattatagagattcggttgcagggaattaacgaagagactgcttagttaaatgagtagaccctttatgtagctcattatttaatctatttaattctaggtggtttggtttatggggaccctgggcaaggagcatacctcaaactcttgatactatcctcctgatcatcatgctgtattgtctcaaaagttttaagcatttgcatgcagccatctctagaatgtcaagtggtctgtcttcaactgaaatgacaagagccaaaataaatgtctggccatgagggcaccataacctatgaatgacatgctgataccagaatcccaaaatgatggtaactgagagtggtactaggccctaagttttggtcacactctcacctaagtgagaatctgaccaaaagaggggagtcttattaaactaaattatgtgaggcaattgttttggactgagctcatgcactaggcctcaacagaccagaccaaagcaaaatggagtcactcatgctaaatatgacataatcaaactaagactttaagacaacacagaccaggttttgtttttctcctgtgaacagaacgttccagcataaagaggtaccttctactcagtccttgttcccaccttgcaaaacccactgctctaccatttcccagtggatttcaagaccaaataagtacatttacaatggtgagggtgacatcaatgactaaagtttttatcaatctctcaaaattgagaagatgaccaaaagcggggaatagttaaatcaagtttcggctaaagctgcctccttacatattttaagttctgcctaaaggtttctctgtatatcgtgaactataacaagtggaggtgtaaatagactgcagcttacacttttgccaatcaccaagttttggccaatcaaatgtagccagctgtttgaactgtgttcaaataaggcaaacatcaacctgtaaccaatccagttgtttctgtacctcgcttctgttttctgcacatcgctttccttcttctgtccataaatcttcttctaccatgtggctgcactagagtctcagagcctacactggctcaggaagctgcctgatataagaaccattcattgctcaattaaactcctttggatttaatttggcagaagtttttcttttattactgcagttaattttttgcttcatggctggggctggtgtctctcgtctgaaatgttcaatggtggggatggggacagtggggatccacttccaagctcatttatctatatgtcagtaggtctcagtttctctccaggtaaagcccctttacagaacttccctcacaacatggcagccagcttcctcccatgtgaggaatgcaagacagagtaacagagagtgctcaagacaaaaaccaccatctttttataacctaatcccagaagtcacatttcatcacttctgtcatattcttatttgttagaagtgagtcagtaacttcagcccattttcaagagaagaagattacaaaacagtgtaaaaatcagcaggcagggatcactgtagggcaatttagaggctgcctaccaaactagcatacaaacacaaagtactgtcttgctttcttctccagattcacagaagtccttaatttttctccaaaactgaattttcatttttgggcaattatgatgtatatcattagatattatttagttgtaactggggaaaaagtgctaatactatgtattttttaacaaaacataaaaaaggctgttttgaatttcaggaagaggtagggatgctaaaagtattataaagatagagtatgtatatagctatcaacatagatgtatagatattaagatggatagtatattactgtatcatttaaggtgttggcaggaaacagattgtacacttaaaagtgttgactaaaagatacattttaaaaggacctatttacagagatgttgacagagctccacaatctaacaagggactagtgacagcagaaagccattatgggcccagggccaggaaagacaagaggaggaaaaggtggtaccttaacttggagaaagctggagccttggaacacagagtgacctttcgtatgtatatgaagcacaactggggatcctatttaaatggagattctgattgaagcaagccaggtattctgcatttttagcaactcccaggtgctcctgatgctgctggttcaaggatcacacttgaaatagcaagggcctagtgactcaaccactgcagaacctcaaggaagcagggaagaaacagaaagaataaacccatcagtatctctttcctcctctcttcccacctcctagaagtgcctcccactgtttaaaattaatcaaaagccgaaggcaaagactggatgatgtagtctatgagaatgttcctgaggctcagagtggagcaaaaacagccatattatacataacgccttgtttgtgtggtttcctcacacacatacctgtcagtactcagctaaatcaagaaggctccactgtggatcaccagcattctctctgcttagctctctctttacagatagcttgtcctatgaactctagatgctttggtttccccagacgttcatctctgtcttttcaacataaggagtctgctgggttagaactaggtccctcttttccacacggtcttttccatattcctttttttttttttttttgcttctttctgagattgttcatttttgggtatttccaatatatttcttgccttttggatatttcagaaaggatggtgctgtagtttagatgtttattcccccaaagctcatattgaaatttgattccaatgttggaggtggagcctaatgggaggtgtttgagtcatgaggcagattcctcatgaataaattaatgccctccctggggtgattggaaggctatgtaactcttattagttcctatgagagctttttgttaaaaagagtgttgcaccttccctctgtttttctcttgcttctttccttgccatgtgattttggcacatgctggccctccattgccttctgcaatgagtagaagcagtcagaggctctcaccagaagtggatgcaggtgccatgcttcttgtacagcctgcagaaccatgagccaaataagtctcttttgtttataaattacccagcatcagatattcccttttagcactgcaaatggacttgcacaaatgacaaatccagcccctgttactccatctcagtcagaagcagagattccttacatggattatcgttaataatttattatttaaccaggtgcactcttggttacagaatcatttttgattgagtctatagatacttctcttttaaagaggatggggggagggtaaaggattgtcttttgcaatttgaaaggcaagattatattagtattccagctttatttatttaaaaaccactagtggagaagtgttgtagaactttgctccttagtgtagctaaaacctagcttcttgtcacatgaccagaaaaatttaggcacacagacacattgaagtgtgagtatagcaggactttatttagcaaaaaggaaaaaatgaaaaaaaaagaagtcagcaaagtgagatagagacctgctaacaggctctctacctcatagattgattcccaggtcaccacatagactgaagaaagcaggctcctcccctgcatagggtgtgaattccctgtggctccacccacttccccccacttctccacccacttcctccacccacatcccccatgtgcatgttgggctccagtccactgtgggcatgcccagacaagccctggcaagcttccctcatctgcacaaaaacatctaatgtaaatacttgtggggcaggtcagagattctccagggaccccttattatctgccttggcctttgactgtctcattcgcccctctaaagaagtacatctatctgctgttagagtaaagataaggagaaggacaaagatcaatcttaactgcttcctgatgacagggggtactgttttgggaaaatggcagtcagatcttcttctgactatctaagggtctaaggctctaaggcagggtctaagggtctaagacagcctatctaagggtccccggcaaaaggggccatcatccgaggctctggttgcatgaccatttggagtttgatggcctgaaggtgagaagagaaaaactgggttattagaaaacatatatcaaaacaaataaggcggggggcggattatggacagctcaagaaatcccgagtccttttactcgtttgcacagggagtgggaggccaaaagtctgactggtataaaaagaaaaaaaaaaaacaaacttttaccctgttgccagcatgtcaggattccgggttcccttcccctgagcccaatcctaaaccaaccagtctaaggtttgggaaattaactcttcccagtttggaggatgcacctgagaagagtgtcccatagcgcatagtataaaaacacaattacctagctgtgaagagaggacagaggaggaaaaaggaaaaaaaagaaggcttctttctcagaggagtcccgcgggggtcagtatgcatttgaaaggggcacagactgaagatgaatggctacttatctggtttccttctcttcttagcaaatacccagggtacatgagggagaggaaaagttaggcattcctctttcctccgttcttatatccctgaattctggtgactatgacagggtgccacccatggatgtcaaagcagctttcaaccatgttaacaggggggcttaggggatgggactatctgctcttaaccacatatgcctatctcccctgctgtcaatagcctttgaattccctggaactcatttatgccatgaatactaacatgacctttatccatgaaacaggaagcttagctcaactggcaggaattagtaatgcctacctgtgctgtgccttttaacttttgttatcatcttcctctggatcccttagatccagttttctttcttagggctttgacccaaaacttggaattgagtttgggaccaaaaatttgtctcgtgggggagggatgttgcatgggctccttatcataagccaaatgctaaggtgaagccgtggaattcagtccttctccaaaaagggagagaaaaagatgtcttgtgacactcccataaaactggcagttgtagttatgatcgctaggatttgggtgcatggagtttggctttggttaactccattggtcttactttcccaaaaagaagacctccgggtgatgggcactcaatttcttcccatcacctggcaggatttgcaggacaattgctcagaactagaacattgatccagatttttaacaatacccatccctcttgttccttctgagctgcagttggtgatcactggttggtttacaggaatgagcagtgttagtttaaaatgtaggcaaaaacttaaaaacaactaatgggtctagaatttaatgacaaatatacgatagattttgaaacataatttttctctctctagtcctcatttatgttaaaaacaaatcattataagactgtgttgtttgcaaaacagactttagtcttgtacttggcctaattatttgcataaaatgcagcaagaatactgatttctatatgcgttttatatatatatttatttatttatttatttatttttattttattttatattttttgagacagagtctcactctgttgcccaggctggagtgcagtggcatatttgcaacctccacctcccgtgttcaagtgattctcctgtctcagtctcccaagtagctgggattacaggtgtgtgccaccatgcccagctaatttttgtatttttaatagagacgaggttttgctatgttggcaaggctggtctcgaactcctcaattacttttaaattgtaatatctcaatttaaaagtaatctgtaataattatttgactatagcatacttgtcaaaagagggccagagatttacctctgaggtttctgacagtcaataaacaaaaaatggacatctatttagttccataaatcacagtataaaaaggataacaaaaaacatactctaccataattaaccataacctatttcttcaaaatattctaggtctatcaacaattgtatagaaatatctgatttttatatatgtgttcttgcgagtagggagagggaaagagatgttgggtatagattgtgttacataaataatatataacattaattaaccaaacttgcttaatcttatttcttgtacatttgataagcacattctaacaccacatcctaattctattgtaggaaataaagcattatagctatcctgggagcaaacaggaaatacactcaacattccacaaaaatttctttccccttttgagagtaataccttgaatcatgaggtttatgaatagctgtgtaaggctccctgcaattttctctggtattacaaactgtgttacacattcatgaaacctcacttatcatttgtaatttaaataggaaagtaaagtgttgttgaataattagcaatgtcttggcttctgtagaatcacctacccacacaggcagaataaatggctcaaaaattgaaaggtataattgaaataggccggcctggagaatttatagagctataaaaaaaagtacgatccttgggataaatgtgaagatttgtgtgtgtttgtcagcattaaaaacacaatcctcaaagcaatactaacctgatatcaagaaaaattgatatcaaaactgtttcttgctcattcattttctcctcagaattaagatgataaatttgttttaaactaagccatttaactcgttttagacaaggtttataacagtgaggggccggtttcccactgggaaatatggcggaatggaataggaagaagcagatgaaaaccaagaagatttcttctgacgttttccccttccttaaaataattttgctattttatgaccttttagagtaatgtttcattaatttgtaataaattcataaagcaggaaatccttctcccaagtctctaaaataagatataaaataacaaggatagtgttgatgaaaagagtcaaagaagagatttattctgagccaaatatgagagaccatgacccatgacacagccctcaggaggtcctgagaacatgtgccccaggtggtcagggtacagcttggttttatatattttaaggagccatgacacatcaatcaaatacatttaagaaatacattggtttggttcagaaaggcaggacaactcaaagcaggggcggggtgggggggtggtgcttctaggctataggtaaatttaaacatcttctggttgataattggttgagtttatctgaagacctaggatcaatggaaaggaatgttcagtttaagataaaggatttgggagaccaagttttattgtgcagaggaatctctcagatagcaggcttcagagagagggcaggttgtaaaacgtttcttataggacctaaaagggtgcctggctcctagctgattatctcctggatctggaaagaaaggaaggaaaacaaaggggaaaggtgattctctataagatgtggatttttcccacaggagactttgcagggcaatttcaaggtatgagaaggaaatatattttggggttaaatattttttccttgtctcataatgttatgacagagtcagactgaaaagtaagtcatgatatatagggtcaaataaaatccatctgatgagaatttatggtttgtagggcatgactccctagaccccttaggtaggaatttgggtaagataaaaaatcagagcttagtcctcaatagtattacttataattttaaaaaataaattaattcactatttacaattattgtattataattttaatgataattgaaagcaagcgggatcagctgcagtttcacagttagtaaaaagccactgcttttaatatagtaacaataattatcagtgcgaaaattttccttctccttccaaaagagtatttttataaagccactcagaataattgcaatcattgggatgttttacctttgagcacaatttatgccatacaaatgtaactataataacaaaaggcattgtagtacattacttcagggtaaatttgaatgtccttcctgtggaatgacaaactccacctccagctgtgactcatctttttcttccattggcatttagtgtcataccttaaccaggctgaatgagtctggtttgtcatgtaatataacctcaaaagtttctgtaaaaattacaacttaagtaatatcttcagattcatgggtccaattttaatagaaattagaagagtacttgggttaatttttatttttgttctcctctttaatgaaatatattatattgtgccatcaattatagccaaaaaatatctttttaagaacgtaatggatttcaataagccctttcctttgacctcctattacagttcttttttttttctctgagagagcttatgtgcttcttttcttttgaagacaacccaagatatttctaagttttattatctacaatggagtttttttctttaaaagaggataataagttttcctaaatgtatataggcttatttatttatatggattttttttttcttaattcctcacgtataatcccaaataactttatttggagttttgcacatgaatcagatggggaattcacccttacaaagtcaggaacaaaaattttttaaaccttatgcagatggccaatactcaccatgtctttttaaaataagtattgatgaccataagcacataaacaaaaactttatttccaataaataatgtgactgccctacagtctcctatgagagacatttagataatcctaggcaatttatagaatataatagctgggaaatatctagacatgttatctacttagaagaagtaaatgacagattcctgctctgagtacagcagattatctattgcctttgagaaataagtgtcagaaaatactggaggaactcaatattgatcggaaaaaagtgtgttttaccctattacttacctttaagtttccactggaagtgtttgctactttatcactactggcctactatctgattttccttcctctagtttgtcactgtatttacattactatgcctccataattatcgctaaaatgtcaattttatttttctactaagatgattaaaagtcttttttgctttcccaccagtcattgacagaagttgaagtccaaagttctaaaactaaatttctaatcatctggtaatctaacttccaggcttttttctcactacttgcctgcagtggtgacccatagctgcatctatgctaatgctcttctaatacttttactatttccttataagagtcattatctttaaaatacttgaacactgccttttatgtgtgatttttttttttttacttttccaccctatctcattcttgtaatacttgtaagaacatgtgctaaatatttatttaccatctaatcccatattactagaaacggcttagcattaacaaatatgagtgtctaacatattatcaaattcctaacttttatgttgtcttgatctttcatttaaattgttaaattgttatttattttcatcgtgctgttcttccatagaaaaattgcatcattagatttcatgagagtaagcaacaaaacttttctggtgtttattccatttaacccaaatacaatgaaaaagaaaggcacaattcatgtgccgtggattttatattccagtgggagagtggataaaggtatatataactaatgacataattatttttaattacaattgtgatgaatgctatagcgaacaaaaatacaatattaatattctttcaataagtatgtttttactgaattgctactatgtaccaggcattgttctaagagagatattcagataatcctaggcaatttctaagggttctaagcgctggagacacagccataaaataagacaaaagtttcatcctcatggagctatcattctaggaaaagagacttatagtaattaattagaaaataaataaatgatacccttttagcaagtgacagatagtataaagaaaactaatcacggtgaaaagagagactgcttggctaagggaatgtggagagagttgactatttttgataaggaattcagcaaaggcctctctcagaaggtaacgttggggtagagacccaagtgatgaggagagagaacacacttagattggggaagaacattccaggtggaggaagcagcaatattttacataacaacatttccttatgcatattatgcacgttttcttatgcatactatgtgggcaataagcagcaactgctatgcagatgtgcatttctttaagaggatgactctacagaatattgtcaggcaatgagtgaaaacacttacaagctcttaagaaatagatttctgcaaatgaatgaaggatccttgaagaaagccctaaaatattgtatgcccaggtgaatctgaaatattagagccaattctactgcatggttgcatgccaaaaatttcatttcattcaaccaacccagctctgaaaacagcatatgaaggagctatggtcaagaaaaataactattcttatcttgattcagcatcttacaaatgacgggatttattttttatttttatttttattttagattcagggtgaatgtgtgcaggtttgttacgagagtatattgtgtgatgctgcactaagggcttctattgatcccgtcattcagatagtgagtatagtacccaataggaagtttttcagccattgttcccctccatatttccctcctttctgcatcccagtgtttattgttcctgtctttatgtccatgtgtatctaacatataagtgtacctcacttataagtgagaacatgcattatttggttttcagtttcagtattaatttgctcaggataatagcctccagtcgcatctatgtttctgcaaagaatatgatttgattcttttatggctgcatagtattccatggtgtatatgtcctacattttgtttacctaatccactgttggtgggcacctaggttattttcatgtctttgctattgtgaatattgctgctataaatatacaagttcatgtgtatttttcttacaacaatttattttcctttgagtatatacccagtaaagggatcgctggttcaaatggtagttagatttttagttgtttgagaaatctccaactgctttccataggggctagactaatttacattcccacagtgtataggcattcccttttctctgcaaccttgacaacatctgctatttttttgactttttaataagagccattctgactggtgtgagatggtatctcattgtggttttgatttgtgtttctctgatgattagtgatgctgagcatcttttcctatgcttgttgactacttgtatgtcttctttagagaagtgtctgttcatgtattttatcaacttttgaatgaggttatttgttttttgcttattgatttgtttaactccttgtaggttcttggtattgtcctttattggaagcgtagtttgcaaatattttctcccatccagtagggtgtttgtttactctgttgatagtttcttttgctatgtagaggctctttagttgtctaactaggtcccatttgtatatttttgtttttgttgcaattgcttttggggacttagtcataaattgtttcccaaggtcaatgtttagaatgatgtttcctaggttttcttctagtattcatatagtttgaagtcttacatttaaatattaaatccattttgagttaatttttataatggtgaaaagtaggggtacagttttacttttctgcctatggctagccagatatcccagcataatttagtaaatagatagtcctttccctattgcttatttttgtcaactttgttaaagaccaaatgactgtaggtgtgcagcttaattcttatgttccctatcctgttccactggtctatgtgtctatttttgtaccagtgccaagctgttttagttactgcagccttgtagtatagcttgatgttggatagtgtgatgaacagaaatgcaaaatcctcaagaaaatactagtaaactgaattcaatagcaaactaaagatatcacacataatgatcaaataggatgcaagaattgtttgacatgcaaatcaataaatgtgatacatcccatcaatggaatgaagggtaaaaatcataagtgtttaacaaacttttgcctcctttcataattaaaaacaactcaacaaattaggtatagaaagaatatacccaaacataaaatggccatatatgacaagactgcagataacatcacatgtaatggataaaagctgaaagcattttctgtaagatcggaacaagacaagaatgcccattattgccactcctgttcaacatatgcatcaaaaattgttattagtaataagtgaattcagaaaagttgccatataaaaaagcaacatgcaaaaatcagttgtgtctctacacactaacaatgaagtatccaaaaaggaaattaagaaagcaattgtatgtataatggcattaaaaataataaaatacttaggtataaatttaaccaaggaggtgaaagatctgtgcaataaaatctataaaatattgatgaatgaaattaaagaagacacaagtcaatggtaactatcttaagttcctggattggaagaattgatattgttaaaatgtccatactatccaaagaagtctacagattcaatggaaaccctgtcaaattttgaattgcatttttcagaaaaataagaaaaaaatcctaaaatttgtatggaatgatgaaaggccctgcaaagccaaagcaatgtggagcaagaacaaagcaggtggcatcacactacctgatttcaaaatatactataaggctacagtaatcaaaacagtgtggtactgatataatatcagagatatgtaccaatggaacagaataaagacttgagaaataaatccacacatttttttttatggcgtattagtctgttttcgtgctgctgataaagacatacctgagactggacaatttacaaaagaaagaggtttaattggacttacagtaccacatggctggggaggcctcacaatcatggtggaaggcaaggaggagcaagtcacatcttacatggatggcagcaggcaaaaaaagtgcttgtgcagggcaacttcggttttttaaaatgatcagatctcatgaggcccattcatcattatcatgagaacagcacagaatagacctgcccccataattcagtcatctcccactgggtccctcccataacatgtgggaattatgggagctacaagatgagaattgggtggtgacacagagccaaacaaaatcattccgcccctggccccttcaaaatctcacatctgtcaggcctctgagcccaagctaagccatcgcatctcctgtgacctgcatatatacgcccggatggcctgaagtaactgaagaatcacaaaagaagtgaaaatggcctgttcctgccttaactgatgacattccaccacaaaagtgaaaatggccagtccttgccttaactgatgacattaccttgtgaaattccttttcctggctcatcttggctcaaaaagctcccccactgagcacctcgtgacccccactcctgcctgccagagaacaacccccctttggctgtgattttcctttacctacccaaatcttataaaacggctccaccccatcacccttcgctgactctcttttcggactcaacccgcctgcacccaggtgaaataaacagccttgttgctcacacaaagcttgtttggtggtctcttcacacggacatgagtgaaaatgtcctcacatttgaaaaccaatcatgccttcccaacagtcccccaaagtcttaactcatttcaagcattaactcaaaagtccacagtccaaagtctcatctgagacaatggaagccccttccacctatgagcctgtaaaatcaaaagcaagttagttacttccaagatacaatgggagtacaggcattgggtaaatacagccattccaaatgggaaaaattggccaaaacaaaggggctacaggcccaatgcaagtctgaaacccagcagggcggtcaagtcttaaagctccaagatgctctcctttgactccatgttgcacatccaggtcacactgattcaagaggtgggttcccatagtcttgagcagctttgcccctgtggttttgcagggtacagcttccctcccagctaccttcacgggctggcattgagtgtctgtggcttttccaggcacacagtgcaaactgtcagtggacgtaccattctggggtctggaggatggtggccctgttctcacagctccactaggtggtgccccagtagggactctgtgtggggactcccaccccacatttcccttctgcactgccctagcagaggttctccatgaggacctcacccctacagcaaacttctgcatgggcatccaggtggttccatacacatacatcttttgaaatctaggcacaggttcccaaacctccattcctgacttctgtgcactcacaggctctacaccacatggaagctaccatggcttgaggcttctaccctctgaagccatggctcaagctctacattggctcctttcagccatggctggagtggctgggatgcagggcaccaagtccctaggctgcacacagcacagggacctaggacctggtgcagaaaaccatgttttcctcctatgcctcctggcctgtgatgcgaggggctgccgtgaagaactcagccatgccctggagatatttcccccatggtcttgaggaatgacattgggctcctcattgcttatgcaaatttctgcagctggcttgaatttatcctcagaaaatgggattttcttttctatcacattgtcaggctgcaaattttctgaatttttatgctctgcttcccttataaaactgaatgtctttaacagcatccaagtcacctcttgaatcctttgctccttagaaattttttccaccagataccctaaattatctctctcaagttcaaagttccacaaatctctagggcaggggcaaaatgctgcccatctttttgctaaaacataacaagttacctttgctccagttccaaacaagctcctcatctccacctgagaccacctcagcctggaccttattgttcatatcactatcagcatttttgtcaaagccattcaacaagtctttaggaagttccaaactttcccacattttcctgtcttctgagccctccaaattgtttcaaactctgcctgttacccagttccaaagtcacttccacactttcaggtaacttttcagaatgccccactctactgttaccaatttactgtattagtctgtcttcatgctgctgataaagacatacctaagattggacaatttacaaaagaaagaggtttaattggacttacagttccacgtggctggggatgcctcacaatggttgtgtaagggaaggaggagcaagtcacatcttatatggatcgtggccaatgttgagaagattatttcctaggctgtcttccaggaattttacagtttgaagtctcacaaactattaaatattcaatgcattttgagttaatttttttatatagtgaaatgtaggggtcccagcttcaatcttctgcatatggctagccagttatcccaggaccatttattgaatagggagtccttcacccatcgcttgttttgtcaggcttgtcagatcagatggttgtaggtgtatggctttatttctgagttttctattctgttccattggtctatgtggttttgcataccagtaccaagctgttttggttactgtggctttatattatagttagaagtcaagtagtgtgatgccaccagctttgttctttttgcttgggattgctttggctattcaggctcttttctgcttccatttgaattttagaatctttttttctacttctgagaaaaatggcattggttatttgatagaaatagcattgaatctataaattgctttgggaaatatggccattttaacaatattgattcttcctatccatgagcacgaaatgtttctccatttcttgtgtcatttctgatttcttacagcagtgtttttttatttctccttgagatctttgcagcaacatgtatgtagttggaggccataatcctaaacaaattaacataggaacagaaagccaaataccacatgttttcacttataaatgggagttaagcattgagttaagtgttgttacgatgagtaacatggacataaatatggaaacaatagatactgtggactactagaggatggaaggtgtgtggtggattgaaaagctatgcctaatgccagagtgatgggatttatactccaaacctcagcattatgcaatattttcatgtaacaaatctgtgcatttacccccatatctaaaataaaagttgaaataaaaaaaaaactctgcaaaatgctttgtactcatatgtgctccaattgtattgcagaaacttcaaagctatcttactcaatttagtttgtcttttaaaatatacctgttttcaatccatggataatgattcagatgtattttaagcatataaattatttttaatttagatctactttcattgagataaaaatgttggcagtttataagtaaattatttcaatctgccaggcgcattgaaattttatcataaagtagagatgtttgcctcctttgctgcaattttttaggagatttttagaaagacagagtataagtattaaacataagttatgtctgaaaaaaaaaaaaaacctattcaattcctctaggcccagagactattgcagaagaggtgggctcatgagattgtaagcaccaattttgaggaataaaaatataattctctgacttaaaggaatcattcaatgtatatattattattttattttatatattattgttgccattccaaatcctttgtgaaataaagcagaatacacaaaaataaaacatgatagttaatgataataattaacatatattgaatatttattatggttctatggacagggtatatgcctaagtttttctaagatttgactcagaaatccatggaattgtgtccattcgttatccctgttttatagataaggaaactgatacttctaatttgcttcaaatcacatatttgctaaattgcagaaccagaatttgcatcaagagctgtctgactccacaactgaatatttaactactaaaatatagtctgaagatattaaaaaagacacaacttacaaattgtctatttttaatactatttaaagtctatgcctacaacaaattttataagatacatacttttattaatatttgtattgctcattaaaaattaatataatatttcctctaaaaatgaaaaaaaggtattttcttctccctttttttttgagatggagttttgctcttgtcgcccaggctggagtgcaatggtgcgatctcgggtcaccacaacctccgcctcccaggttcaagagattctcctgcctcagcctcccgagtagctgggattacaggcatgtgccaccaagcccgcctaattttttgtatttttagtagagatgaggtttctccatgttggtcaggctggtctcgaaatcccgacctcaggtgatccgccagccttggcctcccaaagtgctgggattacaggcgtgagccactgtgccggcaggtattttctttcagatgcaaatcgaagcagttcagtgatagtctgttcctctgtgctcacatcctagacattcttcaaatccaagtgtgagcgacgattctcctggaaacttttccttaaatgtcaacctttaatgattttcctcttttacaaagtaataaacttagagttgtgccatacagatttatatttaactgttctctgataaaattatttttattcagtgtatatccccaaataagaactaagcttcttaaaagcaaaatcaatgtcttctgtttattttgaactatgtacaatgcttagaagaattttgaatccaataaatagctgttgatcagattgcttgatattataagttattcagatgagtgataaaaattgatggctcttgaagacaaaatttaatgaactacctaaacattgcattatactttcacataacactttcccagatattcctagagtaattttggtgatattttagttttgttaaaaatattattttgaattaagaagctttctcaatgcacaaagaatattttagagcctttcatcataaattggaaattcatgaacttctgatattcatgatccagatttagtcattctacttgccaaatgaagtaattttcacaatagcaggtaaaagctattttggctggaaccaaatgaaaaaatattgatttgaagatttttaaagaaaattttcaaagtagtgtgtgaacagtattggaaactgacaagagccatttttcgagcttatactaaagaacaagtaccatttcctagatcacagtgaggtgctaaataaaagttgtatgcattgtatatcattttcattttgaaataagttaaatgaataaaattagtgtaaaatatcaaacctgatttttaatattataattaaaactttaaatacaaaggaatgacttgagacaaaattaaagcctcatgtttaataaccatttttgatgcctttattctatctgaagtataggtgtcaagaagcatatgatatttcatggtcaagtctttaagcaggtttcacttaaccaagcaatgagaaatgacagacctcacagaactcgatagtcaaattatcttttgaaaattcccagtgtccgcctccaattattatgtgcagaaaatcatactgaagttattggcaagtgactgaaatatcagttatcctaaataaaataaaataaatactgcttatgtatttaatactaaagtcttagataaatattatgaggctctactttccatttattatcaaattaggcattttaatatgaaaatatttgaaacatattaagtgggacattatagttctttaaaaatcaccaatgggaaaatcataactaatatcctatttcaaataaaataagctgagaaataattttttagaattacagaacagaatcaaatgtgcaaaattcatatgttctaactttaaatttgaaaacatctaatctttcttaagtgatttacaatggcttatgtaacatctgaatatttattaagtgtttgactgaatacctttaacgttgttttttcctatctcgaaggcattttgtttttccttgtttgctagggaacagttcctttggaaaattgcaggcaacatttcctttggttacattgaaaatctacatggtcattcattagatggaagccaactgattacatatgaatttgtcctgccaagatgtagagttaatcatttttttggagacgaatgaggaacctaagcattctgtagctgatggggatgtcagggtttttgtaaatagtatgctatactcatttatctttcttattctttcaaaagaatggaacacaataaaagtctgactctacagcaaagaaagtcacagaacctatataagtctggtgcaggagagaataacggaaaaaaagtcacaatcataacactaacatgagtaacaactaacacttactgagcacttactatatgccaggcactatggtttgaattgttcatgcatttcttcatatacttttcacagaaccctataagataggcactgttattcttttcatggagatagattacttgctcaaagtcacacaattagctgctgaatgtgtactactgcccaaattataaatcttaagttccgaatgactaggatttataatcacaaaacagcaaagtgcctgcaatgcagtagggacttaaaaatattaagcgagttgattaaacgttacctttatgaattagtacattaaaaaagaaaaaaaaatcttagactattgagtgttttcttattatatgcagattctctatataatttaaacttgctaaacttggggaacataacagaaaataggaaagttagaatgtgtttgtttctgggttcacttgtccaaaaatattttaaagaccatccgtgttaaaccatgtattacgcactagtgatataaccagtataaatcagaaagagccctgccttctcagagttcatagtggagctcatctaccacaggtctctgttaaacactggcttcaaaataaaatgaaatctacaaaacccgtttccagggaaactattatcaaagtagagtctgtttcttttgctccaaacacccttcgtttcttttcatcctagtaatacctacccatccattcacccttaaagaatgtgcttaaatgttaatttgtgtaaatagaattgctaatgataatcacttccttctcagtaatgaaatgatattacttctcagtaatatcatttcataatatatatcagctgtgttatagcacacattattgtgattactcaattacctcttgaaggcaacagtcatatttatcgctttgcatactgccttaggtttagtaggtgcttttcttaggttagaaacagataatgtttctgagatgaggattcctgtgcaagtgatttattaagaaagtgctcttgacccaggggaaactggtaagggagccgggggcaacaggataggcaaggggtggaagtctaacaaagatttgatctcagggcaattcctacagatgataaaacttcagtctgatcctatagggtaaccctggagtgaaagctaagtctgagatatcttgtcccaagaaaagaaagctgggtttttatgtcctgcccatcaaacagaggatgtaaatccctaggcatttctagctatgtgtatgtgtatgtgtatgtgtatgtgtatgtgtagtgtatgtgtagtgtgtgtgtgtgtgtacatgcaagcactgcaaaagagccatcagtagcccaagggcagtgttgtgaaaaagatgcaaagttgctgactgttagatgcaaaagcacaccaaaggggagcttaggtgcacatgtgcatagtaaaaaggaatctgagggatctggcacagtaatgataatatctactacagagctcaatattcattttgtaagataaagaatcaatccattcatgactcaggctaaggcagcataactgggataagtcacatgaagaatcaatgggttcagagtcagagttcagagaaaaacaaaaactaaacaataccatttagactattgacattatctcttaacttgctgcttccttatttaatttccattacacaataaatcaccagctttctccagtgttcactgctggctaaaacaggtactacaaaggagaaggtacataagtaggaatggtatttggtgtaagcagttactgaagtagtctagagagctgagagtcacaatctgggtccatgaccaaactttctcagattcttattttttcagaagagataaaattaatattatgaatataagttgaatttagaaccatttatttttttctgttttctactgtattctacagttctcagatttctgttagccatagaactcctcatccaaagagatgtacacacaaattgaaaccatccatttgagcctaacaggttttacaccccaggcgcttggcataaccatgggaaaagtgtgcataaaatgttatattcacaatttaatacaaaatctcttatgtccttcaactttttcctacaacaaatcaaactccaaatattacacctctttcccaacacacagcaaaactgcataacagtagtttatcagctagcagtttgaccctgagtaaatagtgacagtttagaacatgacagatctggctgggcacggtggcttatacctataatcccagcacttcagaaggccgagacagagggatcacgagatcaggagtttgagaccagcctcaccaacatgttgaaatcccatctactaaaaatacaaaaattagccgggcatggtggcgcgcgcctgtaatcccagctactcaggagtctgaggtaggagaatcgcttgaacccgggaggcgggggttgcagtgagccaagattgtgccacttcacttcagcctgggtggctgagtgagactctgtctcaaaaaaaataaaataaaaataaataaataaatgaataaataaataaataaataattatgacagatctggccctgaattttgtctctgctatttattataaggatcatcttatacaattaatttcacttcagctttagtttccttatgtataaaataaaaataatcatataatctaacttgcaatgttgtatgagcattaaataagacaatctgtatgaattcctaccttcagtgcttaacaaaagagaaatcgcccatagatggcagcattttaccagaactcaaatctctaaccatttttatttttttaagcaggagaaacgttattcttcaagccataataatattggcataaaggtgtacatattttgccactctacatagtgttaatcaaattttccagttcacctaagtgtgtcagttcaagggctcacaaagtagatgccaagatggaataaggagtataagagatttattggggcgtgacaaagactgcttccttggccaaactttagacagccttctctgagccctcttttcaactaggccctgtctttggactgcctagcccaggtttagcaagaatcctgctgaggcagtgtagtaagaatgccttgatatcagattatcctggcctgacttcagcaagaatcctgttaagttggtttagcaaaaatgaccctacccttgatgtttcctcttcctaactttccatcctctgatgcccctcattctgctcattggctataaatccccagttatctactgtattaggagttgagcttaatctctctcccctattatggtagtgttaacatctattgcaatagtgttcccaaatgaagtcatccttacctttttacaaatgtcagaatacttttttttaacagatgacacctatgtaagataagggggaaggggccaagagtaggtcagaaaaatcttctgacaataatgttgttctgaccccctcctgtgaatggagaagggggaaagtaggaggaggggataggaagagcctcagagcacagtgcagctctgagaaggtcttggcaatagaatggagagctctagcgtaaagattgcccataggagacagtgcattgggcagaaatggccagacccaaattccttttccatgctcagtcattggctggggacttcctggggagagtgtatccttggctcaaatgcctacactgaatcccaaatcctaaaggcactgcagctggaggctgttagctaactgcactccccctatcaggttctctctccaatttccaatggagctctgagcagttgccacacttagtcaggtgctcatgttctgtgtttagatgacagtgtaatagaattgaaagcaatgtgtttcgagtctggacttactagttgtgagaccataagaaagtagctgaaaccctttgagctcagagaaaacatatggcagtgactgttccaggataatcttgagagctgtgatcattcactatagtctcaaggtgtggattccaacagtggagctattgccaaagctttattttcttctttctccatttctacagcctgattcttttacctgctcaaaaaaccttgatatgcccattttgaaagccattgcttcttttccttcttcctcagtttccccaaattcagtttctactaatattaatgcccaataacttgcataagtcaggatgggttatgctatgctgcagtgacaaacaacctaaatatctcagaggctcagtcattctacatacctagcagctgcaactctgctatacattgaggcaggaagaaaaaaaaagatatggtgaaccacacattcactcttaaaatttgtgctgcaaaatggcacgcattgtttgaccaaggaaaatcatgttattaaacctaatgtcaacagaacaaaatgcagaatcctcttataagacttctcagtaatcaaatctactatgtagtcccctagttttcataacttcaaacggcaatctgaatgtctttttttccttacaacatgtattctgatatcagtacttccatttgtacagtcaacagaaactaagaaattagctgcatgtgtctctcttaagaactccttctgaaactccttacttgagctctcacatttgtttgacttcttatgactgcagcaccttagcaaatatattctaaggatatcatcgagctttgtatgaaatgcattaatcattcatgcagttttgattggcttctcttctttatacagtatatagcagccaagcaaggtcactgttgtaagatttattacaaagtgtcttactgacaatcgatttttctccttctaatatcttattgtgatacattagcctatgggctttttttggtcattatttagaagagtaaaagtagcacttatctgtcctaattctttaacaatcagccattgtaagaggaaattcagaagggaaaaattacaatgatgtattgtttccctagtcacaaatgtgaaataagtcaataaggcaaatgagttagctcggaatattcagtggtcccaggaattactgccatttggtactggtaccatttttaggtagaaatgtagtgaaatttgcaatctataaaaatgtcaggttgtatctcttcctgaactgtcctcttcccatttttcattagaatgattttgtaattccacagtaatctttagtaggaaatacttatagaagtaatagatggttttaaaaactccaaagatcagtttatagaatatgatacactttttacattaatgcgttttggaaaaaatgtgtaaaagtaaaaaatgtttttatacaaatcaaatatgtaactttttaagaagatacttgaaaaacgtacatgatgattcccttttttttaatactagttgtcatcttttgatattttgtaattggaagcctgcctttccaattctgactcttgctttgtgtcttcttacaactataactacagttcctaaactgtgtatcaaggcactttgtgatactaagagctgttttaaaatttcgaaacagattgacttcttgatttggttctttgcttgatcattactggtgtatagaaatgctattgatttttgtatgttgattttgtatgctgagactttattgaattcatttattaaatctaggagttttttggaggagtatttagggatttctaggtataagatcatattgtcagcaaagagagataatttgacttcctcttttctcatttggatgccttttctttcttcctcttgcctgattactctggctaacacgtctagtactatgttgaatgggagtggtgagagtctgcatccttgacctgttccaaatcttgggggaatgctttcagatatccccattcagcgtggtgttggtcatgggcacaataaaagaaataatcaatagtgtgaacagacagtctgcacaattggagaaaatatttgtaaattatgcatccaacaagggactaatatccagactctaaaaggtactcaaacaactcaacaaaatacctgcaaataaccccattaaaaagcaaacaaaggacatgaacaagcgttttgcaaaagaagacatacaaatggccaagaagcatatgaaaaaaaaaatgctcaacatcactcttcatcagaaaaatgcaaatccaaaccacaatgagactccatcttacaccagtcagaatggctattaaaaggcaaaaataacagatgttggtgaggatgtgcagaaatcagagcacttatatacactgttagtgggaatgcaattagtataacctctatggaaaacagtatggagatttcccaaagaactaaaaatagatctaccattctattcagcagtcccactactgagtatgtactcaaaggaaaaaaaaatcattatatcaaaaatattcctgaacccgtatgtttattacagcactattcacaatatcagaaatatgaaatcaacctaagtgcccactgatggataattggataaagaaaatgtggtatgtatacacaaataaatactattgatccataaaaaaaaataatgaaatcatgtcttttgcagcaacatggatggaaccggaggacattatctgatgtgatgtaactcagaaagtcaaatacggcacgttctcactcataagtggaaaccaaataatgtgtgtacatggacatagagactggaatgataggcaatggagatttgggagggtgagaagttgggggtggcggtgtgtggggtgaaaaattacttagtgggtaaaatgtttactctccaggtgataactacagtaaaagcccagactttgctactatacaatttatacatgtagcaaaatggcacttgtactttctaaatatatgaaaactaaaaaacaaattcaaaaggaatctactaatatccatcagacacagtataaactactaggaaaggtagttcccagtttcaccattagatcacgtgaaattcctttttggtaacattgtatctttgtgaaacggggttttagcaatttccaggataaaaagaaagtactgcacaaaaataatatagtacaagaaatgagggcgatcatctacaaactgattccaaggtttgagagtgtgtacagtgctcaacaggtacatgcatcttgtggctagttaaaaatgaaataaaagttctatttttcttttaatctatgtgtattacattttttccccaagtgactactaaattatcagtgaaaaatgcctattaagttgtcagggcataactcaataaacaaaactataacatatgaattttggtctgggggccccacataaaattttactgaaacactgaggttattttgctgtgagaacacttaagaccctctgaactatatgtattatctccagtgaaatatttgaatataacaaggagtgttacagtggcaaaactgttttcaaattattcaaaataatagatgatatgaatttataaatatatataaaatagtgtcgtgcaggatactttatgccctccatgaatccaaaagggaaaatgtttgttgcatctgaacctcaacttataatttaaccatacataattttctatggtggataataaaaatattcagacatgttcattaattctaatttattaactcttagttgatctagttgtttaaaacatgttattttgatcaggtagtagacattgatggttgctttccctggaatctacccacttaccatcatacacacacacacacacacacacacacacacacacacacacacaagcacatcacacatacacacacacgtatacaaggcaaccatgttatcctacctctttgctccagatttggatctacccaaaccagtcaacataattccattccccttaggccaatgtgtggttaagaatgagcatgtgatgtgaattagttggcctgggcacggtggctcacgcctgtgatcctagcactttgggaggccgaggagggcagatcacgaggtcaggagatcgagaccatcctggccaacacggtgaaaccccgtctctaccaaaaatacaaaaagttagccgggcgtggtggcacacacctgtagtcccagctactcgggaagctgaggcaggagaatcgcttgaacccaggaggccaaggttgcagtgagtcgagatggtgccactgcactccagtctgggtgacagagtgagactccgtctcaaaataaataaattaattaaaatgttgcttagcactgttttatggttggaagaagagatgctctcacttgctcactgaaggaaaactaggcagcctgtgtcacaggttgtgttagcagccatcttaaaagagttaggggaacaagcctcaggaataggtcaactctatgaaggcaaaaaacagttactctatcaaaataaaaagttagttttggtgacacttttactttgctgaaccaattctaacttgaagccatctacgtgtaaaccaacctgcaacacaaacatatttggaattttcagaaaattgagccaataagtgttatctttgttaaaattttctgttacttgcaaccaaatcatttttagtggtacagatgtcttactccttttatagacacaagtaataacaccttagaaagtaatgctaaaactcaaacaaaatttttttgttgttgtgggaaaacaatttgttgccattcaaataatgataataagtgaggttaattctgtgtgaggttaattctccatttctatgaaaaaaaatcacacttatttaatgtcatgtaactaccatatatgtatgtgtgtttgtgcctacatgagtatacaaatacacggatgtactaaaaaaaacagagactaactttcgttgagtttctatcatgtgtgagccaagattatgttatttaaaatatgttttctcatattatggtttattaaataaataccctcaaactgcacaattcctctttggtaaacaaaaatatttttaaactaattaaatattttcaatctaaaatttccccattataggtacatgctagaaaaatagtgatggtcatttaaatcagtggttctcaaccatggctgcccatgaccgtccttggttatatgaattttgtttgtctgtattgaggtctatgcattattaacaatgctccaggttattctaaatgtgcggttaggatagagtaactccattttatgagatcttcctcaaagagtctttgttcccactacctacttttgtttctttaacctctctgccaagtttctgacctatgaataattagccagcagctttatcctgttttaattcagagtatagacagtcaagctgcagctacatattggactctgtcaggaacctaagctaaaatatcaacccattttttttctttcttcaccttccttcagtaaatcaccagctgtcagcatctcctttggattttctggcttttaagagtcaatgcttaacaaacatcattttgctcccttagctgaattgaagggcatcagtaagaaatctattaggaggcttgagaatgtgaacttgggcatagactttaattcaagtaattttccttgctgtctgtgaagtaacagtgatgggatgattgcctcctcccacgttttcttccaagctctcaaaatgctaagcattactaatcaatagcaggtaaattagattcaatgaaaactgttggtgtttattttcaaacacattaccacagaagtcttgctccaaatgtgacatctgtgtttcactaaaaggtaagaaaaccatgactatttatagcttaaatcattgctatgttgttttgtttttctcaatagcgctttctcactattttctcaaattgcaggactctccagaagtgaaataaatttcagagtcctaagtattatatttcattacaatacaggatacacaaaagccttcaaaataatttgattcctaattttttgaggtttaagagagattttctggacacggtggaaacaggatatacgctttttttttttgtgatctgaatcacgcacaatagtaccagctgcttccgttttcttactccgaacaatatctttacacactgccattagagaacagcactctcaggcttattaaagtcatttgtaaattgttgaaggcaaagatcacagttgggtgtacatttcccaaaatgtattgttactagatgtcaggcttattcacttcctgttatttaaatgagattccagagtcttatatatgagtattgtgaaaatataacataataaaatacagaactatatctttcctggttccttaaataattgggttgtgtgtgtgtgcgtgtgtgtgtgtgtgtgtgtgtgtgtattttaaagtctacattttatttgcatttcagaattctggctaaaaggcttattttatatatacagagagagacttttatacaaccaatatctagaactctctaaactcacttagttctctatgaaatcaccaaaggtccaactaaaatcctgcttaatataacataaaatgctgctagattcaatttagaacttacccctattattttgtggcattactgtagccacctaaggtaagtgatgaagagaagaaaaagtacgcatcccctcatcatttcctatctcctgaaaagtgttatctgacttgaagaagaaaaacatgtcttggggaaagaactatagacaaatagaaaaacctacacttgaaagattcaaagttaaaatggtatctacagtgagaaagcttgttctctccgtctgacagaattctgcttttttcatcagcattcagttttaatgcatttttcagtaatgcaaacaacaataaacaaatgaaaaagcaaagaaaacatatcacttagaaccagatgtccgatttagttatcatgtaatcagaggagtcaaaagccaatttcactcagtaaagaaaaagcagatatgtaacttttatagccaatgatgctttcactgggaaaaaagaggttgttaatgtgaatatgcatgtgaaagttactattgtctttaacgcaagcttgcaatattttcaacattcagataaattactaaaaaaggctttttccttcaataagcaaattcaggagaacttttaatacagcaaaatctaaatgtgattacaagttacactttttgtcaaggatttgaaagactgtctattaggcttcaggtatttgtgttatgggctttaggaaaaacatgtaatacatgcaacgtacagagggttttaaatttgaaaatgtattagcaatattattaagatatccaattaagaagagtcacacataatgtttattttggtatcaaaggaaacatggaaattttgaggtaaggtagatcaacactcttcattttacagataaagaaactcacctcaaagaggtcaaatgactcactaaatataggcagttagcagaataatcaggaaaagaaagcaaatcttttagttgagtcacattttttccattacagcacacctcactgagaagaatccgaaacgtcacagattatcaccatctacagaatgaactatgtaacaaacacaaacataaatttattttaaatacaaacgtacattaatttttaaaatttagcttgtctcattagataaactgtattaaatacaggaaagtataaaagtgcaaaaaacatacttagtttaaaaaggaggaaatgctgtcatttgtaacaacttcgatgaacctgggggacattatgttaagtaaaataactaggcacagaaagataaacaatgcatgtcacttacatggggaatctaaaaagtcaaactcatggaagcaaagaatggtggtcaccaggaactggcagcaattagggaagagaggcattgggatgatgttagtcaaaggatataaaatttcacttagatatgagagataacttcaagagatccattatacaacatggtgactgtggttaataacaacgtattgtatacttgaaaatagccaagagagtagattttaagtgttctcaccataaaaaatgttaagtatgtgagttaatagatacgttaattagcttgatttagctgtttcacaatgtacacatattaaaatggattaaatatttaattagttttctctaaattgtctactttgggtccaaagtctgtgagaatcttttgtatttctgtgggatcagatgtaacattacctttttcttttctgattgtgctcatttggatctttctttttttctttgttaatctagctagcagtctatggatctcgtttatcctttcaaaggaccaacttggttttgtcgattctttatatggatttttgggtctcaatttcattcagttctgctcttggttattgctttgcttctactagctttagggttagtttgttcttggtttttgtttttttagttcctctaggtgtgatgttagttaatttcagatatttttagctttttgagattagtagttagcacaatacattttcctcttaacactgattttgctatatgtgaaagattttggtgtgttgtatctctgttttcattcatttcaaaaaattttattaatttttcattaataaaaaattaactttattgtttacctaaaagtcattcaggagtaagttgtttaatttccatgtaattgtgtggaattgagagatcttctgggagttgatttctatttttatccattgtggtctgaaagtatggttagtataatttcatttttttaaatttattgagacttggtttatggttgaacatgtggtacatcttagagtatgtttcatgtgcagatgagaataatatatattgtgtggttgatgggtggagtgctctatagttgtccactaagtccaattgttcgaaggccaaatctaaatctccaatttcttcattagttttctgccttgatgatccatctaatgatttcagtgggatgttgaaatcctccactgttattgtgtggctgtccaagtctttttgtaggtcttacagttatttcatgaatctagatgctctagtgttgggtgtgtatatatttaggatagttatgcctttttgtttaacatttatcattatgtaatgcctttctttgtccttttttactgttgtttgtttaaagtctgcttcatctaatataagaataatgacccctgctcttttttgttttccattcgcataacatatttttctccaattctatactttgagcctatggttgttttgtgtgacatgagtttcttgaagacagtagatgaatgggtcttgttttttttccaacttgcaactctgtgccatttatgtgggggcatttaggccatttatattcaaggttaatactgatatgtgaggttgtgatcctattgtgaagttgtaagctggtctctttgtagtttctattttgtgtttgctttatagggtctttgggctatgtactttagtgatcttttatggtagcaggtatcattctgttgttttgatgtttagaattcccttaagaatctcttgtaattctggtctagtagtaacaaattcccatagtgcttgcttgtctggaaaatattttatttctcctgcaattatgaggctgagtttggcaggatatgaaattattggttggaatttcctttctttaagaatgctaaaaataggccctaatctctcccatctgataagttttctgatgagaagtcagacactcatctcatgagtgtctttcaggtgttctctgaagttcatgtatctggatgtctacctctctagcaaaattagggaaattttcttgaattagtctcttacatatgttttcctggttatttccttttcttctttctctctcaggaatgccaataatttgtaggtttggtcactttacataataccaaatttctcaaggacttaatcttttagaatccttttttatttttgtatgactgggttaatttaaaagagcaatcttgaagctctggagttcattcttctacttagttcagtctattgataaagctttcagttgtattttaaggtttttgtactccagaagctctgattaatttctttttaagatgtttaccttttccttcatttcctggattgatttagaagcttatttgtgttgatattcaaccttgtcttggatctcattgaattttcttgtaatcttgatttgaagtgtctatctgtcatttctgagtttccattctggtttgtgaccactgctggagagctagtataatcatttggtgtcactacattcagattgttcatggtgacagaattcttgcactggttccttctcatctagagatcctggcaattctaatttttgtaaatattttcatgctgataggatttttttctttctttccttataatattattgcttttttttttctttcccttttcttttactcccatccttatgggatgtgactttagagggtactgattagggtcttttggctttgcttctatagccctatgcacttctttcggcaggttttatattggactatgcagtttaacccacaagccagtagatgacacttatgggtaagatactactgcagccaatatgactaggtacatacttgatccttctttactggaagaagctctctgttgcctcaggcaacgggcttatttgtggagtgcacagtgggctgagctccctgccctgccccagaggtactgggtcaagatgggcaggtccagaacagtcaggcccctctacaggtaccccagtggcaggcagaagcaccagtgctttggaggaatccagtgggtacccaccaagcacctagaggtgtgcctaggcatggaggtgggaaacttcctcagctacaagttatctgcatggggggaagaggtagcctaaatttctaatccaggagagtcagtgctccatgttcctggagatctgcctggccatgaagtggagaggcatccttgcaccaggatctctgcacaggaagggtggggcatctcagctcgttagtccatgtgagtggatgctctgaatgcctggagatccgactgtgtgtggaacagagaggcccccacttgcaccatgatctatgcacaagaaaaattaatattaatttttttctttttaaatgaatattaccttcctggaattcactctatattagttaatagggatctttctcattctgttttacagttacatagtactcacttgtgtgtatgtaacatagtttattcaacctctctctaagcttggacatctaggtagttttcaatattttgtgattacaaataatgcttcaataaataaccttggtcatttgtattttcatattgttggagttgtgtcttcagggtaaactctgagaagctggacttctaagttgaaggataaatgcctatgtgcctttgatatattttaccaaattctccttcatatgagattgtaacatttggattgttactggtaatgtatgagagtgcctgtttaccccaggctcagcatgaactttatacaaaagttaagatgatgctgttaagatcatattatttcccaattttaaaatatcacattgtattacaggcacttccatatgccattaaagccctctgtaaatatgattgtatatggttacattattgtccatgaaggcactatactataatcaatgcattccattttgtacatttatatactttttaaatattatttttacactaagttacaatgaatatttttattttataatcattcatctatgtgtaagactgtgtcattagaataaatttctaatattttttcacttagtatcttcatatgaaagacactgaagcttagaaaagtttttgcattctgtgaaagatctttagcagaaatattttgctaaaatcaaacaatttacacaaatatgtggggcaatgaagttttattaagtacagtcattaatgcagtggagaggagaggaaagtactgactaaagcaatcccactgacctccacgaatacttcaaaatgtctttttgtgttttcatcggggagttctggatttggtgagctttagagttttaataaagagcttcagaatgattgccaagtacttcaagtgttcttgagtgcacttggtgtttgcaagaattttcatttcataaattactttttgtagtaatttaagaaactaagtgcttttctttaagcacccaaatttatggtacaatctctattgaaaatttatgaacttgtatcgtcttcctgtcttaacattgggtcactcttctgagaagcaagttcaagttttttatagaattttccttttctctggaaacagcaggctcttagagaggaatgcctgttttcattaaagctgtaacatagctgtggggattggaggttttccctgtggacacaatcatcttataagctacaaaatactggtatttacactgacaataatgtatcagtcctgttcaatgacataactgtccttccctttgctgccaacacatcaggccccaagcctcccttactgtcatgatcaataatgcacccctgtcatgatcagtagtgacccagcagcaatttaaaacctgctggtgtttctacctcaaatcttgcctggctgcctggctgcctggctaacacttttgccccaaatttttctggtttaatgagaagtttgtttgacaaagaacctgccaactgtagctcaggttgctttaccagtctcacttcaaattgcatattccttggtatatagcaccatctgtatcatgctgctggcctgtttgcatttggccaagtctgggcctaggtcagggaatttctgtcaatcattcactgccatgagatagaggagtctgcatgttaaacttcacactgcatctagctggaaaagagatttatagcctttggctccagaaccttagagcaactatcccaatcaatattatagtctaaaattttgacctaaagctattttttcaaggttttgtacccagcccacagcttctctttaattaagttgggctctcttacacattttttaaaaaaatcaaaggaccaattaatgggtctttaccaccaatatatataactagttcctacctctccaaagcttcaactctctctctcatacaaacatgcacacatacacagttgcactattaattaaactacattcacaaaatgtattaatgtgcctttctcccaagctaaactgtgtacttctaatagatagaaaatgagtcttatgcatgtatgttccctgccttcttgggtctagcacatgacctggaacaaactcgtttcttgactactctctttgaatgattaaatccataaacacatgtgttaattcctttgaaatctgtgttactaaggtaaaagaggtgttcattaattatttccaagctcaaacatttgtttgaagactaaagtaggaggaagacaagcatcaacaaattcagagctcctttaaacgggacttcaatggcaaataaacatgttctttcttttgacagttatgaagtgaagaaaggtcttgactgctcagtttcatgtagatctgaatatacacatctgggttgaattttcccaagtgactatagccatgaaagtgttaaatcatattcattaatgaattcatataaaggagactcatgctcttaatcatcctgatattaggaagataaaatttggaattattattggaaatggatgaaagtttcaattgggtataatggaaagtaatgcagagcagcaatgagctctgaaatcacgcatttacagcctataacttgaaatcttgatatgtttaagacgtaacaacagcttgtaaaaactcttgaatactttctgtacttctcttttttaagcctatgaaagtgtaaacttgataagttagggaatatggatcttttaataatgaacacacactcatagtgggtatccaaaaacatattattgattgttttatatatagattggagaaataaaagtaatgagagtagacatgctagaatatttcatatatccatgaggtagtaactggataagacctatcctcttatcatgagttgctgtagcactggacacattctttgagacagctgtttccaggcactgagcaaagctgaaaaaaaaaaaaaaaaaaaacctttgatacttaagagagggaaacacatgggataagtcatttttcaacctggtttctgtctgggggtagttttcaggatgcgatacagggaggtgaagcgtaagtagagaaacaagggagaaacaatacaaatggtgattgacttcttactggaaacaatggctgccaaaatcaggaatatctgctcttcaaaagacactattacaacaataaaaagatcaatcaaagactagaaaaaaatatttgcaaatcacaaatttgagaaaggcttatgtccagaatatatgcttcaaaatcagtaatatgaaaaataattttgaacaggtacttgttaaagtaaaagttattcatgacactcactaaagaatggtaagaaagactttatttaggactactgcaataggtatatggattactgcaatggtgttttgcagtagagggagagggactgggctcaactctgaatacaaggaaaagtgggaatttatacacagggagtagagagggggatcagtaaatggaaattattaaggggaagcataactggtgagggggatcaataaatggaaattattaaggggaagcataactggtaagggggcgattctgactaaacagacctagctatatttttgctaaagacaggccagggtaatcagacctggggggctgatgagagacaaagatttcgtttgatatcaaggatgtaggattctggctaaatcaatttagcaggattcttccccaaattgggcaatgaaaagatggacatggaagtccaaaagttgagccttaattaggaagataatgcagagaagcccgaataaagtttggtcaaggagaaactccttgtcatacttcaccaaagaagatgtacagttggcaaattagtacatgaaagtatgctgaatattattgatcattagggaaatcaaaactaaaatgatgaagtaccactgctcacctattagaacggcaaaataatttctgataagtactggtaaggctatgaaacaactagaaatacattgctggtatgaatgctaaatagtatagccactttggaaaacagtttattggtttcttgtaaagtttagtgttcaaaacaatcagaaacttcacacaagtgaaataaaaatgttaagtttacaaaaaaaatctgctcatgaatgttcatagtggctttattcacaatcaccaaaatttgaaacaatagaaatttttttccaatgtagaatgaacaaaaataatgtggtatattcacacaataaaatactactcagcaataaaaatgaatgaattggccgggcgtggtggctcatgcctgtaatcccagcactttgaaaggccgaggtgggcggatcacgaggtcaggagatcgagaccatcctggctaacacggagaaaacccgtctctagtaaaaatacaaaaaaattagccaggcatagtggagggcgcctgtagtcccagctacttgggaggctgaggcaggaacccgagaggcggagcttgcagtgagccgagattgagccactgtactctagcctgggcgacagcacgagactctgtctcaaaaaaaaaaaaaaaagaatgaattattgatatatccaatgacttaatagatctcaaatttgttatgctaaatgaaagaagccaaatttaaaggatacatagagcatgatttcatttatatgctcatgtggaaaagacaaaattatatggacagaaaataggtccatagctactagaggctgggagtgggaggacaggttgaattgaaagggccacatggaaatatgttttgggtgatggctgtgttctatatagtgattaaggaaatatatgactttatctgtttctgaaaatagtaaaattgtatacctaaagggtaaattttactgtttgtaatttgtaccttaaaaaatgaaaaacacaggatgtataatagcccttttcagataaaaactgaagaaatttgctgacagcagatctggcctctgaaagaagataaagaaaatcattcactacaaagaaaaatgatactagagagaaacagaaatcaataacaaaatgaaatgagacagaaacggcaaatatgtgggtaaatataaatgcttttgttttgttttttagtttctatatttttaaaaaactaatatttgaagcataaataaaatatagtaatgttttacttagcaataagatacactctaataaatgcttttggtttttgttatttttaacttttatcttaggttcacaggttcatctgtaggtttgctatataggtaaactcatgtcatgggggtttgttgtacaaattattttgtcacccaggtactagtcctagtatatttatttttattttatttattataaatattatatattatttcatatatattatatataataaatatcattataaataaaaatatttatttttcctgatcctctccctcctcccatcccctaccctcaagtaggccccagtgtctgttcttcccttctttgtgtccatgtgttctcataatttagttcccacttattagcgagaacatgtggtatttgctttgtgtttctgtgttagtttggtaaagatgatggcctccagctccatccgtgttgccgaaaaggacatagtcccattcttttttatgaatgcaaaatattccatggtgcatatgtaccacattttctttatccaataatccattggtggacatttaggttgattccatgtctttgctattgtggatagtggtacactgaacatatgcgtgcatgtgtctttatgatagaaggatttgtattcctttagatatatacacagtaatgggatggctaagtcgaatggaagtctttttttttaggccgttgaggaaactccacactgctttccacaatggttgaactaatttacactcccaccaacagtgtgagagcgttctcttttctctgcaaccttgccagcatctgttatttttttacattttagtaatagcaattttaactggtgtgagatggtatctcattgtggttttgatttgcatttctccaagatcagggatattgagcttcttttcatgtgtttgttggctgcatttatgtcttcttttaaaaagcgtcagtgggcacagtggctcacgcctgtaatcccagcactttgggaagctgaggcaggcagatcacgaggtgaggagttcgagacttgcctggccatcatggtgaaaccccacctctactaaaaatacaaaaattagccaggcatggtggcgggcacctgtaatcccagctacgagggagattgaggcaggagaatcgcttgaaatcggaaagcagaggttgcagtgagccaagattgcaccactgcactccagcctaggcaacaagagaaaaactccatctcaaaaataataataataataatacatataaaaataaataaaaagtgtgtgtttatggactttcaataagattttttttcttgtaaatttgtttaagttacttaaagatgctgaatactaggcctttgccagatgcatagtttgcaaatattttctcccattctgtatattgtctgtttgcttggttgatactttcttttgccatacagaagctgtttcacttaattagataccatttgtcaacttttgcttttgttgcaattgcttttggagactttgtcatgaaatctttgccagtttctatgtccagaatggtattccctaggttgtcttccagagcttttatagttttgggttttacatttaagactttaattcatcttgaggtgattttttgtatatggtgtaaagaaggagtccagtttcaatcttctgcatatggccagccagttatcgcagcatcatttattgaatagggaatcttttccccattgcttttttttttgctggtttgttgaagatcaggtagttgcagatgtgtggctttacttctgggttacctatttttttccattgatgtatgcctgtttttgtaccactgccgtgctgttttggtgacttatagccctgtagtgtagtttgaagtcaggtggcatgatgccttcagattgttctctttgcttaggattgcatggctattcagattctgtttcagttccatataatttttaaaataggttttctagttctgtgaagaatggcattgatagtttgatagtaatagcattaaatctgtaaattcctttgggcagtatggccatgttaatgctattgattcttcttatccatgagcatggaatgtttttccaattatttgtattatctctgatttatttaagcagtgctttgtagttctaaatgagatctttcaccttcctggttagctgtattcctagttattttattattttgatggcaattgtgattgacactaccttcctgatttggctcttggtttgggtattgttggagtatagaaatgccagtgatttttatatgctgattttgtatcctgaaactttgctgaagttgtttatcagctgaaggagattttgggccaaaactatggcattttctagaaatagaatcatgtaatctctcaactgggataatttgagttcctctctttttatatagatgccttttatttcttcctcttgcctgattgctctggacaggatttctaatactatgttgaataggtgtgatgagagagggcatccttgttttgtgctggttatcaaggagaatgcttccagcttttgccgattcagcataatgttggcttggttttgtcatagatggctcttaatatttcaagttatgttccttaattgcctagcttgttaagggtttttaacatgaaggatgttgaattttatcaaaaacactttctgcatctattgagataatcatgtgttttttgtctttacttctgtttagtaataaatcacatttattgatttttatatgttgaaccaaacttgcatcccagggataagacctacttaatcgtggtggactagctatttgatgtgctgctggattcagtttttaagcatttttttgaggatttttgcatcaatgttcatcaaggatattggtctgaagttttccttttttgttgtgtctctgcaaggttttggtatcaggatgatgctggcctcataaaatgagttgggcaggagtccctcctcctcaatttttgggaatagtttcaataggaatggtactacctcatctttgtacatctagtagaatttggctgtgaatccatctggtaaagggctttttttggttggtaggctacttactattgtttcaattttggaatttgtttttcatctgttcagggattcaatttcttcctgattcagtctttgtatattgtatgatttcaggaatttatcaatttcttttagattttctagtttatgtgcataaaggtgttcataatagtctctcatggttatttatagttctgtggagtcagtggtaatatccactttgtcatttctaattgtgattatttagatcttctattttttcttctttattagtccagctaatagtctatctatcttattagtttttcaaaacaccagctcctggctttggtaattgtttgaatggcttctcatttctcagtcttcttctgttcagctctgattttgattgcttcttgtcttctgttaggtatggggttgcttttcttttgcttcttttgttcttttagttgtgatgttcggttgttaatttgagatgtttctcactttttgatatggacatttccctcttaacactgctttagctgtgtcccagagattctcctatgttatatcgttgttctcaatagtttcaaaaaaattcttgatttctgccttagtttcgttatttacccccaaagtcattcaggagcaggtcatttaatttccatataattgtgtgattttgagtgattttcttagtcttgaattccgtttttattgcactgttgtcccagagagtggttgctatgatttttcttttgcatttgctgaggattgttttatgtctgattgcgtggttgattttagagtatgtgccatgtagcaatgaaaagaatgtatattctgttgtttttggctggagagttccatagatgatgtctgtcagatacatttggcccagtgttgagttcacttcctgaataccttggttaattttctgcctcaatgatctgtctaatgctgtcagtggagggttgaagtctcccaatgttattgtgtggaagtctaagtctctttgaaggtctctaagtacttgctttatgaatctgggtgctcctgtgttgagtgaatatatatttagaatagttaggtcttcttgtggcattgaaccttttaccattatgtaatgccctactttgtcttctttgatcttttttggtttaaagtctgctttgtctgaaattaggaacgcaactcctaccttttttctgttttccattttcttggtagaattttcttcatctctttattttgagcctatgggtgtcattgcatgtgagatgagtctcttgaagacagcattcctgtgggtcttgcttgtttatccactttgctactctgtgctttttaaatgggagcatttagcccatttacattcaaggtaactattgatatttgtgcatttgatcatgtcatcatgttgttagctgtttattattctgacttttttgtatgattgcttcatagcgtcactggtctatgtacttaagtgtgtttttgtagtggctggtaatagtctttccttttcatatttactgcttttttcaggagctcttttaaggcatgtctggtagtcatgaattcccccaacatttgcatgtctgaaaaggatcttatttctccttcccttacgaagctaagtttggctggatatgaaatttctgattggaatcttttctttaagaatgttgactataggcccccaatctcttctgacttgtatggtttctgctgagaggtccactgttagtctcatgggctcccctttgaaggagacctgtcctttctctctagcttcctttaacatttttttctttcattttgaccttgaagtgtctgatgattatgtgtcttggggcgagattcttgtgaagtgttttgcaggggttttctgcatttcctcaatttgagtgttggcctctctagctaggttggagaaaatctcatggatgatctccttaaatatgttttccaagtttcttccatttgtcctatctctttcaaggatgccaataagtcataaatttggtctctttacataattccatatctctcatatatattcttcattcgttttcattcttttttctctattcttgtctaatgactttatttcagaaatccagtcttcaatctctgagattctttcctcagcttggtgtattctgctgttaatacttgtgactgcattatgaaattcatttagagagttgttcagcactatcaggccagttacattgttttctatatggatattttgcctgtcagctcctgtatcattttattttcagtcttatctttcataaattgggttgcaatgttctccagtgcagaagctatgatgcaggaggaacctgggggctgcactgcaaacaggtatggtcagattggggccccagcagaggccagctgacaaaggggtgctcaggtcagactagccctgtcttgtgcaagactgtcctgaagagttcagctctgatagttcccctagggagaaattatcctatgggtgcaagttgagctaggggatgtgtatctctggccatgctcttctagagacactcctgtactaaactctctgggctgcaaactggcttgagttctgcccctaccactactctaagcagctttccctgctgactcaagttgtggtggtcaaggagtctcctcctgccgggatatcagagacccatggtgagaacaggttcctccttacctattcaactaattccttccctgagagtccctggaggccaggaatgagtcccagtatgccatagccccatgcagtgttcccagcttcctccccactcagccaagcatctgctctccatctgctctcaatgattttcctatgaagatctactaggagtgtgccagtgttcccaatgtcccagtccctaggtgggagatgttcctcttggctgcatctagtccaccatcttggaaagagaacctaataaatgctttatttggcaatttcattgttgtgtgaacatcacagagtatacttacacaaacctatatggtattgcctactgtatacctatgatatatggcatagcttaatgttcctaagctataaacctatgtagcatattactgtactaaatactgtaggcaattgtaaggcaatggtaagtatttgtgtatctaaacacagcaaaggtacagtaacaatatgatagtataatcttttcagaccaccatcatatatgctgttagtctctgaaatttcattatgtgatgcatgattgtattttactgcaggatttttgatgtatgtagaagttaaatgcatgacaacatagcacacagtataagaaggaaagtagaattacacttttgttaatgttttgaattttatacaaagttatataatattcattctaagtagattgtgaaaagttagggatacaaattataataaaaaataatgaaataaggattaataggtatgaataaaaatccagcagaggatataaaataatagactaaaatattaaaataacaccaagaagcagtaaataaggacaaaagaaacgaataatgtgtgggacaagtagaaaacaaatagcttagaaggaagacaaataaatcatatcaaaaatgtgtcaattcactaggaagacatcacaatcctcaaagtgaatgaaccaaataacaaagttacaaaatagatgaagtgaaaattgatggaactaaagtaagaaacacagaaagccatagtcattgttggtgagtgcattaccctcctcagtaactgataaaacaagtagacaaaagatcataaggctgtaaaatctttcaaaaacaatgtcaacttactgaatctgattgacacttatagatcacctcaatttctgaacacattgtttttcatgtacacatgggatttctgtcaagaatgacaattgcggggtaataaaatatgcattgatacacttgaaaagactaaacacttatggcatatgttctttgaacataacaaaataaagttgaaaatgaataataagaaaatatttagaaaataccccaaactttggaaattaaccaacttttctaaataactcatgggccaaagaatgcatcacaaaggaagctaaaaatacatcaaattgaatttgaatgaaagcacagcatgccaaaatttgtggaatgctactaaagcaatacttacaggaaaatgtatacctttgcctgcatattttataaaataaataagattttaaatcaatgattagttcacttttcccattttaaaggctttacactacctaatttctatctttctataatgctacagtaattgagatgttgtggtattataaatggatatacaaatagctcaaaaaaacagaatatagcatccagaaaaagactcacatacaatcaatttttaagaaagagcttaatgccattcaaagaagaagttaatttgaacaaatagggctggagcaacttaataaatatagggaaaaactaaccttgtcccctttttacccagtgcacaaatattaatttgagatggattaagaccttaatataaaagctaaaactgcaaaagtttttagaagaaaacattacagaatattttggggaacacagagtctgcacagatttcttagagtggtcaccacaaaaatatattcagcataaagaaaaatgataaattggacttcatcaaaataaaagtctgcttttcagtaatcatccttatgaaaataaaaatgctaaccacagagggagtgaaaattttagcaacacacatgtctgcaaagaacttgtgtctagaatatataaatatctctcaaaaatgactaataaaaaatggacaaaatacttggacaaatactatataaaagaagatttgtaaatagccaatcagtgtatgtaaagattcgcatgttattagttatcagggaaatggaaactaaaactgcagaaatacaaacacctcagaaaactggttgacaatattttaaacagttaaacacataccactcatattactctatgattccacttcttggtatttatttaaacaaaaaacaaatttgatcacacagacttgtatgtgaatgcttatagtagttttattcaaaatagtcaaaaatggggaataattttaaagtctttcagcaagatggtacataaactgagatatattcaaataatgaagtaatatttagcaataaaaatgaactactgatacacaaaccaacatgtatgaatctcatagaaataatgttgacattacttggagtagaataatcccactcttctgtatttgtcacgagatgtgatcatttgcaaatctgcctgtttctagaggaaatatacaaaacactacatttttatgattctatttagatgaagttctagaacatgcaaatttaaccgatggcaatagaaatcagagcagtgatttcttatcaaggggaatatgattagaaaaaggaagcaccagggtctcttgaccttatattgagtggatataaattacatgtgtgtatattatatgtgaatgtttttattacatgtgtgtatataaaatctcatgaaattgtgatacaaacaggagacaggaaaatactggatagaagagggcaattccctggcaaaggccccaccctcgagcctggaaacccacagccataaatgggaataggcattcctgttttcacatacaaaggttgccttttggtccaccacatctccctatcctgtaccaatataaaccccaaaccccaggctccacaagcagatgagcagataagcaaatgcacagaagagcagaagagaagagaagagaagagaagagaaaagaagagaagagaagagaagagaagagaagagaagagaagagaagagaagagaagagaagagaagagaaggagagaagacaaggagtgtatgaacttcgagaggagttcagctgaggatgatcagagaggagattggccgctgagcagccaaactccagaggaagatcatgttttcactccatcccacttccagctccccatccttcctactgagagctacctccaccactcaataaaacccccgcattcaccacccttcaagtttatctgtgacctgattttttctgaatgtcggacaagaacttgggatacagaaagctgtcacactggctcactgcccttgcgaaaaggcagagagtccactgaaatgtttaacacttaagccgtctgtgggaagcaaagctaaaagagcccaaagtaacacatacccacttgggttttgggagtctcagacatccatccctagatgctaccatcgggccagagcccaaaaaagggctcaccccagctcctgcacctgcccctctgcatgttcaccctcctgtaaggggtttgagtgctggacatacgagccacacccctgtcgcatgtcctgcaaggaagatcagggaactctcccatttcaattgtacatttacagtctgttcatttcactgtatgtaaatttaaccttgataatatttttaagtttcaagttaatttgttgagaaaatatatttagactgattaatacagagggaaatttgcccaacatacaagaattccttttcttttttgatctagttttgtttacttgcaaaaattttacatgtagttttgaaacctcaattcaaatagccgtgtgttctgtggctctgttcttaaaagtcattcagcatcaccaaagcacatatattgatttaacagtcaatattagcttttaagtataatagatatataccatgtaactactattattcatatatatctaagttatcatttatgtgggagaaggttatttaatttcttttactcaaggatttaaaaaatagaccaggaagattattgaataaatgctcaagatgccttgtaatcagcagtgttggataaaaatcagaaaaaaaatcttttaattacattggtggtttggataaaatgaattcaaacctttttacttatttggataaaatgaattcaaacttttacattacttagagtagaattattcactcccctgcatttgacatcccctaaaggagatgtgattatttgcaaatctgactgtttttagaggaaatatcaactatccacaactatttgcagtacttaagttcagcggatctaaagactcttgacacaaaatattactaggcatgacatcagaaatttaccatgacaggttgctaaaaatttaaggggggatacactatttttgtcttgattaggatgccagcattcatctgtactagctaatctcaacaaggaaaggtatgggggaacttagatgtctgcagctttcagcaattggttcatctatctgtttccagaataagtgaattacttatcagtgactcagcacgtctctggtgtttgaaggtgtattgcacagattaaaatgggggtttatttgtttctggagccaggaaacaaatccaattaaatgatttgaaaagatttttatttctgaaagttatgaaaaatgtctttaatataaaaattgagtgtctgcattttatgaaccaccctgtacttagactccaatgtattttcaatacttgccttttcacatgttaatggctattaaatgcccatgtgttgtaaataaaatttcagaagatattagaataggaaataaaaatgaaaaaaaaaaagctgaagctacactttctctttcctaacagaacctcaattttgtttgggtatctactccatctccagctccacatggaatggctatttgatgatggaatcagtgcagtatttctcttggctattcttgtccagataagttatgtaatctaagttaactaatcagagttaattatattcatcttttggagagaagtcattctgttttgtttcaatgaataaattaaaaactaagcattcccaggtcagacacggtggctcacgtctgtaacaccagcactttgggaggccgaggcgggcagatcatgaggtcaggagtttgagaccagcctggccaacatggtgaaaccccgtctctactaaaaatacaaaaattagctgagtgtggtggcatgtgcctgtaatcccagctacttgggaagctgaggcacaagaatcgcttgaacccaggaggtggaggttgcggtgagccgagatcgcgccactgcactccagcctggtgacagagtgagactctgtctcaaaaaaaagtaagcactcccagttgccataggcatgctcctgaaaataagttgatatttaggagagcaaagtaaagagatgcatattttattgaatcattgaaacactggtgtttctgtatttgaagcctgccctacctctaatcttcctggtatgccgagaaatgtatttccttatggtttatggaatttgattcagtctttcttatctttttaaaaaaaatttatgtaattttatatattttaagtttatttatttatttattttaaaaacagagtcttgctccatcatataggctggggtgcagtggcttgatcatggcctcaaactcttggactcaggcagtcctcctgcctcagccttctgagtagctaggactacaagcaaaagccactacactcagctaactatttgtagagacagagtcttgctatgttgcccaggtttgtcttgaactcctggcaacaagctatcctcctgcctcagcctcccaaagtgctgggattacaggagtgagcaactgcgcctggttagtttttcttatcaaaaatattcttctaaacatcatgaaagtacctcgttatatatacttgggccttgcttcacagtaaaatattttgctgttggcctgagttttgggctaacatactcatagtttatggatcttgtctacattgcaagcaacagagaaaacttgaatatattttggtttatacagtgtaatccaattctgaaggggttaccaaactatcttcaagaatacagatagtagcatatgttgataggtcagtggcaccaaaattctcaaaattataaaaaacctcaggtgtgaaataaagcctcaaaatcaaaatctcccaaacacagcgtcaaacaatcatgaattgaactcaagaaaattggactaaagtataacaattttggaagaataaagattcaaaaaggagtaatttctattttatctgctctctgactattgaatgataataggtgccaatggccttgttgaagttttctgttagagaattgtggttcaatttcattccagagcatgagatagtggtaaaaaaatagagaggagattatgttaagtgggagaagcagaaaaaagatgacctgtgcttacgttccatcaatacagaaataattttacaatgcaggcttaactttcacaagttaggattgggaggggctggaagaaaaagatctagctatgttaatagagattctttatagatgtaaattttccgccacaaaggacagctttgcagggccatttcaagatatggcaaataaacgtgtttgggggtaaaatattttgactttcttctttgtcacataatgttatgccagagtcagattggaaagtaagtcacgatatataaggttcaatacaacccatctgatgagaatttgtggtttgcagggcatgactctccagagcccttagatgggaatttgggcaagataaagaaatcagagcttaattctcatctacctattaagccaggttgcagtttgtccacaaggactcaaatatagaggtatggagtccttctcaggccatatttagtttgctttgacactaaattaggaagaaaaatacaaattgagttaagctgcagttctactttccacagtagtagaaaacagtagaacatcaggtttgaaatgtgagatttgattttggtcaagtattctaagcccaaagagaagcaagtagctaacaatgatataattttctgagacacatttggaagtttcagaaaagctataaagattgatttatcttggggaaatgaaatagggtgaggatggaaaagagagagattttaatagtgtattggtgtttacaaatgcaggcccagatttagaactttgaaaaacacagttaaattgtaccaggccaatctcctgaatggctctgagcagtgaggtacttgacaagttgcagaacaatgtttcccaagcactcatggtctttcctaccaaactaggtctgtggtgtttggatatgaagtttattttttcacagacattaaaaatcctaaggtaatctttaatttctctctccatcaaattgtaaaggaagaaataaatttaaagttctaaattgcccagattgttatctaactttctgaatttgatagaatacagttaaatatattttaactgtctctaattcaatgaaggatcatgatttgaaaccctcaaataatgagcatctactatgctttgcgttttgcatgaattatctgaattaatccttactatgtctccataagatttatttctattataattcccattttacaaatgaggaaattgagattttaatttgttcaaagtcactatgctagcaagtggatgattcaggacttaaattctgatctgtcttacttctaaacattttaaaacatatgttgtaacacaaactgggatacacataaacgatttttttaaaaagtgaataaatgatactggaaaaaattagagtagaaaatattaggcaacaacacaggttcgtgaacttttctttgagatgtgtgagtatgtgcacagcatgtgcatatgagttatattaaaatcatatttctgactgtaccacagtaaaaaaatgaaaaatactgctatctatactcttgaatcaaaatgatctgtggcaattataatacgcaaaagaagaaaaatcttaaagtactatgactgtcagatttgattggtaacttcctcagatttagaagctgtataggctatttttttattttctccttcactagatagataagcagatatctctcagatggttctctgaattttgcaattcagaatttgatcaacaactctggggtgcttaagcgtatacaatatctcatttgatgccaagcagcactgtgagttagggctcgtgcaaacattagagacaaggacacaacttaaatacctttttcacatgtcacccaactagtacaggacagaaataggaaacaaatatggattcaatgatgccaaccccttttcactctcctcacctgcatatgggaggtactccatctacacacaacttttagatttagagcagaaaacaggatggttatgaagagtgagtccttacatcacgagtgtagatatgttgctatggcttgttgtacgagtattaaaggtatttccttcttctttttttttttttttgtttgagatgaagtcctgctctatcacccaggctggagtgcactggcaggatctcggctcactgcaacctccacctcccaggttcaagtgattctcctgcctcagccttccgagtagctgggattacaagtgcccaccaccagcccggctaatttttctgtttttagtagagacgaggtttcaccatgttggtcaggctggtctcgaactcctgacctcaggtgatccgcccgcctcggcctcccaaagtgctgggattacaggcgtgagccactgtgcctggacaggtatttccttcttgatttgacagcatcaggaaaataaatccaaagggtcattcagtttagagaacaataagtaacacagagtcctgcagtctggaaattaccagtgtgtcaggaatgaagaatcctttgatgctgacctttgtggtaacaggaagtgggaaattaaattgggactattttaagtaagatgctaattgataggccaggaaacttaatttagcaacaatatattttatgaggaggttcaatagcttattgctctttacaaatctcttattctgaattatataaaatgttaattataattggaataataagttgattctgatggtcattagtcaatgcactcagtagaggccttctgatagatggcagacaggacaactctagaaatattttgatacatcgtttagtgctagatatattataggcacatatggaaaaagaacccacctgtaatttatctgttcacctagctcaaatataattagatatacaaataagaaataaacgtgaaaaaatacaaccaccatgtttaggaaaatacaagtgagacaagaatgaaatactgtattttgaacactgttgttgggaatgtaaattaatacagccattatggaaaatagtgtagaggttcctcaagaaactaaaaatagaattaccatatgttacagcaattccatttctgggtgtttaactgaaagatctgaaatcaatatgtcaaagagatgtcagtactcccatgttcattgcagcactatccagaatagccaggttatggaatcaaattaagcgtccatcagtggatgagtggataaagaaaatgtgatgtatatacaccatggaatactattcagccctaaaaaagaatgaattctgtcatttgcaacaacatggatggcattagagaatttatgctaaatgaaataagccaggcacagaaagacaaataccacattttcttacttatgtgtggaatctaaagcaattgaactcacagaagcagcaagtagagtggtggttacacagaggttgggggatggggagaatagggagagtcaaataacacaaagtttcatttaggaggaataagcttgatttttttaaatcaatttcacaacgtggtgaatatagttaataattgagttctgtacattttaatataactaacagagtaaatttctaatgttcccatcccaaaaaatgttaaatatttaaggtgatgaatattaatttgattaagctttcctcattgtattcaaaagttatgacaccaattttaacctcataaatgtatacgactataatttgacaatatatactaaaaaaataatttttaaagaataaaaaaccatatttagtcataactcacaaattctcaagtgcttttgagatggctttcctgaaagtactaatatagtatttagctactaccagcttcatttccatttctaggtgcaagtaaccaggagacggaatgctacagtgttattgttggcaaaagtccaggtctttcagttgtcagtactccctggcaatgcatgagttttatgacattaaagagttaggaaattatgtcttcgtgttatacataaattgatgtcaaaaaattatttacctatcacgaagcatctcaaactacagctgtaatataagacaagacacctggatttcgaatcagaagactatactcaaatgaaaagttaaaatatagtagctgggtaatgttgaaaattacttaggcttcagtttctttacctgaaaatgatagatgataattcctttttacaacatgttgtaatatttgaggttgaattatataaaattgccaatatttagtcatgtttatgtacaaaaatgataatttcatttagatcaacctaatagtaatagctacacacttattaaatctttgttataggtattttgctatagtttacatgttacagtagattacaatgatggtatattagtctgtctttacactgctataaagaatttccttgagaatgggtaatttataaaggaaagaggtttaattgactcacagttctgcatggcagtggaggcttcaggaaagttacaatcatcgtggaaggggaagcaggcacatcttacatggtggcaagagagagacagagagaaagcgaggggggaagagccccttataaaatcatcagatctcatgagaacacactcactatcacaagaacagcatgggggaaaccaaccgcatggtccaatcacctcccaccatgttcttccctcaacacctgagaattacaatttgagacgagatttgggtgggaacacagagccaaaccatatcattccgcccctggcccctccaaaatctcatgtccctttcacatttcaaaatcatgctttcccaacagtcccccaaagtcttaactcattccagcattaactcaaaagtccaagttcaaagtctcatctgagacaaggaaagtcccttccacctataagcccataaaatcaacagcaagttagttacttccaagatacgatgggggtacatgcattggataaatgttcccattccaaatgggagtaattgcctaaaacaaagtggctatagactccatgcaagtccaaaacctagcgggacagtcattaactcttaaagatccaaaataatatcctttgacagcgtgtctcacacttaggtcacactgatgcaaggggtgggctcctagggacttgggcagctctgtccctgtgggttttcagggtagagccattgtggctgctttcacaggctggcattgagtgccttcagcttttccaggtgtacggtgcaaactgtcaggagagctaccattctggattctggaggatggtggccctcctttacagctccactaggcagtgccccagtggggactctgtgtaggggctccaccctgacatttcccttctgcactgtcctagcagaggttctctatgaggactctgcccttgcagcagacttcttcttggacatccaggcattttcatatattccctgaaatctaggcagatatttccaaacttcaattcctgacttctgtgcacctgaaggcccaacaccacatgaaagctgtgaagacttggggcttgcatcctctgaagcaatgccccaagctgtaccttgccctcttttagccacagctggagctgtagtggctgggatgcagagcaccaagttcgtaggctgcacacagcagtggggccctaggacaaggccaggaaaacatttttccctccttggccttgaggcctgtgatgggaagggctgccatgaaggtctctgacatgcctggagacattttccccattgtcttggttattaacattcagctccttgttactaatacaaatttctgcagcaggcttgaattcctcccccagaaaatggggttttcttttctaccacattttcttgctgcagattttctgaatttatgctctgcttcccttttaaacataagttttaatttcagaccatctctctcaagttcaaagttccacagatctctagggcaggggcaaaatgcgaccagtctctttgctaaagcatagcaacagtgacctttgctccaattcccaaagagttcctcatgtccatctgagactacctcagcctgtactttattgtccatatcactaacagcattttggtcaaaagcattcaacaagtctctagggagttccaaactttcctacatcttcctgtcttcttctgagccttccaaactcttccaacctcttcccattacccagttccaaagtcacttccacattttcagtttatcattatggcagcatcccactctactggtaccaattctctgtattagtacattttcacactgctataaggaacttccctgagactgggtaatttataaagaaagaggttcaattcacccacaattccacgtggctggggatgcctcaggaaacttacaatcgtggtgaaaaaggaaggaggcacatcttatatgatggcaggtgagagagagagagagaaagcaaaggtggaaatgccccttattaaaccatcagatcttgtgagaactcactcactatcatgagaacagcatgggggaaactgcccccatgatccagtcacctcccaccctccctcaacacctggagattacaatttgagatgatatttgggtgaggacacaaagccaaaccatatcagatggcttcaattttttatccctcctgtatttgtgtttttttgcaatttacattttcagtgtcctctcatcatgagtgggctgacttaccctgtcccttcagtctgggctcaacgacttgatttcttttggtcaatggcatattagcatgtttgaacaagcagaggcttgaagtgaactcatgcaatgggattatctctcttttgtcatgagaatatgtctaggatagactgctggagaacgaacacatatagaagagagccaaagatactatgtcatcttaacctaggctatcttaggttatggatatccagccagtctacagacttgttgatgaggccaagcatgattagcatagccagcttctagccaaccacaggtatagttgtagaccactgaggagttattttgctatacatattattatgaaagtaactaatgaatacaaatgattatctcatttcatctacccaatgcatctgtaggcagcaatgttatcatcactggacaaaagaagacactgagacccagagaaaagttcagtaaaccaccctgggtcacattaccagacagtaaatgacagaggcagggatgaaattagggagcctagctctagaggccatattctaactagcacactgcatagctttgttctcgtgaagatgaaatgagattattttttgaaagtactttgttaatgttaaagcacactaaaaatataaggcatcattataaggctgcaactccttttcaaggatgtaaaattccagctaagtttttctttatctcataaaaaaataaaccccaggcaagcactagatgatttaaaatgcactgttctttgatatgccagttacacagagaaaactgataaatggtgaaatttaacatgccaccttccttccaaatcaatgatagaccgctgctatttgctaggcaaataccaagtaaacagaaaaataaagccacggttttcttggcaagtgtcattaaaaatagattaagtttacagtaaatgtaatctgtgatatagatcacatagacaaaaaaaacctgaaggggaaatgaaggcattaataagagatttcttaattttatgaagcgttacacacatcaagccactgaaccaaaataacctcagggaatagtaatgaaacaaagcatttattcctcagcctagaggaggcatgtaaatacaaatgatgctaaacgaaaagctgattatgccttgaaattggaataaatataaaaaagaaaagtctggagatgctaataggtattaagtttatgagctgtgactttatttacatggaatattctctttgggcatgaatttttaaaattccatttgatatttcatgtttcctgtattgaaatctcccagagttattatcttttggaaaaaaataaaaatagaattctgcactgagtgaaatgagtaattaggagcatgactggtgaagtatgggatctaagctgagcagggcatgactagaagaggaattttttgatctggaaggtttttgtgtgcagtattctttttttaaaaaaaagaaaacacagaaattgccatttttaaaagggagaaagaaaaaaatggatgtaaaagaagaagagagaagacaaaacaaaaaagaacccaaaagaaatgtattcgacagaacaggaaaagaaaattctgctttggaaagggtaactgagacttaaatgatttatacacaacctgttgttgcataaatgtttccaaaaaaccttgggtttgatttaactggttcttattttaatcatctgcttctctggtaattgtcacctatttttttctattctttaaatagaaaggaaatttaaggggaagagagaaagagagcagaagagctttgctttggagtgtctttacattctttaatattcagctttgagctcaaagcattcactcattcactcattcacatattcgtcaacttaacaaacatctaccgagtgaaaggttcatttctcattggcggttggcatatacaagctctacttagggaaaacttaccctgctggattagatttagatagcacttttcttttctgactaccacactttagtaatattccatcacctttttcaagtgaaattccgtgacacttagtctcctcatactctacttggtcagctggtgtaactttgttttgctcctgctgaattttacctaaccatcattgctttattgtcttatcctgtcaataatttttaatactgaggctataatcctataatactatctaaaaattcttatgtattctttaaagtcattgaacaaattttcagcagtccggatgactaaaatataaaaaacaaaagaaaccagaaaaattggcactctattacatagctagtgagcaggcaaattggtactaccactttggaaaactgcttgggaacatgctaagccgaacatgtaaatttcctattactcatcaattttatttcaagttttaaatatgcaaaagaactgtatctacagttttatcaagggatctgttcaagaataattatagcatcaatatttgtaatagtccaaactgagagcaacctgtatgtctaaccatagtaggatggataaatagtagcatctacatataatggaaaactgtacatcaatgagaatgaccaaactacagctatatgcaatgacaaagataaagctcaagagcataatgttgagcaaaacaagacaggcacaaaacaaatactccatgagtccattttcctaagttcaaaagactgactaaataaaactgatgtagagaaatgaagagttacatgctcaagctatttttaaaaggtggacaaggaaatgactatctctgggatgggcaaaatggaactacagtgataatatgagcatgagagatctctaaggtgctggcaatttctgtttcttgatcttcattacgattaaatgaatgttcactttgtgataaatcactgagctctacatatgtatttgtgcacttttttgtttgtgttttattttacaataacaagatttaaaaaacagtaatcaaaatgtcatgtagggaaggaccccttcaagattatcttccagctcatctccagtcctgaacctaagctgcgattaaacatcataattttttaaatggttgcttttataaagagcaaatgtttcaaataaactgcttaaagtcttatctgttttttaacctttttttttaaaaaaaaaataaatgacatattagcttggaaatgctagtctggaaacatttttcagaagaagattcatatgtaagtcttctaaaataaaaggcattaaagaataaggactaagatatgtgagacaattgatttcttttttttttttttttcgaggcagagtttcactcttgttgcccaggctggagtacaatggcacgatcttggctcagggcaacctccgcctcccgggttccggtgattctcctgcctcagcctcccaagtagctgggattacaggcgtgcatcatcatgcccagctaatttttgtatttttagtagagacagggtttcaccatgttggtcaggctggtctcgaactcttgacctcaggtgacccaccagcgtcggcctcctaaagtgctgggattacaggtgctagccaccaagcccggccgatgtacttaaatctcagatattttaatcctaagaggtaactgtgaagtgaaagtcctttacttaaaaataagtaataactatatttcatcaattctaaaacatatttttacataatgaaatcagagtgcatcttataatcaataatatgcttaatttctgtcagcctagattgaagtcaaggtctttcagagagaattttcacttgctttggccagccaacttcgggtactagccacctgagaccactttaaattaaattctctgcgtgaggtgttttgggtcacactggtaatgtgaattcagacctcaaacctgcctaaatactaactggtggttaaaattttccaccctatgccaaggttgagatatgaaagttcccttgctatttctttctctgtggccacactattgggtcatgtagtgttgcaatgaaggtatagcctttggtgtctctgttttatttagggagttcctgtttgatcgcctctccacaaaatcttggttgcattatttctttcttattggtacataaaatcttacaatcactggtgccttattttatacaaaatacaggttacaggtaattagagatttggttttgtttccaaaagaaaatatttagcccagaattggataggaagactcagattgacgtttacatgtatcattttgcttaagcacacattaaatttgatcaaaatcttgctacatactctatattgttagtaaaagtatcaggttgcaataagattagtgaacttactttgagaactgtaagtaataccacaatataaggaataattatttctatgtgcatactgcactcccaacttgaattctaagaccctagaagtctaagattatatttttagtaatgtcctgctgccttgtacagtattgggcccatattaaagatgcaataaaacttgttgaatggttggagagctgaaaaatgaacatatgaaatgaaatacagttgtaagaaacacaaaaacttctgtaaatttgtgtgggtgtgtgtgtgtatacaaccgaatgcaaagaaaaggtcaatatcaggacacaagagcaaagacagcttctgagtcgatcttcattatgaaaatgtcttggccttgccaggatttgatattatggaagagtgcttgggaggagattggaaatcctatctacaatgcttgctccaacagattcaattcacagccttagcaggtaataaaagaagcctctggaccatgtaagagattgctctggcatagctaggtgcattggccattttatgtattaatgccaatctcagataaatcacttttctggtctgctgtggaagaaaagtggatatttctttcagtaagcgaatggaggattactgacttgctgacctttcctgactgtgataaaagattacttatttcctgtcagcaatacttcaaaaatggaaattgctcttttaaaagtactatgtaagaatgaagtagggagccagctattattccataaatagatggtggcagagggcatcccttgggaaagggagagttctcattaggcctatttttctgagagctgtcagtatgcatgtatttgcatttaaagattgtggagaaaggaggaagcaagtcttgaccggatatatttttaagactctattcttattcctgctacacttaaatatagtgtgtaaaatacagcactcttaaatgcctcatgctatgtttgttatgtggattcttatgtgattttcctgatgaaggagtcaggaatgcaaaattattttaccccacattgtaagatccaaagcagaatggaaaataacaaggcatgtattttcttttgacccaggaaatgtgacagtttcctagtatttcaaagacaaatagcttttgctacgcaggccataggaaaagggaatgggctaaagggttagagttttcattatatatgtccaagagtcttttgaaggcttgagaaatgtaaacaaatgagaaaattataatgtagactacatagtaatatcaaatactgacagaactaaaatggcctgtcagaagtcccccccatattgctcaagtctttttctgtcaatcaagtcttatagggctcttctttccatggcaaaagttgtcaaaatcatccctttgtcttgtgttctgagtgtatgtggctttgctaccaaacttgaagatactgtttacaacaaattagggatggtgtattataccagtggatacttttgatgatgaatcaatttgtcttaagggcctaaggctatcttctgtcatacagaatcagaaaaatatccatcaaagcttgattgtccatcaatcaatagaactttgtttttcagaattaaaacttctcgaagtggaggaaaaaaaataaaaaatcttctcaaagtggatgcttttctttggccgcggaaaaaagctgtggaaatgacagataatttgattgcctgtaatacactgtgattacagctatcaaagtcattctaccacataatttaaacacctaatttcttttattgtttctttgcaaaaaaaaaaaaactttcctttttttgtaggtgtttatctatgtcataggaagctgtcctttatttgaaggtctttatctatgtcatatgtgcacttgagattggaatacatacaagtcataatcttttcacacacaaaaaagagaataagcagatttgcctttaggaaacctgatagcaagagagggggattttacttctcttcttttatttaaccccaggctgacttgggaacacaaatgtagagactaggtcctgaccttgggttcagttgtccgtacttgtgtataatcattttttcatatgcacagtcactatgttagccaagggatgatctaacaatagttgtaactgttaggctgacttgcttaagcagtcatgtaggtcaattcaccagagatttggatgagtagaatcgttgtccgtagtcaattaacatgtctgcttccacaagtttggttctacctgggcttgattcacctgagcccaaagtggcactagagtgaaggcggtagaaaccccatttggtagttatttgtgtgagatattattgtaacatcctcaagagcagccataagcacaaagaaacagtcaactaaactagcattactgaagaacacacatgaatgatgctctcttataggccaatgcagaatgccgatgtatcctaaagataagatggagaagaaactaccatgagtgatttcagagattccaggacagttttcatgtcatctgagaatgattgattttctccccttagcacatgactttgatccggagaaaaacaaacacaaaaatgtagaattaatcctaaaatgttttttacttagttatattttactgtaagacaattggaaccaacttttgatgggacagtagagagtgcttggcactcccgggtgggatgggaagtttgtaaacaaatctttgtgtacttttcaattcctttttggagagttagcacaacatgaatattgaaccatttaaaacaagggtcttcgtcaagattctcttgcatccaactaaacctggtttaatcaaaacaggaaattattggaagaacacaggagtattttatggaatataaggcaacttgaccttactaggaactgagaccacccactcttgttctcttgactacttctctgtgcatatctatttcatttctttattcttcccagttagttttctttgcatctctgcacaccccaaagccctgtagtttacgcattttattactagctacatgcagagaccaattccaaattaataggcaagagaaacagagtggctagctaaaggcaggaactatctctgtgtaatcatctttgaccaggggtgtagggtcatgtggtacaaatgtgactgcctgccaaatcttctgtttgtctctaagaaataattacgggtggagcataaactccaaagttaatcaattccatcaaccagtcagatttctactcttttttttttttttttttttttttttgagacagagttttgctcttgttgcccaggctggagtgcaatggcacaatctcggctcactacaacctctgcctcctgggttcaagtgattcctcagcctcctgagtagctgggattacaggcacccgccaccacgtccggctaatgttttatatttttagtagagacagggttttaccacagggtttcaccatgtgggccaggctggtcttgaattcctgacctcaggtaatccacccgcctcggccagatttctactttttctcatacctgcgcactcttatagcatgcaatcatgactaaatggcagcacttggaagatccaaatctttgacttccttttcctattaaataacttcccccagttcttactctttatatttccataagttacaaacaattttaaaagtgctctcatttcaaaatagatactatacaaaccattcaaagtatataaatgtatgcaatttatacatatttatacttatgaataaaaaccagcccaacttcaggaaaatagcatattacaagtgatttctccatccaaacagcacagtagtcaaacaagcctaactgaagccaagcagcacttttggtttgaatgagcataagagggcttaattgttgtctcatcttttagagcatttctgattcaaaggtgtcatgcaatcattggtagcagtagtttgctgtattttggctcatacttgtaacatcctcaaagctcaaatgcctggctaaatatgtactaatgtttattgactgtctgagacagacagggaaaacttatttttactcaagcctgaacaatgggggaaagtaactcaaaatattccatgtctcacaagttggctggaaagataagtgctaaatactgaggtttgagaaatatactgagcaatgcattttgcaaaattcctctccattatgaagcagtgaaaaatgctaatgtcttcaaagaatataactggaaatttttaatgaaacattatgtccctataaggattcctatattgtcaaatttatgccagtgggttcaaatgggaaacagcatttgtaccttgtggtcaaacgagaaacatacttttcatgattataagtgttaaatgttttatcacaacttattttgctgccttcacacaaaccatgtgcctcaaagaattaatacaactgtaatagctagatagtgtttaagaagagaaatcacctaaaagttaaaaataggaaaacttgtgtttgatgtcattaagttgtcacatcaccacggagcactgatatggacaaagagggacctactctccaaacatgctttgatacagcagaagtttgcctgggagaggttatcaagcatgatagtattatctgcctttttgttaacatacagtatcaaagactagcaaagtagtctttcttctccatttaacccttaacgatataactctccattcataagaaccttaagagaaatgttccccgctcaggtttaaaacaattccttcgatgtcttcgttaactatattttactttaaaaattaaatagaatgtagggatgattttcatttattttacctttatgatgacaaattcaaagcaaactgaggggtagcctatggtaccatcatttcatatatgtcgtattttaggcttaattccatgactgaccgctctcatctagtataagagtgccttcacatcatcatagacgtagcttcatacatgcagatgtagcatatatcgaattattttttagatacaattttcttcattaatccttgtcacatgcaaagattgaagtattcaaggtttctggtgcttcgatggcatgattttccagtacttgttccaagcttcttttataaccattatttctatgaagtcattcaacttggaaataattgcttgccaaaactgagtttctctggtgaaccactcaacacagctttagttttacaaagaacaccattctttgtgtgctgttaatcttggcttagaaacaccacatattttccttcccaactgaacagttcagctcctgttcttttagttatactttggaaccatgagagttacttgtagaatacaaatgtgagtcacctagctgatgactttttggaaaaagattttccacgtatgtgtacatatattatatatatatgtatatggacactctgcccaggacatcattcagtagctgttagaaatgtgaggacttcttacagtccccaagcctaccttgtataggaaaaactgttggcattttattacatggagttttgttatctagtctgattttaacttattgggattaaggtgccatggtaccatgacccaatacttgacatagaagttaaaaagtcaaataaattagtgcttcctgtgaaaatactcttaagcacttaattctaatttctggtgggttttttttttgtttgttttttgttttttttctgagatggagtctcgctctgtcacccaggctggagtgcagcggtgtgatcttgggacactgcaacttccacctctcgggttcaagcgattctcctgcctcggcctcctgagtagctgggaatacaggcgcgggcaaccacgcccggctaattttttttatttttagtagagatggggtttcaccatgttggtcaggctggtctcgaactcctcaccttgtgatgcacctgccttggcctcccaaagtgctgggatttcaggcgtgagccaccacgccaggcctaatttgtgttcttttaattttagttaacatcacacttctgaaaagctatgaacagaaaataatagcatgaaaatttgataatttaggtattcagtagtttagtctacagaatacaaaataatttcactgtcaatttactttgtaaccaaaatgacttaaaaaccatcaaaatggaacagtgttgacatagcatgtgcctgttttcataattcaaactgcaacagcccatatggccattatggaaaagtaaattgaaattgcttttctgttttatgttcacaatgaaagctctgaaggcaaaggattttttcttgtcaaattctagtgaaactatgtctccatgtcttccaaattcagagagactgggtcatggataattactaggcaagccatgtttgtaaaggtgatttactcaagagtatgctgtataaaaatgaaagtacttatactgaaaatacatcaaatgaacgctgctactccatcaaattagaataaggccactgaaaaggaaaatttctaaaatgacagaaaaactgaaaaggttagaagttataacttaagtatggctacatttgaaagtgtgatattaaatatatcataggcttacaggggatttgtaatattttcttcttagcaaaacaaatatactgtgatctttgcaaaatgtaatggttcctatgagacatgaaaaaacgtcttgatgacaaatatatgttttatattcaaactgattttatcaacacaagaaagtttgctcaactatggttctatttatatcttcgagaaaaatttttgggccaggtgcagtggtgcacgcctgtaatctcagcactttgggaggccaaggcagcagatagctagagctgaaaagtttgagacaagtctgggcaacatggcaaaaccccatctctacaaatacaaaaaattagcagggcatggtagcacgtgcctgtggtcccagctacttggaaggctgaggtgggaggatcgcttgaacccgggaggcagaggttgcagtgagctgagattgcgccactgcactccaggctgggtgacagagtgagactccttttcaggaaaaaaaaaaattggcatacatgcaagtgaattttattgaatgtctaatttaaattgctttttcacatattctcaccatttatatacatcaaagggtgatgaattttgactttatcagtttcttcacacatgcacattgcacacacacatgctcatgcacacacgttcatgcacacatactcatgcacacatacacactgaatttttagtctttctaagagataatacagacaagctggctttaacactctgcaaacgttgaaaactacacaaagaacaaaataccatatcaaaccctttgactaatcatttccaattgtgtgattagagtcggaataagggaagcctgcactacatctcctttgagtacattttaaaacagaaggttataaaagatatttaatagtatccctttatcactgaccgtgcaaaggctgtggagaatagaaggatcttgggagataatttgtaataaaaaatttaaaaatgttttcaagtaaaatcagcatgtcatattaagatgttttctaaataatatatattttgaaggagaaaatgtaatgaatatatgtaatttagaagcgttgtctaaagagtttacacaacagagacgacacaaattcaaaccacatccgtgaaatcacttttatttttatttttttccacatagatgacttcatgtcaactacaaaaatcatgaaatgaagaactgattgtgaaactgcaaactcaaaatcactggagtgataaacaggttttcccccagatgacttaaaaaaaataaccaggataccatgaattcatgtttaagtagtaaacatgtcatatatttaaaaataataaatatagaatagcagtacagaaactaatagcataaacagcatgaagtatattttacttttaagacagatgaaatttctaggcacagctttaggcattaaagaggacacagaggcataggttagagtgcactgctctgtacaaaaatacagtctgaataaattacattgctagccatacaattagacgtcacttaccagtcagttcattgcatgtttaataatatacaggtacatgctaatccatatatatcatttatattcaaacacataagtctctctatatttatgtctttaaaatttacatgttgaacttacaaaaagctaaataattgtgcaagaaatcggaataactagccctgctgagtattttatgctatatgtgtgtgagtatatatatgtgtgtatatctatatctatagatgtagatctatatccatagatatctatctaacaatgggtttgtggctaaaaattatgcttaagaacacatctaacaaacctaaagctgcaaagacataatgttaatgtaggtgaaaatttcacttgtgtttattctgatagacaaaattgtattttagatgagaagcaacaattttcatgttgtactgagattgttagtaatgaaatacttccaaatattagtgatggtagaaatctagtgtagggctctttgctgagaagggaaaaaagtcacataagaaatctacttttcagtaaactgcaaatatgtgtgcttcaacctataacatattctgtcactttgagcttgtcatattgacagagaatgaaaacttgataagactcgagatgtgatgatattggtttaacagtacactgcatcctctactaggaccaagagaagtgcctcattggtgtcagcaccaaagtactattctttcattattcaggaataaagagatctcagaacagagaatgtttagttgctgaaatccctatccaaatatcatatttctcatgctgctctgacaatatgcaattaactgcaagacactctgccccagattttactatttctcaaaaaattgcttcaaaagactctataatactatctttctggagaatttccactcataatttctaatgattctttatagaatcatatatttttataaaggtttctgtctgtgatgtatttattcgcttttgtctatcattgctaaagtaagactaaacctggtacttcatattcgtgattttatagaaaattcatgtgtgttttctagcatttggataataaaataggttttttttttttggctgttgtttttggcaaccattcttaagacaagctgaaagaagaactgtgttttgggaggtaaaacaaattattaaatactatcgatgtggtcctgctcttaacagattttgcaatacagtaacatatagctacttttaaagtaatttttctaatgcttctttctgcaagagggccaaaaccagaacatactgttttagtgtctttgttaacaaaaataattatttataacttttatattagaactgtatatttgatataaaaatatgtttataattaagctatccaaatttgtatattaaacagaattaacacaagtttgcagcatgagattagttgcaaacttattccctattattaatacttccttccattgaacagtcagtaagtaattcccttaacataaatccatcctaagtgtgtgcacaaatcggttagcccatcagttaacttcagaggaccaggtgataaccagatgaattctactcctctactgagacatttagatatttatataaatctatcgctattcctttcttaaaaaaatgaagacatttaaaatacttgcaaaaaatagcagccttctattttaatgaattttacacaaaatgatcatcctaattgctactctcttttcaactacagtgcttacagagaatcattaattttcagattaacaccatttcaatttttattcttaggcaactctattgacactttccagtgaaacagtaaagaacatagagcaaaagctttaaggtaccatacttttgtatggtaaataagtatgaataccaatctaagcctcttaacaatgtgtacaaggttagtgctcaaaccacttcactagagtaaatattaattttacgtgtgataggcaaatgtatgtggagggttagggaacaacttattaccatttatactaatggttcaccttctataaaaacagtgaagcttgttacatacgcacacttgtttgctgcaatgtttggcaaatgatttaaagggtacaaaagcaactcatgcagatttctttctgtttgccccaggaaaaacagagatcctcaatttttccccagtctagatagggctgaggcaccaatttctaaccacataatgagaagcacatgtctccaagtcttgactctcttcccagggagacgctgattgccaaagcataacctcccattaaaaagagtgttcctgaaggtggaatgtgtatcattaaccagttacattcacaactcccattagatgctgaagggcagttcatttttcaagggctcactcaagcaaataaccaacagccaatgtagtcattgggtaggataagcaggcggtaagggctctaacagtggaatccttgtcagcgcaaaggaacttctaaatgttgcttatgccaactgctcccctgcaggcaataggagattgaggcaaatctcattccaactagtttctcacaatggttgctgtcatatagacccttcatttgtcaagaaaaacgatatgaacatattggaagtttgcagcatttgcctatgtctaatcagctctcttaatttgtgcagatttctaaaatggatgtaaaagctggttatgatgttgacagccaaaaggcaaaaaagattaaatcaactgagcaaactgcttgatgctccacaagtgttttagaaaatagtaagttagaaaagatgcagacgtaatccttttgttggatggtggtggttgtttttactttgagactattggttctagtagtagtcttcatagttcttagggttcaggcaataaaggatggcacccccaaacgaaaatatagttgcaccccaggccaggccataaccccagttgaactcatggtaaattttcaagctcacagtttcaatgaacttgattgggtaaaggaccaggctgcaaacctgtaaaacaactgaaagaaaagcaaatcaaaattagaaaatgttatttgcagcaaataaaataatataaatatgtaactatatatgtatgagagtaactttgtaatcaaatatacataaaagccaaaaattttaaagatggcttgttctagatggtatactttaaaatactaataatttttttgtttaaataccttttcccaatatataagaattatcctattaattagtaaatcattattagtatagataaaataattagtgcaatataataatttatatgagcatacaaagtagtgattttcaccttaaaaatataattatcattattattatggcaagtagtactagttaaactaaattgtgccactaataaaccgtataagtagctcctcaagaatagtgaccccagccaggtgcggtggctcacgcctgtaaatccagcactttgggaggcccaggcaggtggatcatgaggtcaggagttcgagaccagtctgaccaacatggtgaaaccccgtatctactaaaaatacaaaaattagcccagtgtggtggtgtgcacctgtaatcccagctactcaggaggctaaggctggaaaatcgcttgaaccagggagggggaggttgcagtgagctgagatcatgccactgcactccagcctgggcgacagagccagactctgtctcaaaaaaaaaaaaaaaaaaaaaaaaaaaaaaaagaatagtgaccccaatgccaactgaaactcttgttatttatttatgctattaaggaattaggaaattcaaattaatttctactgatgcaactggtcatcctgtgagtgataatgtgcttttgatgttgttgctgctttgcaatactaactcagcccaatatgccagaaagtctcaccatgatgtctttgcttacattactctgatccaaagctactttcattattttcttctcatccactctatgcctcttgtctttaaaaagtggcttaaaagttattaacagatgatattttcatatctgttttccacctactttcaaaaaagaattaagtcgataaaggcaagagagataatggtacaggaaaacctaggccaattatggctactgtaacagaggtcaaaacttagctcttagtccctggttagatcctacttctgtcagggccaaaggggaaatatgattagtcataccgaataaaataaaccaaaataatcaggaagggaatgtttattttgtttttgttttgttttgtgttgtttctactatctaaaataaaatgaaatttatgttgtggatatgcacaagacataatgtcttccacttaaaattcttaacttcctattagatcaattattatgtaattttattttaattagtttaactacaattagttaactacagcttcattctctaccataggacagcttccaccctcaagaaatagacaatctttttccctaaaaaatacagagtacagttatatttaacaggggttggcaaactaccaaatctggtctgctttttgtttttgaaaaagttttactggaacacagccacactcattcatttacgtattttctatgcaacaatggcagagttgagaagctgcaaaagaaaccacacagctcacaaagccaaaagtatttactttcttgcccttaacaaaaaaagtttgctaacctctgatatatgaaataattttagggggtaaaataatttttgtttaattcatctgaaaagaacaaaaatgtgaataattaaagaaaaggagggaacaaactgacatagtaaaactatatacataaatagttttgatatcgcttatatgttttaaaaaagaacactaggatggatagagtgtttaattaaaatggaattttatgttttaaaatgtactctcatctatttttagcccatgtaaaagattattaccagtatgatgaagattcctagaaagtctacataacagtcatctttctctcccataaaactgatgaaatacagcaaattcatgaggaaatgattcctcaaaatttctttctataaggctctggctaggtgtcaaaggaccgacctagaactagatataaaaacacccaacatttctgccgtgtagcacaacactgctgagtcagcactttgcctaccattactactgagagtggatacacaagtaagtttgtataagaggataccctactgatatccaaaatagaaatcagaccttctcagaaaaggttttggttgttgttaggactcagctgacggcatattgtatgacccacacttcatctatttccagttagtaagtgctaaaatgtgcattaattttaaaaaaagcccagttggctctttgcctttgtgaggaaaagggagctttcatgttttaaatgtcttaaaactaacaagaagtcaattactatcaaccataactacagagaagaaaattccaaagttgccaagtacatttgaaaaaaaaaaggcacttctccttaggtttctatactctgttcactcgtcaaatctgtactgatcctaccaggatatgactgaaacaagaatgtgggttaggtatagtaattcatttactcattcaataaatgcatccattcaataaatatctgaatgtttctaaagcgatacagtttaaggcattatgctatcaaaagagacaaagctgctactctcatgggtagtcagtccattagtaaacaaatatagaatataatgtcacatattgctaagagacaagaaatgcaagaaagcagacagaacacagggatgagggctgctcttttagatcaatcgtgagagaaggctgctctgaggaggagatattgagcacagatctgaatgaattgggggtgcagaacaacatagtggggactgagcattcccacgtgaaaggcataggcactgcaaaactcccatcacaggagcatatctggtgcactggaacagaagtcagaaggctgtgattgcagtacagagagcaggaagggagaagcatgagatatgatggaagaaacagcaggggcccttcgtggttcatggacagcctgtgaaccatatctggggtctagattttattctacgtgtgacaggcagctggtagaagagtttgagcagagaagtaataactaatctgaattactctaaaatgattacactgcttcttttgtgaactgactagtccctggagtgaggtgtttacctacgctgcttttaatattcatttcaacgtgttttatttagcaaatatttggcctccatggtataatataatgatataatttccctctagtggaaaaatggaaatacaactccattaggccctactggcatactctcccgaacaactttcttagacttttattgtgttggagctcaataaaaattactgtaaaacacttcatgcctctgaattattcgactccctttggaatcacagagaaaaatgaatgtaatagcaaaactgagaaaaatataattctgcatttgtaaataattttctccatgtaataaaattcacagatgtaggtaaaaatgcctccttgcctttcatagatgctgtagagggaagaaaaaaaaaacataaagagttcagaagtcaggaaaatgccattatactatatttctattttactaccaatcaatgaaacaaaataggcattggatatggtattctctatgctcttcctcaaagataacataggtacagctctggaacattttagaatcttaagagatttggggttcattttatgccccctgcacttttttgaaaacaggcaatgaaactactaaccatgaaattgtgtggatcagaggcatgacgggaatgtagacctactaattcttgtgttttattctagttttaaagggatatttttcagtgttttcaacactaaaatattcaaagcattgatattgaaatattcaatattttcttctaagaaggacatttcactattttgataaacatatattgggtgcctacgtgctagatgaaggggataagatagataagacatggccctcgccctttgatgattcatactctgatggtggagacaggcacacaagtaattataaatcaatgcattcaacagcaatagtagaggcatgcatgtttgtttataatatgttcaacacacatttactgagctcaaacattgtgccaagtactgattcagcttagagaaagaaaggagggcttcagagggacatcatttgaattggttcttaaaggatggatgaaaggtggtcagaagaggcagaggaaagaaaagacgtctaggaagacaaagcatattctatagtgcttacagctattaagagagtatgactagaagcaatttgcatgggtaaaatgaagggcgcatgcacaaggctgtttagttcatactataataccatagtgtttcataaagtaataaacttttgtttctctagggagaccatctgcgaggttattgtaattgtatatgcggttggtgtcctatccatatatttttatcttccccacttcagtacatgctaccctgacttccaattgccagcacctgtatttctttgcctgagttacctctggccactaaagcctcttcagctgcctatggggcaggccaggtccagaaaattaacactgctctcccttgattataaccgacatttctcaaccaatgacgctccaaatttggtgcattaatactccagctccgtagtcctctgaatgagattattctcgaggtgcgtgttctacaccggtttttaaagtttccccaagaagattaagctccagctgcttcgagtgacaactggcttgataatgtaaccttttaatggctgctttcccattcccgtctcattttccatactctttatcatatcccttcttctaccttacaaataaagtatatgcacttgatttctcgtctcagggtttgcttctgaagaaatcaaagggacaagtgacaagaccagatgtttatgtcacaaggagacctcatgtgttgtatccaagacagattacatggggaagagattagagaaggacaggcccctagaaggtcattcagtgtgtggggacctgtaggcagtgatgactaaggtgtcatcagtgggaaagaaaagtcagggaatctaaagaaagactaaaagaaagaactgaaaaactagatactcaacaaggcaaaataaaggagtcacataaacatcttaaaacagtcagatattgccatagaaaaacaaaataaagtaggggaagaccaaatttggggaatgagacgttccatttagggaaaagttgtggcctcgactaaggcaataatgatggtgtacgaaaaaaaggtacaaaattaggagataatttaaaggcaaaggttgataggccctaccagccaggttggtccctaaatataaaattgacataaaagaaacaatgatttggagaataaaaagcatttgccagtggaaggttaatatgaaggtatccatttcttttctttttaaaatttaatttgtaactactagtggcagcagtatgaaattaattattgggaagtgatactgtaaattgttctagccgaagtgtagtttgataacggtacagggaaattaacatgtaatctaaatatcctgaatagaagaactctcttttagtttgaaatctaaactggacactgatttttctaccaaaatctagacttgaaatggttccagctatctcactgtgacttataggatggtgatgagggctgtaagacacaagcctccaatcagagatagctcagagatggaaatcagctgcaggaccctgaaaaaacatcacctttctataaaaacaatccttataggaggctttctgcagatataacataaagaatcatccttaataacataataaatggggattctgtatgtaaaatcgaattataaaagagaattttctgcaatttgtattaaaggccttggaaagaaagaaaacactcatcctatattcctgtgggacatacaaatgacctgcggatagttcaaaagtagacaataaaagaagagaacgtggcaagaggcagtccctctaatttcaccaagtctttagtgagaactggatgccagttatcagaatcacatcatatattacctatcactgtcagttacacaaaaagaaatatgctgtagtcaactgtactggaaatgtgcacaactttcattatgtgctatggtgcagtcatgctgcatcaatcagtttgtggtctttatgacatctcaaggtactaaatgccttcaggtgttgctcccgagaaacggagtaactggagttacaggacggactccaactgcagtgcacagttggcaactgaattcaaaatcaaggctgattctgcactgatttttccaatatgtgatatgtactgaagtaaagataactggggaatcctcattcgggctttcaagtcagataggtatcctgaatttaaaccctagatgtacaacttactagttaaaatgaccttgggaaattacttaatttttctgaacctgtttcttcattgataatacggagaaaataaatatctaactttgagattgttatatcagagacagtgtatgttaagtgtctagcacgtggcacatgacaggtgcttaattaatcattcttatcagcattattattataaaaatatctaattctgaagtctagatttataggactggtgagaaagagagttgtggaaaaaaggacagtgttttagatgggctacagcaatggctagctcttagctattctagcaactattcaagaaggtaataagcccgccctaaataaaagacctcagagaaaaaaaaaagaagacaaaatctttataatctgtttggctatctttatgagacttaattatcagttttcagtaaaaacccttagagtatattttataacaccaagactgtctacttgtatagtgtaagtgcccaacatatttattaaataaataaaaacataaatatatgaaaaaacatccttttgatatttattacttttttgaggtcttttggtcttagctttgtagtcatgtgaaactagctgcttcctaagaccccaaaagagaaattgcttaaaaaaaacccttcattacagttacttatttgtttacatgcctgttttaccccaccagattatgagctacatgccttagtcatttttatatcattcattcaaaaactatttattgagtgtatatgagtaccaggcatagcacacggtactaaatcaagtaagtgtgaagtctcggatagagatgtttccaagcggtagtagtaatgtgtctgttttgattttatgtactgcacatgtctcggcagaaaaaggtacttttattatttttttttccttgagatagagtcttactctgttgccaaggctggagtgtaatggtgtgctgtcggctcactgcagcgtcaagctcccagactcaagtgattctcccatctcagcatcccgaataactgggactaagacttcaaaatattttttgaaattgtgctttctactctattagtgagtatctgtggtgatactgtggccagttttataggtgtctaatactgtgtttagcctgtaataggcatctaagaaatagttgcataaataagtgaggaagtcagtggttaatgaaccactagattaagattcagaagcctcccaggcccaggtctgccagtagctactatgcgatcttgagcaagtcacttaaagatttgaattagatgtacttctggattccttcagccctttggaccttcatttttatgacacccccaattctgaccagccttcatgggtataagaaaatgaacacaaacagtagggggcagcagaacacttctgttttgtatttttagctccaactaccctttaaatcctgagaaatttcatctattccaatcttgaaacagcttttaaaaatccatctaacagcctagatggttttgtcagtgtcttcattattgatagtcacagaagcttactttgcagtcttcaaatcagatatgactgacagggcaaactgaaggcaccacagaatattgcagtttgagtcaaaaagaacaatatattcaaaggtatttttataaatgaaaattaaagctcacatcaaatcatgtattgggcttttagtctgcaagccccttttctaaacagtcccgtcttttcatttcattggttgatattttaatccaagctgtgcttcatacaatgatggttgataaattaattaacatacaattgacttcatataattgacttgtctaatggttggagtcatacatcacacattttcaaagagatatacatctttaagggtaaacattttggaatttgttttcagttccttatcagaaaaaataatgctgccttaagatcaccaggggagcagtaaaaaaggggaaaaaactggatgtaaaagactgttagtaaatacacctgctgcaattcctaaggtaatagccctgtcaggcagtattatttgttcatgctttagtcagaggtttagaagctgccattgtgctctgtgaaatgcttaacacactgaaaactgataatctgataaacctttagccaagttaccttaaaaatatagtaaatgcctctcaatttttacgtaatgcagcaaacacatacctcttctgcataggaaaggaagatggtagaaaggttcatgaaactttaatactcatttgaaagtaatgaatctgtttacctgctgcaaaaagcatgaccgcaacaggtctatagaaacgccttcgagatcccacgcagatagaaatcaaacccaccaggaatgcaatgagaatgatggcagcgccgcccaggagtaaagccagagtagcaatctgccaatctggaaagaaaaaagaaattgtttttgagtagtaagtcctcaaagaatcaacagaactatgttcagcagccttcaccttgcagtggctcaacagatgtgattttactgcatgctaagcatcctttggggtttgaaatgttttgcaacaaaaatgaataggaaatgtccttattcagaaaagtctcctatgctaagctcagcagagttttagaccaggggtttgctaggattttcttccaaggactctattaggcattcatgttaaatcaagtgtcccctccatgacctattttcaatattattatgatttaaatttttatcgagcaataaagttcacaaatcttaagtatagaaagtagagaagttgatgaattcttatagatatttatacaccatccagattaaaatacagggcatttctatcacccagatttttctcttgcgccccttcccagtcaataatgaccctcccacctgggctactgaggacatccgtcaccacagattgagttctgccttctgttaaacttcatataaatggtatgaactattttgtgtctggcttttaagtttctcatattcatccatgctgcatgtgacagtagtatattcttttttttattgctatttcttggaaagccttccttaaccatataaaaatctccaaagtttttatttgtctctcctccactccctctaaaacaactccccatcaaattagcatcaggaatattgtttgttttttccacttcttttttatttgattctagtttcactgctgtatttaccatcacgggtgtggtttctaaaattaagtattcccagggagccagaatggactctgaatggctgctcggccccttcattcatacacggaaacagtaagcatatattgaccacttactatgtgcaggcctctgttcacagatacttccaaacagtttctcacactcttagtgacacataaaccttattgaaatgcattcatttcttataaaacaaaaatgtagaaatagtatgatgaaaaactggcccattttccattcataagaatggtaaaatattctctcagaagagacaaagtgaatctatgaaagtactatacaggttgggaaacatcatataaaacgatactatggagagcagcagttgtttaaaagccccaagcgcctcttctggccctcagtttaatgtaagtgcagaaaatgcaaatggattttaatctatcattaaattgcaatggattctatcctaagtccagaagtcatgatattttgatgcttccctctgaaattatccccccagaaagcttccaaaatgcactctttgttacggtaggataaacgatgagcagaggaattgccaataccctaagattttcttttatttatatttgtacatccctgtctcaagcatcctcttccacatcttcccctcctacgaaattgtggaagcttcacaggctctcaactagaacttgcactgcaatcaagaaacaaacaaacaaggggaaattgaacaaatccaaacttcttaaaatataaagatgagtcacaacaaagtggagagcatcttcttaatgccatctatttgtaacaaagccatacaacttcaaacaaaagtagatctggcttttaactagaagttaaaaggctagccatactgggcttttttattccataacagcatgtagctttgaattaaaaagccaaaaaaaaaaaaatagtccttacatttgaagtctctaaatttcttgggaaaagtttacacaagtgcacaattatattgcactttggcatgatggaaatccttctaaaaacaggtgtgtaaattgaaatttctgaattaaaaaaatcaaagtttaattatataaaagtgtacaatgaaaaaaataaaatccatccatccatccatccatccatctatgcaattcctggagagtttgattaagaaagcctatgctccatatgttctagttggtctattactcttatagaacgattattactgttagcaactttccctaaattattttacataagtaaaaactttaaagcattggattcatttaaatcaaaatgtaactaaatatctacccatataaaatatcttaaagtgaaagtgcaatagattgttttttcctgattagctctttcacatagctcagtgtgaaaaaaaatgccacacatttgactcttcactttcagccataattcaaacaggaatgaattttgatcacttttctctattttaaatatcctcaaaaaaatagctaaaatacacgttttgcattttgtaaagacagactaaggtagaaaatgataagcaaactttccatataaagggccagacgagaaatatttttggatttatgatttatggtctctgttgtacccactcaactctgcatgatagtgtgaaagcagccacagacaatgtgtaaacaagctggctgtgccccaataaaacttatttatttatttttttgagacagagtctcactctgtcatccaggctggagtgcagtggcacgatcttggctcactgcaacctccgtctcccgggttcaagtgattctcatgcctcagcctctcgagtagcagggattacaggcatgtgccaccacgcccagttaatttttgtatttttagtagagactgggtttcaccatgttggccaggctggtctcaaactcctgacttcaagtgatccacccgcctcggcctcccaaagtgctgggattacaggcgtgagccactgcacccagccccaataaaacttaatctacaaaaacaggtggtgagttggtttggactccatggctgagctgctgtttgctaaccattatactttatttagcatttcaaatgttgaacttttttctaggcaaagatcttttaaactacaaaacacacaatgaagttaatttaataaatgaataatacaggagtgcaaagtgatgcttaaccaatatagcgagagaaaattccaaaaaattcctaatcgcatattgctacatttcctcaatatagcaattcttcatttcatttgaaaaaccagtaaaatgctatagtagaaagcaccaggagaataaaagtaaaagggactagaacctaattagaaaaagaacctcctatagcacaggaaatacttctaaaaagtagataaacataatcagttctggattttcttctaaatgtcctatgtttattttcagcactgaggttgtggctaatgacaaagttaccctagatgtaaagtcaacaaggagaatcatcagcattaccactgttgtgatatttctacctttcctttggtccacaaccagagatatgactgctcaaacagaaaagctattttattttccaaaagaaactagaaatgggccatgactgccactgttctggccaaaacctggggcttagactggattattgagactatatccctggcgaatggtgccaagttttagaattgttgtcattatatccatttggaatgattcactcaggccagttgcccagcaccaaaactttaaattgctgatcagtttaacctcgatcaggaagctgaaaaagtggttcgatatggctatcatagtcaaggaggtctgaggtgcatttcaaggttcagtgtgggtactttggagctgcaaacagggcctgtggcatcatatctctttcagtaaacaactagaatccattgtccaaataatagtgccagcctaagaggtgaactaaaatcaaggactatgtaaatcagccagttaccatttccctctctcttactgaacaagactaagatatggggagtaaaaaaaagtgaaaaatattttatagacacctactaatggctattaaaataataggctgggctttacattgacacagttagacagatatttacttaccatccgaagtccaatactagatttagcaagaacatatacataagacttggacaattttatagtaatattataagagaccagaaaacttgttctaccctgacttttccaccaaaagatttgcatgccacaaatacctgctaacctacactcagtgtttgcaaaacaaattaaaatttcataaaattctctgtttccagcaccatttcttcaaaaaagtcatgcattttaagttttcacaatcagttaatttctatatcaattttagttgtccaattatagccttcacagtatttagtcagatgagttaagagtctgtaaagatttattactctgcattagttttctacctttctataaataatataccaatactatagtggaacagtaaacacaaaccagacctgcagaacatcaatgaacatggtactgttttacaaattgcagtgctctgcacaattaaaatgggccattgttcaatgtcacgccagctgattggaaacctgagtttggtttctgagaccacagagaacaggtgataatcagttttgaggaaataacatacatccttggttgataaattggtgagggctcgaatgggatgggaggcatgttttggatctgaaaaccaaacctgaaatcaggctgccatgttacgtgtcaggttctctcaaaagaattttggcaaaattgacacagtgacacactgggggcattcaaactgcaccgaaagaagtggaggctcaagataagtgtatgcttctctactagtgttttctataacaggaaaaaaaaagtaaaaagaaaaaaaaactccaggaaaatacatacacataatgttatattccccttgcagttacaagataaaaatcgggcagtccctatactacaccatcaagtttaacattaacatgcaactcaggaactgatttcaagtcctctttcaaggtatttttattagctggcatcagagtttccaatgtctataaacagtttagtattctgcagaattgtgctgacttattttagcattgtaacatatgagactggcctgaaatcgccactgcattatgaaaattctatggaccacattataactgtccaattggagaattatcattcccttagggaattcatgatcaaaagtcacttccaattttcagaaaagacaaaattttaacaaggatacattttcgatatttttgagccaagggcaatgcacaaaaccagttcctaaagctttctgcctccactcacctcatttagaaacctttcacttgtcaaacactggctaatttatttacctctgtagctactggttatatgctgagattctttctactatatgtaaatccctgagcacataatgcctatttcctttagaaaattagatataattaaaaagcaatggaaaaacaagtttttaacctcataaacagaagtcctactgtttaggtgggtagtattcccctcaatgtattccgttgtttttatggatgattctcgcttttctatcattctcatcacaaattaaaacactgatttttaaatcacactcacatttgtcagactggcacttgtattttcatttttgaacccctccaaaaggaaattatattaactaaaatgatatctataactgcaataaaataattcaccagacaacttagaacaatgatttttttacctatcatcttgaattacaagttatatacaaattcttcctaattcacccaaacagactggattattttcactcattcccagcaaacattcagcttttctaaacacttgtattcatttgtaggacatatttatagcaaaacatttaaattacattgttgagaacatagttaagttagtattgccaatcccattctatcatcaggaaccggaaatagtaggatggtttagtactaaaggaaaaaagaaagctcagatacagaagaatatttcaaactcacattccctaaattatccatctattcaccaaagactatgtctttttcccaactagctcactttgtcagaaattatggcatttaattattttcacgaaatgtaactaaagaatttatcttaatattaatgctacgcatttctgagtttggataggaagcctgtatcctcatacacaaagaatggaatgctattttgtgtagaaccataaacttagcctaactacttctaaaggtatcaaatgatctacttaacttttaaaagttagtctgcatgtgctaatgaggtggaaaactgaaacgttactgaggcagcttaaatcttggtttattggctaagttgcattctgacctaaatttgtcaatactgcattaattttccaccactctgtgatgtagacacaaagaaaggcagccaaatgaattctgattctaatttcaataattaaaatgaccacttcttttattaaaactggtatcaaaactataatttttcacttgcaaagaaatatttctttgtatatgaggatactgcctttccatccaatttaaggcaagtaattatttgtattttataaaattacaatataaatactatgtgtgttgtgacaaacaaagcaaaatagatgtttgccaaagcaactatgttagatatccatagtagtaatcaggttggcaacaatttgatttcgaatactaccctttaggcccgttcacagataaagactgcctccaaagtatagtgctaacctgattttaaactacagacataaatgactccaggtaaccatccaaacagatgatacaataaccctaacgaccaaaatgcgtgttaattttgccaaattttggaaaatcccggttgtccaaaatgccagatgggttactagtgtttaacaatgtcaatttcattcaagatcttggagttgttttatgttgatgttagaaaaaaaaacacacatactttttattttcaacaaataatggaacattttagctgcttcacagaattctgtcttagataattcagtggaaatgtaattaataatctaaacacaataacatatggtgttttttcctcaaataaaaccacttgaatacagtatttagcaaagagccttgctgttaaggcaagttccagtatttggacaaaaagaaagacactatcacccctaatgactgctgtttcttaccatgcaccatctttgaaagttttcataagcatttgatggtaactagtgttacctaacaagtactggtatttttcaataataatttctaatcatggtatttctacaaagttgtgatgactttggtattttgaacattgttcttttttcactctttgaataaaaacctaattaggttacaacttggaaaacttgattattttgaaaagcacaaagaaaacctactactccaggattaggagtgggtgaaacttcctctaagcaactaaagttactgtaatgggtttaggggagctaagaataatcaaagagtagaatgaagaaagccagacagccacccacgatagtattaagatacccctttagtaaatatggaggaataaaattggcaaagctagtactcccaccagctccttcttaatgccccgctgcagaagtagaacctttgttttctccttcacagcactttgcacatttatttaattattaataatttgtttaaaagacaccatttgtttcacccatcattttattctcactaccttccacgatgcctggaacacagactaactggctgactttgtatcagaataatgtctaccctctgctagaaaaccaatgactacgtttcaatgaagttaactcattgagtatatgtgagaagatgggaaaatagagggaagcattcgaatgtacccccctttaagttacctagaggagctaagaatagattctaggcttcattcacagagcatcatgacagcattctggtgaatatttggtttagggaccttaaacatgatggcaataaaatcttctttgatgaaaattttagttcttttgtgtctgtccctttttatgtacagagaataagtaattcaggggtctcgacttctatttttttaacatggttttgcctaataaacagaaattttgaacagaaagtataaatatgtgatctcttgaaacatggctcattaaaatatcattttaaacctcataacagtcaacaagctgatagagacaaaggtgttatagatattttttctcacttctttggaagaccatggatgtttcgttgtacattttttaagtgagagtcttcagtgtccatgattagaatagaaaattgatgatctacaagtgtacccaaatcacacacaaacttaggagtaaaaacattaaggaaaggtgtccttgtctaattttcaagggaggtgaaccaatagtttgaaaagattagtaaaattgaaatgtcagtgcctttaatgtgtgaggttgaaattctgctgaaagaacattcaatctttttggataaattaatacatacttttaataaagccagaatgcaattaagttgttgaatgaaaattaatattcatttaatcaatttaagaaacatacatggttgacttctacaaaatttggaaattctttttcaacttaaaattaagctattgttagccaagctgagagccaaatcaggaaggcaatcccatttgcaattgccacacaaaaaaaataaaatatctaggaatgcagccaaccagggaggagaaagatctacagggataattataaaacactgctcaaagaaagcacagaagacataaacaaatgggaaaacattccatgctcatggataggaagaatcaatagcattaacatggccatactgcccaaaggaatttacagattcaatgctattcctatctggcattcttcacagaactagaaaacctattttcaaattcatatggaaccaaaaaaagagcccgaatagcaaaggcaatcctaaacaaaaagaacaaagttggtcgcatcacattacctgacttcaaactatacaacagggctacagtaactaaaagagcatggtactagtagtacaaaaacaggcatatagaccaatggaacagaatagagagcccagaaataaggctgcacacttataaccatgtgatctttgacaaaattgagaaaaacaagcaatggagaaaagactccctgttcaacaaatgatgctgggataactggttaggcatatacagaagattgacccctttcttacactacatacaaaatcaattcaaggtgggttaaagatttaaatgtaaaacccaaaaccataaactataaactacgttgtcaaccctataagacaaggtaggcaataccatcctggacataggaacgggcaaagatttcataacaaagtcaccaaaagcaattgcaacaaaatcaataattgaaaaattggataaattaaagttaagagcttctgcacagcaaatgaaactatcaacagagtacacaacctacagaatgagacaaaatatttgcaagctattcatctgacaaagatctaatagccagcatccataaagaacttaaatgaatttacaagagaaaaataaacaaccccattaagaacgggcaaatgacatgaacagacgcttttcaaaagaagacatacatgtgtccaacaagcatatgcataaaaagctcaatatcactgatcattagagaaattcaaatcaaaaccacaatgagataccatctcacaccagtcagaatggcttctattaaaaagtcaaaaaataacagatgctggtaaggttttggagaaaagggaacacttatacacagttattgggagtgtatattagtttaaccattgtggaaagcagtacagtatggtgatttctcaaagacctaaaaaaagaactaccattcaacccagcaatcccattactaggtatataccaaaagaacagaaattgttctaccataaagacacatgcaggagaatgttctttgcagcacaactcacaatagcagacttggaatcaatttaaatgtccatcgatgacagatgggatgaagaaagtgtagcgcatatacaccatggaatactatgcagccagaaaaaaaaccgaggtcatgcatattgtgggaacatggaaggagctggaggctattatccttagcacactaacgcaggaacagaaaaccaaatacagcatgttctcacttataagtgggagctaaatcatgagaactcgtgaacacaaagaagggaataacagacactggggtctacttgagggttgagggtgggaggagggagaggatcaggaaaaataataactattgggtactaggcttaatacctgtgtgatgaaataatctgtagaagaaaccccggtgacatgagtttacctatataataaacatgcacatgtaccccgaacctaaaataaaagttaaaaaaaaaattaagctttttcaaatttattttgatacggagtcttgccctgctgcccaggctggagtgcagtggcacgatctcggctcactgcaacctctgcctcccgggttcaagcgattctcctgcctcagcctcccgagtagctgggactacaggagcccgcaaccacgtccagccaattttttgtatttttagtagagacagggtttcaccatgttggtcaggctgtcctcgaactcctgacctcatgattcacccacctcggcctcctaaagtgctgagattacaggcgtgagccaccacgcctggcccccaagccattattttaacgtaccccatcatggagaaacttaaagtagaagtgtttatttttaagcactagtcatggttaaaatgtaaatttgatggtaataaacatctgaaatgtacttatcaacacatataattctattttcagactttaattctatgtgaaatcaaatcatggatgataaataatcttacaaaaagtgggcagctatttcacatgcagtccttcacctcttcatccaagcttccatacatgacatcattcaacaatacttcaaacaccaagtgacagttatctacaatattacagaacattttaaaaaccaaccctccaaaaatactatggcaaaatgtaccctctctattgagtgtttaacattgtatccttcttcattttccttaatcatgtaataaatttgattagactggattatgttaaaaatcttgtctattttattaaacacgttacaactctgagattcaatacatgggcagtagttaagagaagagctatgttattaaaacaaaggaaaaggaaacaaacaaaaaataactctaactccaacacttctctagcactataaaacttggctcctgtctggaattttaatgttttagtgttcatgtagcaagcgtatcatcagatgcattcataactttctaaaaaaagaataaaattttatcatacaacataaagtagcaaattacattccagattcataatcagtttgagccttggttgtttgagactaaaccaaagattttggaaggttttacatgtatctctctgtttgtggaaaagttaggttctcgagttcattccatctcatatccaaagtacaagtaaccagtcattaaagccatatgctggctgagggaaggttttgtcccagtcagacattatttatataatcaattcaaagttcttaagtacagaagctacaaagcaaagacaaactggttggccgtttgttgttgttgttgttgttcttcaaaggcaataaagaatgcagatttgcagttagactcagtgtcagactgtgtgctccaaacacggcccaacagcaactcctatcccacattctcttctacaatgtgaacttgccactgctccatcaaaaggtggtattcaattctccttcccttaaatccaagctggccatatggctcctttgtaaccaactgaatgtggtagaagacatgtgtgatttctcagcctagttcagagagattctggctcttatgactcttgtcctgcgggacccactcaatttgtaagaattccaatatcctaagaccacaatgctagaaaggccacctgtaggcattccagggagagtcacagctttgcccagtatctcacagccttccccaccaaggtgccaaacctgtgagcgaaatcatttggaaaatgaccctacagttccagacgttctggttcctagccattcaagttatcttccacaagggctccagacatccatcctcattatgtcctatctgaattcctgacccacagaattcatgagtataataaaatggttattttacacgactaacttttgttgtggttagtttcccagcattagcaactggaatactcttggtaagaatccatctttaccactagttaattgagaccttggtaatcttaacaaaaatccaaagtttcctcaataatatatagggataactttagctaccttgcaagtttattgtgacattgggaataactgaggtgtctggcttgtaataggactgaataaaaggataatagttttgtgatcatgatctaccaagagcattgttaaatgttaggtaatgcatatcaaaatttaaatttgaaattgacaaagtacttcattatgcaattcattatgcaatgcagagattttactacttaaaggggaaaaatcttcaattattgaaaaaagtatcactgggattttctgaatacgtaaccaggaagaaacataacactaacaaacaggcactttcatatatttaatctttatgataaaccatttgaggacattaagttgtatgaggtcacatgattggtaagtggccaagttcaggtcagttagaatccaatgtctcatttattctccaacatactactctactctgatacagaattacattacaatttagcatagctcacatggaagtttgttgtggtatttatttatttattcggttagttattttggggtagccctcagaaccagaagtggttcagagagctccctgctgtggtatttaggttaggtattccagagacacattttgaagcatctatattcctttcactagcatgtctagtagcactgactatatctatggtctctgcaagtggtcttactattaaacaaaaacttgcaggaaatttcttgaaatgtattcccgacagcaagtaaaatctattgcttgagatattcttttgtttgtttttgttttgttttgaaatgttttacgaaaggccaggcttttcccacacccatcaaatcccttagctgccaagactgatctaagtggctccctgggaattataatccttctatgaatgtgagcaaaagagaaattatatctgttcacacattaaaatgtcctttgtaaaagtaaatctaaggaacctgaaaatctaaaagacattaagagaaagtcatcaggaagatcttgaaataagttatacttggttttctctggcttatcagtggagaaagttttggtgctctctggtactcttaactgtccacccgtctatgatgtctaggttaaacaaaactgcatttattcttcttatgttcttttcaaggaagccagaagtgggtataacaatagtgacttccaggcttgcggagctatttgtaaaaatgcatcaatatcaacacatttcaagcaacaagctgaaccttccccggagcaaatcacattgtgaggtttcctaatgaaactgtgttttcgaattaaggaataaatgcaaaatatgaacagatgaaacatgtttgaactcagaatcactatatctcagatttgctaagacgtgcaggtggttaggcagttccatttatctttaacacctaagataggctttcttataaattccttttaaagtagctttttatactaaagttaaaaaaagatctacatataaagcactctaaaaagaatttcttgtcaattagaaatgataatattcacctgttattagcatatggtatactgccatttcaaaactaccaatgactcacgttacaaatgcagctatttttaggatagtatgtgaatgatgttaacaatatcccttgaaaaaaggtactatttgatcaagtattttgggataaaaaaaggaaaaatgaatttgttatatccctaaattactgttagtaaaagtgttcatttggccatctgtatgtccttgctttctccttagtcaacaaattacacagacaccaaaaagcaatctgctttacatgaaatagctatgtatttatacattttaaagaagaaatgtaaagtctccttagaggttatagagcacatttgatatcaaatttagggcatcagcattctgtatacacttgtgccaatcctatttacactaaggattcttgtaattgctgtgaaatcctagcaactatatcctagaaataaagttagcaaactaaatgtgactaagcagaagtctaaaatattactataatttgtgtaagatttaaggtttattaaaaggttccccaaaacagtactggggaaaactacccttagaaagaattctgtggccggcagccatgtgagtactgcgtattctaaacttcctaacaagcacactttattttttttttctctttccaccattaatcacagtcaattagccgctttctcatatgtctttctggaacacttagaacttaagatgagtgcctcaactgtcctccatacattgaattggaacaccagagaaaagcattacggctgactgacaaccggattagtggttcgtactagaagagctgacgcaaccttcaatacaccagaacacaagaggcatggttctacttttgcttaaaatcataaaacaggttataaacagcaaatgatgcacatttggtaccaaaattaaaatgcaagtttaaaaataatggcttaggggaaagtttcagtagaaactgggtctaagtagggcatactattgtgagtagaaacattcctgaaatgctccttcagtaaatacaggcctgcctcttcacagcagttttaattctaattaagacaaacatttttaattaagccttaaagatcctggtgaagggccttcagtaaaagtgtccttggtggttcctcccaaggtaatttattttgaaagacaaagatgtggatctctcaaaatcttcagagaagacatttccctccctgttttctgctactccacacagcaaacagacgaaaaaagctgcttgccctttggaacagacaagaaaagcactgctggttttgattcgggcattccccttcctttcaaaacactggcggacagaagcttcaaattcacataacataagaaagtacattttgtaaagtggggacacagagcaattttccatatcttgtttcctttcctccacccccgccctgtgtcccaccatcaccgtggagagcaaaaaatgaactgctattatatatacacaaagtcaagaacttgttccagaaaacctctaacaaaatcatctctactttttacccatttgcttatgaattctactttatctgggctgaaaactatttttttaaggcaagataagatgaaagctgattttcagaaatccaaatagaaatatacgctgggctatgactttcagcaagggggtagaataaacagggaaaaatcccaaactgggcctgcctttgatttttactttgcagagtgctattaccgctatatttgcattaggcttgcgtctccatatttccttgactagagaggaaaaaagctgagataaatgggtatggaggcaattaagaaaaggttagcaaacactgtatgttgctctgcaaactcgagctggcttctccccattccctacattcctggccaagaaaaaagggtactggcttgaaaagcaaatgtgagttgaaactggtttctctaacctatctgaaaagtctttatgcaatcaggggtctattatttcaggagacagagagaaaggggcaaaacattcacgttgccaaggagtcgtgcagtagctgtcattcctacataaattttattattgaagaggggaaaggagatattttcgccaaagtttatttggatcccctggttaccgaagaaagaaattctgccgatttattttatctttagttgtaaactgccaaccctgaaagaattgaaggacctaaatgttgacctcctgctgccaaccagttccctccacagtgaattaaccaacaaagaggaaacccttcaatgggaattttgaggtagtatcaaagaaaaagccttttttaaacacaaaattaaatttacagaagaaacttggtcaaattttcctgtgttataacaggaaaccaaagacaaaagaaaatcagatttttgtggctttttgtgctatttcaactttgttacaacttgaaacgtttccaggaaagctttataaatagtcccagagaagacatgaaactggaaggaatgtaatgagtttctcaggtgtctatgtgtgtgtgtgtgagtctgtgtatgtgtgtgtgagagagagagagagaaagagagagaaagaaagaaaatcgccggcaggtcctctctctttatttccctttctcttcgctgacaccagcagttgaagaatcaaaattagaaaggaaggggtttgtagcgagaaatcataagttgactgatttttgctaagggcataactggggcgccggggaaggcaactggagggtcagggagggcggaaagcagtaaagccccctgggactggtagcctcagtagctaccttattctccactccccacccccatcttatccatttgcagctttcagcgctggcggaataaagcacaactttctaggcatctgtgagtagctcatggagaaaagaaaggtctggaggagagaagagttacttagagtggcagagaaagaaaggcaactcacaatcaacggcggcgtcaccaaaaaaggaaaggaaaacaagcctgtccctctctcaactcttcatatccatcaaaaacgtaaggaaataaaatccaaaccgaaatacattggtgaaaacgcagataaggtggagtggaaccggcagaaatgtgaacactaggcaaattcgtcctcgagagaggaaggaaaaagagtggggaagaccgaacagcgaacccccgcagcatctcggtggagttggggcgtttttgcctgcttcttttttaacgggggtgtggaaggcgtcgcatttttttacacagccacatggctctcgcctcaaatgataacaaatacccaaaatagcgtacgtgttactccagaacaggaggaatggccacggggaagggagagggcgtgggctgtcgctttaggtttggcgaccagggatggggagggaagaggggtggatgccagggaggtggcgggagccccaggatccgagaagggcctggacggggtgggacgggccagggcagaggatgcggggacgtggggacaggcggtgactgtcctggcagtggggcgcggggcagtccggggcgggaggcaggggtcgcggcgcgccaggccctcaccgctgctgagcgtggactcgcagtgccagatgtccaagctggcgggtttccggcaggactcccacaacgacaggtagtactggtggtcagctgtgacccaggccgggctcagcaccgcccccaggtccagacacagcgccaggaagatgcacaccagcccgaccagcttcaagggggtcagcaccgacacgcgcacctcctccatgccgctgcccgccgaagccattcctgggcgccgctgtcgtccgccccgccgcaggcgaggacgccaggcgggtccggagagccgggagccggacctcccgaagggagaagccgccgagctgccacgcgcggggactcgctccctcggggctctgcgcgccccctgccgcgcggccaaggtgggtctgcggaggcggccggccgggtgtgggtcgtcggcagccgcagcgacgtcgattccaccccggaccttcgccgccggccccgcgccgcgctctgccagcgcccgcgcccgctcctcccggctcggccgggctcgctccgccccggcccctccccgggctgcgggaggcggtgccgtacggggaggggcggagggccagcacttggtggcttcggctccagttcccagtgccggaggctcgcgcctgtcccgcccctaccccgcctctggcccgcgggcggagcccagtgccagcccgcgcccccgattcgcagcgcgcggcagttccttgaagcagccccgcgcccagcccggccctcgccgggcccccagcctcgctggctccaggtcgccgggctctcccctttcgcccagtcacgtgggtttccttttcttagggagcaggagtgggcggttttctagaaggcgccagaggtggattcctaggtttcctaagctgtgcctcttggagcaaggacaggtcctctgtctctcagtgatgtaacacgcccctccccggacaatttcacatcctgagagatttgcgggacggaggagaaaagtgactaaatgcattttgccctcttttcaaaaccagacgggcccaggagtcccccggttttccctgttttctcacttctccgctagcctgctgccgcttctgttctctgggctcacctgcttttgcgcccccctatgaagggcatttgctctgaaaacgcaggcgctaaaaaggaaatgagagctcctgcgaaatatgaagtaagtcttatttccatctccactgctctgccctttgggtgttggctaaaacctttattaattccgctttgcattatgccaagctggatctaattcccctcctgggtattaggatgtccttgtccttagcaagatctagcccaggacctgcaataggaaaagtgatgtgtatatttcctgaatggtaaactaagcagtctacaaatatttgttgagcatctaagggctaaggattcaacacaataggacatcgtcctgttcttaagtagatgcaccatattttctcccttatgtgaggactaaacacctcttgaaattgaaattgaaattttgtaattgcctggttcagcatgtgattggtgggttatctgtctcttgtagctctttgactcatctccatcttttctataaaataaataatttattgaatacattaatgaggaggggcgatgtttctagatctttagtcatcccaaaaacttggtgagactcccaaaacagtggttaagagctgaagaatgcaagaaacatgttctctcttctatgaaacacaatcctcaatgttgcaagatttcatacttttggttgataaaaattatttttccccaaccacatctttccataggttgaacacatgttgactgcagcaacattttgggctaagaaacaatcgagttagtgtcaaatgagaacaaacctaatgtaaaataaacgcccgggcttttcttatatttacaatttcgggaacttttctcccacctctcaatcattaccgtgctaattattgcaggacccttaacaaagaatgcctagagcatccagagctcactaacctccaaatcccaaagggcttcttggcttctcaactagaaagaagcctaagtgcatattctccttaaaaaattagggaacactgaaaaatttacaaaccgggacaattaagaggtgaccaggattgtgtgactgttcttttatctagatttataatgtgtattcaaaagtaataagaaaatgtcttgagtgtgctctcaaagatataaagaaatctttattttgcctccaacttctatcatcttctctttaataagtttattttccaattagccaatagttttctttattctcttcaatgcaggctttctttcccctctacccctaccccaacccccacctccacccacatttttgcttaatttttttctggcttgttctcaactgcttgcttgagttactccatccttctttatactatctaaaaaaattgtctctatactgtctccaaaactagaaaagtaaacaatttttaacaaaaagccaaattttccttaaaaaactctattcctctattaataatttatagaattttgcacaacataggcccatcaaccatccctaatcctcaatttcaaaatacaacaaactctcaaaagtattttttttcttttcatatatttgtagcaaactcaggggcacagggacacttcctctccaactgctgaaggttcactggaaatgaactgagaaaaggcagattaattggagaaaaaaaatgcatgtaaaacttattttatgtgcacagggaaaaaaatcacaggagtgtgattacccaataacacaatgaggtccagatgcttatatacccttcttcactgaaagagagatgaggggtgtaggagtaaatgattgccaggggaaactgggcccaaagaacatggcctgaaacaaagtttttctgagctctggggaaggtggcagtaaggtgaggggcggaatgtcactgtgaacaaaggttgtcttgttatgcagattgagcctcccaggtaatttctgaactgccctggaaggaatagatgaaaagtcagtcctgacatagtgagaactcccagtctcttctgggtggttgatctttcctggttatttgatgagatttcaagggaaggggtcttaagataattgcatttttttggaaaggagttttcttagttatataaggaaattccagagggaattcctcctggtgcttcaggaagcaaagagagtcagagagacagagaggcagggaaaagtcagagagagtccttgaggctgattcttgagttcagtatgtcaaagcaccatatttgggggttttgttttatcatccaaaagaccaccaggatggctaaatactagaaagaagagctttattgtcgatattagttttcaaactgggaagagaaggtctctggcaggagccgaaggtgctccctctttgaataggggaaggacaggttgggttttatacctcacggggtccatattacaaaatataatcatatatattcagcaagtttgggagaaaagcaatacatatttatcagaggagaagaaagcatgcacaatgggtaaacatatatgtaacatcccatgttcactttggggcagggtcttagcactaaaacgaggtggaatttggctctttacatcaaaagttgaactgtatgacacaaagacagtttctatgcagcctctgtaagctggctgaaactggcttaaggtctgtaattgcttatgagaaaagaatgtttataaggtccgtactatgtccaatcagagctgcagtggtctgggttgtaacttagaattagtaggaatctgatagctcctattgtttggaagttcagaacagtaggaatctggaaatttgccatgtcagctaggccctgaaccctagacccataagtcattttgtttccttaaccacagggttcatattagctaatataggggcatctatttctcagattagagctttctgatccccaacagtgggaaaacatctttcaaactgatgtgaggctatctatggtttcaatttatccatttagtgtgaagaaatatgtaggcagagatcccacagtgtatgcaccatagtattcttcgaatatctgaaaaatcatgaattgcccaacatagctggccccaaaagtttcatataaaagacagtagacttggcctggtgcagtggctcatgcctgtaatcccagcactttgggatgatgaggcgggtgcatcacctgaggtcaggagttcgagaccagcctggccaacagggcgaaaccctgtctctactgaaaatacaaaaatcagccgggcgtggtcgtgcatgcctgtaatcgcagctactggggaggctgaggcaggagaatcgcgtgaacttgggaggcagaggtggcagtgagccaagactgcaccattgcactctggcccggacaacagagcaaggctctgtctcaaaaaaaaaaaaaaaaaaaagatgatagacttgtatttaccctaaaaatgggaaaagtagaatgggagattccaaaattagcaaacattgaatgaaaacctaccccccaaaaggtatctgactggaagtgggtggtagttggggtgggaagtgacagttaagatttatgtatgtatcttatgtatgtatcatatatgtgaatatatatgtgtgcgtgtgtatgtgtgtgtgtatgtgtgtgtgtgtgtggcagaaacaaaagttaaaatagacccagatttgagaaatggattgaactgtgaagaaaattcaagtccctagtcaaggagatttaagatctcttaaaagggatggctttgttggccctgcactgtcacatcacacaaaggccagaagccacctcctttacccgaggctagctgaggcaccatatcaccatgatcacccctgtcctgggaccttatggggcaaaggctacaactagagtcatatagtacaggagctccatgaaaattgggtatatgagttgtatagccagggaaaggcaggaagttgtctctctctgaaccctgaaataaaggatgagatcatctccaagcttgaaccactgaggccacagaaacaggtcagtaatgtgagaggtcaaggtcaaatggaagaaactgggaagttcatcagggaagtggaaagtgtcatagctggaggtagaaggtgtggaagagatgtggggaacacatttcagatgttgaactggtcttaagaaaataaagagaacttactgtcatgctgttagcttatagcctatcagcaagtacactaactctgtgttttttttaacagttgaaatgtgcaactacttaagttcagtcacgtgggataaaccactaaggacttaaccaattaggaaggaaaaaattatttactgttttcaagcccagcaaatctcatacattgtccaagttcccaatgtgtcactgtcacagcagccactggtcactgccaatcttaagcccattttttagatgggcagtgggaaggtatcctccagtttttccgacttccatccatatagagtaggctctgtccattgggtacagggccacctggttgggctctttcagttgcacttctccttccagatcctggaaagttgttcatacactgtggatttcagcactgggatcacatccagacatgcactggttagacctctttgctctcagagagaagaaattgaatggagggacaaacagattccttgagagaaaaacaattaaatattcattgaaaaattagaaatacactagtcctcccattatcttcagggatatgtttcaagaaccccagtggatgtctgagaccacagatagtacctaatcatatatatagtgttttttctatacatacacaccttagatagaattttatttataaattaggcacaataagagattgataacaactaataataaaatagaacaatcataacaatatactgtaataaaagttatatgaatgtagtatctctttccctctcaaaatatcttattttactgtgctaacatgttttcagatcgtggttgaccttaggtaactgaaaccgaggaaagcaaaactatgaataaggttaacaccattgtacccattgcttgtccagtggaacaagtaataaggtcaacaagatactttaggaataagaaatggaaaagagcacgttagaggtttactgtctttactatacttttattcttgaagtccactccagaaagactgtgatttgagtgaaaccataatataatgaggcctacctgatatttatggtaattaacgaggtcaagagggctccagattctggtgcattctgtttcatttctgggatttcttgttgcattgttgcaaattttttggcttaaaattatcataaatgacggtgattgatagttgctgtttctgcttttatttaaaaaataccatttataaaaattaataatcctgcatctaaaaatcaaaattttatcattttctaatgtcttttctattttaaaaatgtactataaagttgaattagttagatttcggtcaataatatcaagtaacttactattcacattagacgctgttttgatttcagattaattgatgtttcacagtaggatctatgaccataaaaatatagttgtccacaaaaaaagaaaacaaatcatggaattggaaacactaaaagacatgagagggaaaggatgattagttttaaaataaatacgttcattataatgaaagaagtgtgcgtcagatgaccaggaggtaggaatatgggaaacttagactattctcactgggaccaattctaaatgccttttccatttccttgtcaagcattcatttccttaacaatgattacatataggcacaactcttcctccacatttgtattgtatttgtattcatttaaagctatgtgaagaaatgaccaggtgtatgtatatcaagcacatcattactgcagttttaatctttctgtctccttgtttttacaactacaagttgaatcttctggttacactgaagcaagtgcatgcctaccaacttactctcatcatggtggaattttggttatccttggacatcatcatcatgatacatcatttctatatctgttttggagtgtcctgtgcttgggaactcaatggaaaatggaacaccatagcctcagaaataggtaccctgaatagctgaaacattggtagaatgagcaggcttagcttattcttgctggagcttggagggctaagtgtagactcatgacttaggtgttgactgagacacagatcaagaggtcagagtagagaaggaaggcatcaggaagttatttgccctcccccactgctcttcttggagctggctcgctaagctttatctgtgactttaaattttagtcaaatccatctttatggacttcttggtgaattttcatagacagtcttcatagagacgttttgcccttgtgcctttgaatgaagatgcttgcagatagatggaaaaagtctaagaatttccagcttagacacccccttcctgaatttgagtcctattttgtcagtttcccacgttagcaatagatgttgattgacaagatgaccagcactgttatattcgctgccatgtgcttattttttgtaatatagaaaatctcaaaactgttgtagctgggagcccttccccaatgttctcctgatggacacagtatctgtagcgtcagaaaattctccttcataggaagtatgggtacctcctccctttgtggtctgaaggactcacatgtacaatggggccaaaagtgaccccaaatcatacatctaaagtatagtgatggctcaatgtcaactaaaggaaaaactgaaattaaaaagcatttagtagaaagaatacctacaacagtttatactcacattccaacttagaagaatgcagctaagctatttctcttgagtttccaaaagctggtcttaaatgtcagcagtaccaggggattgaggatagtggaataaagattctcttagaaattttttttcagtgtagctctcacctttagatttcaccttttaatattagtctgtaaagtgagtattactgcatggtatgtctacagtctgtcaaaattcaaaatgtcagttgattcatgtccaaacaaacataggtggaaaaatattagaacaatatgaagatctgtgcttatgtcatttctgaatcattttcttttcaacttttctctagtctacatgtttcacacttttccccctctcctttcaagctttcttatctttggtaaataagaataggaatctctttaaattcatcaagaccaaggttaaaatactcgctttggaacctactgactgtatggctttgagcacgccatgagcctcagttccctcctttataaaatgatatgatgcatcactgggttgttgtgaggattaatgtggtaatttacataaggtgtaatgtctggcatatggtatgcacgaaccatgattattacattattataatccagatgtcaacgagggcctcctggtccctgagagatttaggtaaactttgctcaaatctccaatttcatgatccttcagagtacaaagtcctttccaaaattcttacttcttcttgtctctgcatttggttctgcatcttacactgaattcttccccttgaaaacctaggtgcaaatgccagcccctttaccaatttctggaaaaaaaaaatcaaacggcactatttagttttgagttaatacaagacttttctgactgcttcagaagtcataagaaaggggtgctacacagtgaagaggaaagacttccatatcttgcttggttcatcagaacccacatctgcgccctcttctctgtcagccttctcctcctttttctccccagtgctcattcagtagtttccatccctagtgctctaaactcttgctacatgaagtgcatatgccatcattactggcatcacctggaggtttgatggtaatgcagatttctggccccaccagaaattcagacctacttaatcaaaatctgtagtttaaacgggattcctagtgactcttgcacaggttaaagactgaaaagtgctgatccacctcatcttctcaggcctgttagggctcaacgtctaccccagtagctgtatcaaagttaagagaataaaaagtcactattttataccctacctttcaacacattatgcggtgaccaggtgaatggtgtttctttcatgtccacttctcagtaggctctatttgtcactgattttgggcccattgacaatgatgaatcagctttgttttagctgacataagtgtattcttcactcaattgttcttaaccaccttgttttgttatgctcccactactgggggctgtgattctcagtgcagcccgtgattctgacaatgtattaattggctgataaagataaatgaggatgtctctctaggtacacctaaaacaccaacttttaagacagaggaataaaaagagtgacatatggcttcttgtgaattcagtttgtgacattcatacagcttcacgatgcataaataaactactagaaatttagaagtaaaaagcaaaagttcatttatccaagtcatctgaaaaaacatcatgaaacaaagtacaaaaaagctgctaatccccactgataaaaactatcaaataggaagggtcacagacttggaaatgatatctctagttaaagtaagaggatgaagctgcattgtggtttcaaactgtggccacgttgacatttgctctctgagctccttttcaatcccttatctttagccaacccagttgtcagattttaggatagtcttcttaattgacaaacaagaaatggtgtgcccatgaacagtgctgtgaatagaagccgcttatggaagccaaagcacattagagatggcatttggaaaaatggatccaggtgacatgatgtacagagatagtggatatagggtttttagaatgatggcgagaaaattaaagtggaagccaagtaaaatttactttaaatagaattagaaaagttcaattatatatgaatggttgataggttaggagaaaaaatagaagagaaataaaacattgattacttgagttgataattaagactaaaggacaggctagttacctttgtagggatcaacttttcatggctgacattgaatcaggatgattgacaccatcattctgtgttttgacaccactgccctacagtgaactaagtaaagctgtgatatctgataaccatttattatttcttgacaagatatcaccaattttgataaagctagacagataaagcagattcttaaatatattcagagaaatacatttttccaatatattctattcaatgccaattacaatttttctcataaggttttgaatctttttatcaattcactgtcactttcatttcaacctctgggcatttctttggtcatgcattttaatactttgagtgttctcaggaaggggagcacataatgtgtgtgtgtgtgtgtgtgtgtgtatgcatgccttcagtcttcttattttttacagcattagtttctcagtgactgaactaatgtgcattgctcatgccttccctagaatatgtttctttcttagaaacaggctttctcttaagagaaaaaaacaaatctgtttttcattatttgttcaagtttctgaatggaggatcaaataatgtaaaagaaaataaatacattaaagttttgctttaaagtcagcaaaaccaaagtggtgattattttaaaggatatggttataattatagacttgctgcaaaatagttttagttattccatgcttaattctatattcatttatgatatcagtttacatttatggtattttcctgatagttttcaatgtttactaccattttccaaatccaaaatgagagaaacagagacagaaagagataaaaacagtcaaaaggcattcctaaagtacgtatgcaaatttacaatttttccatttaaaaaatcttactactttttatttctttttctgctcttattttatttagtctctcgcatgatccacatttttttggaataagaaagcagtaaatcaaattgtgtgaaaacacacacacattcacaggcacacacacacacacacatatatatatacacacacacatacaccatacacacagaccatactgtattattttgtgacatcccatccttgtgaatattcttgtgttgccccaggaaagatgtagaaccatctttctctgaagtatagtcacatttcaccaaactgaaaactatctgcatatttggggataatatttctactgccattttactgaatatagtgcttcttttgccattaccaagtcagatccatgccaaccagtatgtttatcaaacacaaatttgggacacaaggtgtgacaaactagacaaggtgttccgaaggaacaactagacaaaatattaaaaatcaggcatgtcttgccaaatttgcaacataggattgctaaatctgcagtgcaaaatgttcactctgtccttgatctctcctctcaaacttctttaccgttgaagccaagcatttaaatggctttgtcctcactccgttttgccttcacacttccaaatgtttttctgaccatgcccaagtttctcatcatacgcattaatactgcactatttagtcttggaaggtatttcttgccttatcattatcccttctgggaagcataaggataatgtaagataaaagtagaatatgtgcataaaagaggatacttttggtggtgatcattaatgatgatataaatgcagagatgccagaagtagagaagttagtctagattgagcagagttcactgaacactgaataattgatttggtagcgattctataagaatgagacattaggaaaagcattgcataggaaaaaatgcaaagcctgtttggaaacaatcaagatatgtgaatgctaaagagtgaagagttggaaatgattccacaatttttaggtaatcagtctgtttgaaaaaaaaaacctgattcaaaaggcaactttatttttcattctctctcaaggtcactttaaacatttttagtatgggctaatttttcttcactcctagttgaaatctcttacagagctcatgggttctgttcactctcaggtaatagagtcccatgatcactttagtttgcaaatacaatctcaattcagttattagaatagctagctgcaatacattaatcaaaacttcaaacttgacttagcattaaatcttctttgtagctcaggcctgatccaggtcagacatataaagctgagcctttctttaaggggtgctgcttcccttctagggatatttttatgtctttgatcaggctgaggggttcaataaatatgaaattggtcccactttgttttgcttgtaaattcagcagttggagaaagggggtctgtttcacctttatcaagacactctggtgtcttggtatctgttctatttggcacctcacttaaatttgaggaaaggggagttccattatgacacccagttacaatgtgctgccaaacttggccaggaggttgaaaaagagaggggacagtatgaacatcactcagatggctggtcaagaactgtcagagatttaaatcttatcacaggtgtgtattaataacatcatgtgagatctaaatagctcctaataagattttactgcacgttattttactaatatcattttttataacttactgaatgcctactatgtgccatcattttctaggtgttctgcacatgtgcttatatgtgttaaacgaacataagtacactagatgctagcccttcttttcaggttagggaaccaaattgcacaaagtttgagttacttccctaaggccacataattaagtagtaaagctgaaattttaatcttatgtaaactgaaattgataaaacataaaagctatgttatacagagggaacaaggattgacaagcactgctaattgccttttgttttattcctacaactatagtagaccagctcaggactgactcccatcactcccccttttcgccttggtattgctaattgcctttccaccttgagactgagtcttttagactaagcagtatttacaaaaaaacacacaccaagttaattttatgtaaagcatgatctgaatacacatacaaagaaaaaatttgtaagactactacagttttaatatcctttatccaaagtgcttaggaccagaagtgtttgggattttgggttgttttttagattttggaatattcacatatacataatgagatatcttggggatgagacccaagtctaaacatgaaattcatttatgttttgtatctatctcttccacccatagcctgaaggtaattttgtacggtgtttttaaataatctcgtgcatgaaacaaagttttgactactttttgactgtcacctgtcacatgatatcaggagtagaattttccacttctggtcacatgttgcttctcaaaaagactcagatttcctgcattttcaatttaagatgtttggattaaggatgctttatctgtatattaaccagagatgaatggatgtgtctcaagcgagagataatagatgtcagtacactattgtttcctagttcagatttcttttgtactataatactttatatatcattttgatgtatcatgatctcatgtaaggaatctatttctacttatccaactcactaacttaatattctgcactctgtctgtaaagcaagccaagacatactcatgcaagacgcgtggctagtagaccacattattgttggcccactcacatatggagatatttaccaggaagggtttgtgtttgttgtgataccgcattgtgatattgcacatgttctagtaattgttaaattaactgtggaagaagaaatggtagagctttggaaataattggacaaaaatctagatgcagcccaaatccagaataactccaaatcatctaaattttctttcttcttaaaaatcaaacaaacaaatgaacaaaaagaataataattgattcacgaaagatattagggaacttctatctgtggacctttattcaaagaaagtctcttgagcctgtatcacatgattggtcaattgatgctcatactctgagaaagtcttattttatgttgaagaacaagggttgagaatgtttgagtgtgacactaaacacacacacatacacacaaacacacacacaccccaaagataaagttggagcccttgccagggtacccctgtgtcccatgaagggtgcaaatcaccaaaggcctgggtcaggcaaccatcagactttagagaaccagagttaaactagaatccctatggcaacaacacaatggcattagaacaggactttctagccctctataaggataacttttgggaggaaaacggatttatttggatcaagtaaattatctttttgctgattgcaagctaaagggcttaaaaagaagaaactggatgttctgctaataaagatatgtgaggttttaaacaatgcattagaaaaataaaagagatgtgaccgtgtttacatctcaacctactgaggaaggtcgtacacattaaacctgattttaggacatattattagattgaatgtaaatctagctatctttacaaaagattatttagtatcactttatttgcaaatggaagaagatacagacttagagaaacaatgattttataaaaaagaattatagattgagcatcccaaattagaaaatttgaaatttgtaatgcttcaaaatccaaaactttcgaacatccccaaaaaggtgctcaaagaaaatgctcactggaacatttcagattttgtatttttggatttgagatgatcaataaagtataatgcaactcttctaaagcccccgaaaatctgaaatctgaaacattttttatcacaagcattttggataagggatactcaacctgtataatgtcttgcatttaacattattttcttgcttttggtttatccaataattccacttataggtacataccctagaaatattctttatagttaaaacataggctttcttgctttggctaccacagtgagccaatgtctgtacttagttccacccagcttatttgtttttagcttcataaatattctgtaaatatgtagttaaaacacctaagctaaagcaggtgcttataacccttcctccctcatgaaaaagaaggaaaagaagtatgagagagctctggcattgggccagagcattacttcttcatgagcagtgcaatgaatgcagctaattgaagacatgtaagggactgcatcctggggagaaacccggcaaaacacatcaacagattttcaaccctaaggtgcagaccaggaagtaaaatccaggcctatggcaaccagatgggactgaaggaatgagatgatatctagagggtccacaatgaaaagtggagaggtagaatactgagaaatcctctgagaagaagcagtagctgccatggatttttacaagatgtacaagacttcacacttgttcaggagggagctgtcactagctctcacatagcttggacagtggtgggtaatttctcagctgaagaaatttttttttcagtttccactgggttcatgcacagtgttctaactttgtgaaaacaccagtgggcgtgggatggggttgggatgggtattgcaacctggtgtagataggtcctcagaggttgctataccaaatcaccatatagatggtaaatgagttcctccacaccaaagaagcaagttcacattgggcagcttctgcctctgagcaaattaccaactctaaaaccatgtttcttcccaattagttcttaatagaagtacaacatacttataacaaagggtgtataaatataagcaacaacaattaactgaacactcatgtgcccaacccacatttagaatagaattattatcagcaccttaaaacccctgtatgctcttcttcatattcccctctctattcagcttagaggttccacagtacaaaattttatattaattttctcttgcttttactttgtatttttcccacaagaacaatgtgctatttagctttacttcatttagtgctatatgaatgtaattctacagcacgcatttttctgtgacccttttctgagtttcttccacaatgatacaggtagttgctatccattcatttcttctgttgtataatattccaatgtatattcatacaatgagtaaatatgtgtccattcttttgtggaaggccatttgagctagttccatttattgcttttaagaacaatgctgctaagaatattcttgtaagcattgcttagggtgtatgtgcaagcattatgtactcaggagtggaattatgggttataaagtataatcttatttacttttattggacaatagtgaactgttttccaatttatacttctaccagtactgaatgaaataaattttatgttgatccatgttttcatgagcattgagttattgagaagcttttgcaataacatctcagaattgtccacctgggggaagaaggaaggaaggactgattgatccacgggttcttctacccttctggtgaagacagactcatgtgctgctagctaactaccttgtacttttaggtttcatatatgtgaatgcaggtgagttcatgcaggcaaccatagacagcatggattctggaaaggagaggtacagggtgtaccctcaggagagggagctctttaaggtaactcctgagcaagctcattaaagacagtatggaagcagttgctaaagcaggggatgaaataagagttgatacataagagagtacaacatttttttgtatttcttgtgttattttttgtttgtaggtatcctttatcgagttattagttatcttttgatttttattagctttaatgaaataaaatatgcatacagtaaaattaactttaagagtacaattcaatgagtttttactaatgtgtagtcatttgacctccaccctcatcgtgatataaaatattttcatcaactctataagtttcctcattttcccttgcagtcaataaccttctgacaatggctgatctgccttccatagttaataatagtggttaatgattccctttcatttctaattaaaaaaaaattcacatcaggaaaggatgttgaattatatcaaatgtgttttattaatttattgatacgttcatcttgggtttttcctcttacagtctcttaaagtagtgagttgcactaatactttattactatttaaataattccttagatagcaatttgatgatgattttttaaaataaacaagactatattcatattgctactagtttgcttatgagtaaacatctatattcatgaaatgttctcataactttgcatctcacactctttgggaggaagtcactatacacggttcacacttaggagtggagagttatcatctacctccttgaaggatgagtatttacataagttatttgtaaatcttctgcacaagagatttatttattttcttccaaatatttatttaatcacttatttatgtagctatggactcatagatatttattttatagtttgggttacaatccaatgctacattattttgttgctcatatgttggttcctgtgatcccttcacacatcacaatcattgtactttgtttcattttgttttttcaaacacttccttactttctagcactacaagatgctctacgctcatcttgtacatttctagcccaagtcctagaatcaactatttctcagggaagcccagtcctatacatttttaatacactattctttaaaaatttttgctattaaggtttttatggaatcattgaataatttgaagtattccttctttttctttacttgcctgtaaagccatctgattctagtgtgtgtgtgtgtgtgtgtatgtgtgtgtctgcgtgtgtgtgtgtctgtgtttttggtagaataaactattgatgttatattttaatgatttttaatttttttaattgaaccaattaaggtgggttatatttttttagaaattttccccatttcatctaatattttaaatttattgacaaaattatttatagtatctcatctttttaatcactttagtatctgtggttatttcatctctttcacttctaatagtctattttgtcttctctattttatttgatttattattatgactaaggatttattagtcttttcaaagaatggtttttggtaggctttgttggcctcttttgttccaattttttaaataatctttattatttattccctattatgtgggtgaggtttgctctgttgtttttattctgaggttggatacctagttagttatttttaaatgtttattgttttccaatatacatactgaaggctttaaaaatttctctaagtacaactttagctatatcctacaattttgatgtgtataatttttgttatttagtttgaaatagcttataatttcattatgattttttcatttatgtttttttctaactcaaaggttatatcaaatagtgctttaaattgcaaaattcattcattttttatttattcaaccagtatttgtcacatatgtagaaagtaccagaaactattctagtcattagtgttataacagtaaatatagcagaatgaaaactataggaattgggagtttacattctagagaggggagacagatgataagatatgtaatattgtatatggtgtgaaatgatttggagaaaaataaagtatggatgagggatagagattgagttatcaagaaggtgtttggcgaaggcctcagtaaaaaaaacaaaacaaaacaaaacaaacttttgtaaaagacctaaaggatacgagggagcgagtgttcagatattttcagaaaggatcctgacagaagaaatagcaagtgaaaagttcagaggtggaatcaggtttaatgtggtaatggaacaacagaggccagtgtatctggagcagactgaataagggagaggggaggagatgacatgatgaggtaagagagacaaaaccagaagccactgagggaatatgaagagaggtaggactcatccagctaagattttcacaggatcattatagttgtggagttgagaataaacaatgtggggaaaaaggaagcaaaaagaccatatttccatttgctttgtggcctagagcatggtcaatatttacaatgttctccaagtttttgcagaaaacgtatatccttcaatcactgaatgcagtgttacatatacattcattagatcaaacttattcattgtggtgttcaaatcttctgtattttgctaaatttttcaatctatttgattcatcagttgatacagatatatgttaaagtctcatttaattttgtcaatatgtgctctatatagtttgaggctatactattaggcacatataagttaagaataattttcttcttgcaaattaaatgtttttctcaccttgtaaaactcttgttaaaataaattaaaatggagaccatgtctgaagattccctgagtagacaaaaccagttagacctcataagcgacctaaacttgatgaatttgcaaacataagtgaaatttaagttgagttatttcctataaatgctgatattaaagaaaaacagaacttaagctcaaccaatcaggagcaaccaacaaacttgtaattctacaactgaggactttccaatggaatagattaaataaggcaagcatataactaaccaatcaaatattttctttgctttacttctgtgtctgtcctataaaagcctcccttttgtatttcctccatgaagctcctgaactgcttctggtttggagctgcccaagtcatgaattgtttgtgcaaataaactctttaaaattctattgagtttcagtttactttgtacacattcttcatacatgcataatttatttaatctctttcacattttccaactctttctgagatgcattcttgagagcctttatggatctatcttttatttatctcttttcttcttaactgaacaatttgctgtttaacccactatcaagtttttaattttaattattatgattttcatttctacaaatgcctttgattctatttcaaatatgcttttgtattttctattgtttcttattcattgtttaaattttcaaacttctattttatggtttgaagtatatgaacgtagttactttgtattatgggtttgatgattccaacattggaattcattgcacatcatattctctctctcagttatagtgaatggcttcttgtggcttttgtatttttgtttctgtgaactcatgttccttagattattacctctggaaattattcgagaattgggttgcaattgtttccctcaaagaggatttgttttattatttcagtcatttgcgggttcagaacagttatcttaaatacacctctcgagttttctggtttcacgaatttaggctgcaaacttgcatgagactagtctgtgtttaaaaattctcaggggaggttgtttcctcccttcgtacaaggtgaatgtcaagacaataagttttcttgctgtcttattggtgtgtcaggtttatttcttattactgttacatggaaggtctttccctcttgggtcctagctttatcctcagagttgtattagactcctgccttgagcaaggcttagactcttctcttgtccctgtgccttctgtagcagcaaataatgctctgctcaaggttgccaaggtttacagatgccctgtggacaaaggcttccttatttatctcttacattctgatgtttatgctttcattttattttttgtcgttttttcattgtttatttcttgccatatcagtggtgacatttaagaaaaagttcatattttatgcaactttttgttgtttttcttagaagggatgttcagggtttgaaatcagccacatggctccaaatagagccactttacaaactctttttcttcatgtacattattttcctcttttatgtgtacagtattgtttaggtattgtatgacctttaccctctcccagaagattactttgaagagagaaaactgtgataagaattaatcctgataatttgataattgttggtaaaattggaaataaacaatattttagtatgtcacagaaaaatattcaactatattatcacccaagtctactagaaaccacccaaatgtaaaccacagttattagtataaaatgtggacaaccattttccaagttgggaatctgaaagctacaagcaaaaacagcacaatataatctctattttagggttatatttcttctaactttcaccagcaatgttaggtaattggacaggtactatgaaagagagatggataaaatgcaatccctgaacttctttctaatttctgtcaagtcattgacttccattctgacaaccaggggatatatgcctaaaagagcatagaattatatcagtaaaaataataatcttttataaaataatgataagctcctcgataagaaaaatctattaatattgttaaaatttcatattatctataatgatacagagatccaatgcaatttctatcaaaattacaaaggcatttttcacagaaatagaaaaaattattctaaaatttgtatggagccacaaaagaccctgagtggccaaaacaagcttgataaagaaaagcaaagctgaaggcatcacacttcctgatttcaaattatattacaaagcagtaatagtcagaaatgtatggcattggaaccaaaatagaaatatagaccaatggaaaagagtagagagcttagaaataaacccaagcatatatggtcaaccagtttttggcaaggccacaaacaagacacagtgaagaaattacaactccttcaataaatgcttttgggaaaatgggacatccacatgcaaaaaaatgaaactggatccttgtgtttgtatgcatttatgcatttatgtatttatttaaaattttaattgaaaaataaaaattgtatatattttttgtgtacagcatgatattttgaaatatgtttgtattgtggaatggctcaattgagctaataaacatatgtattacctcatttatcttttatcgtggtgaaaacacttaatatctattatcttagcaatttttcagaatacaatacattgaaaccataaaactcctacaagaaaacagaggaaaaactccttgatattggccttggcaaatatttttggatgtagcaccaaaatcacaggcaaaaataaacaagtgggactatatcaaaccacacacacacaaatgctaactatgtgggtttgaataggataattagcttgactgtagtaatcagttcactatgaatatctgcatcaaaatatcacattgtacaccttaaatatatataatttttattaaaaattaaaattaaaaggttgaaattaaaagaaaaataaaaattatctctatattcaaggagatcattgggtggtagtttagcctgactgacaaaaacataaattatatgggtacagtgaatagatttataaaaagcatcatggaatcacataacaaagacccttgatccagtatgataagacaaaggggttgagccataatggactttttcagaaacattggaggttgggtaggtgagaaacagttggtgctgaatagttatcccatctatattttacaacctgcattgcagttagatttgaccatatggctagttctggccaatagacaatgagtgagagatagcctaagtcacttcttaactaaggcagttaagaatgaggaatgcctctgtattagtctgttttcattactgctataaagatatcacctgatactgggtaatttataaataaaagaggtttagttgactcacaggggaggcctcaggaaacttacagtcatggtggaaggcaaaggagaagcaagcagcttcttcacaaggagtcaggagagagagagtgtaggggaaactgccacttttaaaccaccagatcttatgagaactccttcactatcttgagaacagcatggaggaaactgcctccagatcccgtcacctcccaccagatccctcccttgacacacggggattacaactcgagatgagatttgggtggagccacagagccaaacctcatcagcctcttccatcccattctgctctcagacatgccctaggaaactgtgcatgtgatggtgttcaatatggagaaggattgactagtcttgatttgactttacaaaagtgagaaacaaacattgtgtttagtgatgagatttttgaaccctggctttagtggtaggtagtgtaaattacctagattaatgcagtacgttttaggtttgggatcccccgggaatagatgccaacaccaggattcaagaacaagtagtttatttgggaagtgacagcaggacatgccagataggaagtaagatgatgaacagttagcagacaatagaaaatttgttttcaagcatttattattggtaatttgagcttgatcctgctagggagttctggggaacagtgtagaatatgcacttttgagttattcttaagtgattgcgagggttgagggagctggtgttttatacaccagttcttgttagtcagagtttctcctgggaagtgttaattccccagcacttttgcttaccatgtagatgaaaaaatgggccttagtggctagagaaaacattcaaagaaatgcagctgggcacagcatgttttcacttgtatgaaggcatgatacatgacatattctgggaaccataaatacttgactgctgttggaatgtaatgtgagtggctgaatggcatgaaatagggctgaagagacaatatgccaactagtcatggaagcacttgtttgccatgtcaggacattttgtcttttgtcttgtcagtggcagaaagctgtgaattgattataagtgtgggagtgatgtggtcagatttgcactccagattggtcactctagagggtatttggagatggaatcgaagtggaccaattcagagactgttatagagcttcagtgatgagctcatgaaacttgaaactacaataatgataatacagacaatatgatagtagctaatattatttagcagtgtgtatgtgccaaacccatttttagcttcttacataataagtcagttaccacaacagtggtatcaatagcaattacttgtatatccatttttgggaaactgtggcacaaaaattttaagtacattgctgaaaatcagttcagcaaactgaactgaatgagatgggtgagcttggacacatttcaggatatgttgttccagagtctacactcttaatgtaacaacaccaactgatcaaaaaaatgaatttcataatgttatttgataaaatcaccagatcatggtgatttctaagagaaagtgtgaaggatgattaaatttctaccacgggtaaaagataagatgcacatatataaacaatatttttaaaagaagagaaaatctttcatgcataaagtgctgctaaaatgcatgtattttagcaacaacaaaaaaagcttctgaagtttattttatccctacagttataataaaagaaatgaaccctgaactgcattaatttcttccaagaaactggtacattaatttgtggcccaagagctaaaatattaaatagctcatttgcagggagtatagcattttgtttactagcaatttggcagttagatagggtttttgacctaggaataaacatccctctatgcaggaggggctgatttttgtcaggatgtaaaaagcagacctaatcacgaataagactagtagcctatagtggtcattttacctatagtggtcatttcacgtagacttaaatttaaaaaaaaatttttcttaaggacaaagatgtgtcacgcttcaaaaatttcttctctaaagatagctaaaattgtatggaaaatgaactttcatgttactattggtggttcagacagcaaaataaccagtgtaagtggtggtgtagatctactctatacaccaaaggaaataatcattcactttctcatttgaaagtacatttcctgagatcaatgatgtaaaaatatatcttaaaggctaggtgagtgctataggtgaaacttatttttgttttttgagacagggtctcactctcacccaggctggagtgcagtggtgcaaccatggctcactccaccttcaacctactaggctcaagcaatcctccctaagtagctgggactacaggcgtgcaccaccatgcccggctaaatttttttaaaaaatgtttttgtagagacaaagtcttgttatgtttccagggctgatcttgaactgctggtctcaagtgatcctctcacctcggcttcccaaagtgctgggattacaggcatgagccaccatgactggtcttattaaatgctgttagcaactatattctcttgtaagacgattatggaattgacaatactcttattgaactgctctacatacaatgtttttttttaaatatggtaaaaaaaacacaaaacataaaatttatcatcttaaccattttaagtttacagttcagtagtcttaagtatattcacattgttgtaagacagacctctggacctttttcagcttgcagatctgaagcgctatgcccattgaataataattccccattttcccctctgcccagcccctggtaaccagcattctactttctgtttctatgaatttattttagacagctcatatgagtagaatcatacagtatttgtctttttgtcactgacatttcatttggcataatttcctcaaggatcatccatgttgtagcatgtgacaatattgtctctccttttacaaaaaagttatagcaaactgtttaatagctaaaaaatttaattaatcaacagcaaccaattccttaagcattctggttgttattatcccatgctgtttaaatgcttttccaattgaattgaattgtagttcccataatccccacttgtcatgggaggaacctggtgggaggtaatcgaatcatgggggcagttacccccatgctgctgttctcatgatagtaaatgagttctcatgagatctgatggttttaaaaggggcttttcccccttttgctcagcacttatccgtgctgccaccatgtgaagaagggtatgtttgcttccttttccaccacgatggtaagtttcatgaggcctccccagccatgttgaactgtgaatcagttaaacctcttttctttataaattacccagtcttggatatgtccttattagcagtgtgagaaggtactaatacacatgaaatttagaatttttttttcttattctgtgaagaatgtcattagtagtttgatagaaatagcgttgaatctctaaattgctttgggcagtgtgaccattttagcaatatgattctttctatccatgagcatggaatatattttcctttgtttgtgtcatctctgatttcttttagcagcctttgtatttctcattgtggagatctttcaccgctatatttagctgtattcgtaggtattttattctttttgtggctgttgtgaatgggattgtgttcttcattaggcactctggttggacgttgttggtgtattgaaatgctactgatttttgtacattgattttgtaccctgaaactttgctgaaattgttgatcagatctaggaacttttcagcagacaatggggttttctacgtataaaatcatatcatctgcaaacagggatagtttgactttctgtcttcctatttggatgccttttactattttcacttgactaattgctcttcttaggacttccagtactcagctgagtagaaatgatgaaaacaggccatcttgtcttgtttttgttctcaagaggaatgcataccgtttttgcctgttcagaatggtgttggatgtgggtttgtcatagatggctcttattattttgaggtatgttccttcaatgcctagtttgttgagtttttttttttacatgaagggataatgaattttatcaaaagcttttctgcacctattgcaatagttgtgtggtttttgttttgtccctgcttgtgtgatgaatcacatttactgatttgtatatgttgaaccaaccttgcatcccagaaaaaaaaatactggataatggtggatttactttttgaaatgctagatttggtttgctagtattttattgagaatttttacatctatgttcatcaaggatattagcctgaacttttatttccttgtggtgtctctgccaaattttggtatcagaataccttatagaatgagttatagaatggccttatagaatgagttaggaaagagtccgtcctcctcctcaattttttttagaatagcttcagtgggagtggtatcattttggtagaattcgagtgggaatacatctggtcctgggctttttctgttggtagggtttttattactgtttcgatttcaaaattcattattggtctctttaggttttcaatttcttcctggttcgggaatttattcatttattgtgggttttctattttgtgtgcatagaggtgttcataatagtctctgagggttttattttgtatttctggtatttctgtgcagtcagtagtaatgttctctttgtcacttctgattgtgtttatttggatcttctcttttttctttattagtctagctagcagtccatcaatcttatttattctctccaaaaactaaaaacctgaatttgttgatctttagtatgtttttttgtgtctcatttttcttcagttcagctcagattttgtttatttcttatcttctgctagtcttggggttagttggctcttgttttgctagttcctgaagatgtgatattaggttgttaatttaaattctttttaactttttgatgtggccatttagtgctataaactttcctgttaatactgttttagctgtgtcctagagattctgatatattgtgtatttgttcttattagtttcaaagaatttcttgatttctgacttaatttcattatttacccagaagtcattcagaagtaacttatttaatttccctgtaattgtatggttttgggagatcttctcagcattgatttctgtttttattgtgctgtggtccaagggtgtggttggtatgatttcattttttttattttttgagatggaattttgctcttgtcgcctaggctggagtgcaatggcgtgatcttggttaactgcaacctccacctcccaggttcaagtgattctcatgcctcagcctcccgagcagctgggattacaggcacccaccaccacatctggctaatttttgtatttttttaagtagagacagcatttcaccatgttgtccaggctgatcttgaactcctgacctcaggtgatccacccaccatggcctcccaaagtgctgggattacaggcatgagccaccacactgggtcattgtttttccttaatttgctgagaattgttttatggatgatcgtgtggtcaattttagagtacgtgctatgtgcagatgagaagaatgcatgtatttttgtttttgagtagggagttcggtagatgtctgtcaggtccattaggttgagtgtcaagttcagatcctgaatatctctgttagttttctgcctcactgatctgtctaatattgttagtgggatgttgaaggttcccactattattgtgtggctacctaagtctccttgtaggtctctaagaactagttttatgaatctgtgtgttctagtgttgggtgctcatatatttaggatggttaagtcttcttgttgaattgaaccccttagcattatgtaaagcgttactttgtctttttggttgttggtttaaagtctgttttatctgaatttaaaatagcaatccttacttttattactttccatttccttgttagatttttcttcatccctttactttgagcttgtgggtgtcattccatgtgagactggtctcctgaagacagcatatatttgtatcttgcttctttatgcaacttgccacactatgccttttaattggggcatttggtcagtttacattcaaggttaatattgttatatgtgaatttgatcctgttatcatgttagctggttattaagttagacttgattgtgtacttgctttataatgtcaatggtctatgacaagtgctgttttgtgttggctggtaatagcctttcatttccatatttagtattaccttaagaacctcttgtaaggcaggtctcatggtaaccaaaccccttagtaagaatatttagttgtctaaagaggatcttatttctccttcacttacgaagcatagtttggctgaatataaaatttttggttggaatttcttttctttaagaatgctaaagaaaggctcccaatttattctggcctgtaggttttctgtggaaaggtcttcagttagcctgatgaggttccctttgtaggtgacctgctccttctctcttgctgcttttcataattttactttcatgtaaaccttggagaatcagatgactatgtgatttggggatgttcaccttgtataatatcttgcaggggttctctgcattacctgagtttaaatgctggcctttctagccaggttggggaaattatcatcgatgataccctcaaatatgtttccaaattgctctctcatttattatctctgtatttcagggcttccaatgagtcatacatttggtaactgtaccaatcccatattgcacagaggttttgttctttcttttcttaaaaaaatttatgggtacatagtaggtgcataagtttatggggtacatgagatgtttcaagacaagtgtacaatgtgaaataaacaaatcatggagaatgggatattaatcttctcaagcatttatcctttgagttacaaacagttgaattacactgcttatttcaaaatgcacaattaagtgatcatggactgtagtcactcaattgtgccatgaaatggcaggttaaattcattctttctatttttgctgtactcattaaccatccccatctccccccatccccagctacccactaaccttcttagcatctggtaaccatctggctactctctgtgcttatgaattcaattgttgtgatatttagatcccacaaataagtgagaacatgtgatgttagtctttctgtgcctggattatttcatttaacgtaatgatctccagttccatccatgttgttgtaaatgactggatttcattatttttgatggcttaatagtactccattgtgtagatgtaccacattttctttatccattcatctgttgacggacacttagattgcttccaaatcttagctattgtaaattgtgctgcaacaaatacaggagcaaaggtatctctttgaaatactgatttcctttctttggggtatatacccagtagggaattgctgaatcacatggtagctcaatttttagatttcttagggacctctaaactgatcttcttagtggttctacaatttacactcccatcaacagtctgtgagggtccctttttctccacattctcgctagcattagttattgtctgtcttttggataaaagccattttaacttggatgagatggtatctcattgtagttttgatttgcatttctctgatgatcagtgatgttgagtacttttttatatgcctgttagccatttgtgtcttcttttaagagatatctattcaaatcttttgactatattttgatcagattattagatctttttcctataaagtcatttgagctccttatatattctggttattaatctcttgtcagaagggtagtgatacggtttggctgtgtccccactcaaatctcatcttgaattgtagtgcccataatccccacatgctgtgggagggacccggtgggaggtaatttaatcatgaagacagtttccctcatgttattcttgtgagactgagtaagttctcacaagatctgatggttttataaggggcttcccccttcgctcggttctcacttcttctcctgctgccatgtcaagaaggatgtttatgctttcccttccaccataattgcaaatttcctgagacctccccagccaggctgaactgtgagtcaattaaacctcttttttaaaaaaatataaattacccagtcttgggtatgtctttattagctgcttgagaacaaactaacacaggtagtttgcaaatccattctgtgggttgtctcttcactttgttgattgtattatcatttgtcatgcagaagctttttaagttgatgtgataccatttgttcatgtttgctttggttgcctgtgcttgtggagtattactcaggaaattttggcccagaccaatgtcctggagattttccccaaagttttcttgcagtagttatatagcttcagttcttagatttaagtctttaatccattttaatttgttttttgtatatgttgagagataggggtctagtttcattcttctgcatatggatatctagtttttccagtaccatatattgaagagattgccattttctcagtgtatgttcttggaacctttgtcaaaaatgagttcactgtaggtgtgtggatttgtttctgggttctctattctgttccaaagttctatgtgtctttttttaggccagtaccatgctattttggttactatggctatgtagtataattcaaagtcagctaatgtaattcctgcagttttgttcattttgcttagcctagctttgctgttctgggtcttttgtggttccatatacattttaggattgatttttctatttctgtgaagaatgtcattggttattttgatagggattgcactgaatctgtagattgccgttagaagtatggacattttaacaatattaattcttccaatctgtgaacatggaattttttttttttttaagacagggtctcactctgtcacccagactggagtgcagtggtgcagtctcggctcactgcaacctctccttcccagcgtccagtgatcctcccacctcaccctcctgagtagctgggactacaggtgtgagccaccatgcctggatgatttttgcatatttgtagagacggggttttaccatgttgcccatgctgatcttgacctcctgagctcaagcgatctgctcacctcagcatcctaaagtgctgggattacaggtgtgaaccaccatgcctagcctatttttgcatttttttgtgtgtcctcttcagtttgtttcatcagtgttttatagttttctttatagagatcttttacttcttttgttaattcctaggtatttaattttatgtgtggctgttgtaaatgagattgctttaaaaaaattttttcacattgttcactgttagcagaaaaagtgctactggtttttgtatgttgattttgtatccagcaactttactgaatttttaaataagtactaacacttttcttgtggaatctttaggctttttcaaatataagatcatatcatttcaaacaaggataatttgactttttccttttcaatttggatgccttttatatctctttattgtttgattgctctctctaggacttccagtattaggttgaataatgtcaatgatgacattgggcaacctggttgtgttccagatcttagaggaaaggcttgcagtttttccccattcagtatggcactagctatgcgtctgtaatatatggcttttattatgttgaggtatttttttctatcctcaattttttgaggatttttcttttatcatgaagggatgttgaattttaccaagtgcattttcagcatcaattgaaatgattatgtgatttttatcattccttctgttgatatgatttgtcacactgattggtgtttgttgaaccattcttgcatcccagagataaatcccacttggtcatgatgaatgacgctttcaatgtattgttaaatttggtttgatagtgttttgttgaggatttttgcttcaatattaatcagagaaactggcctgtagttttctttatttggtgcctttttctggttttagtatcagggtaatactgtcctcatagaatgagtttgaaaattttcctccttctctatttttcagaaaattttaagtaggattgatattagttgttctttaagtgtttgcgagaattcagcagtgaagacatcaagtcctgggcttccctttactgggagactttttattatggtgttgattctcttacttgttattggtctgtttgggttttggatttcttccttgttcaatcttggtaggtggtatgtatctaggaatttgtccatttcttctagatctttcaatttgttagtatttagttgctaatagtagccactaatgatcctttaaatttctgcagaatcagttgtaatgtcttttcatttctgattttttgatttgatttggatctgctctctttttttcttagtctggttaatggtttgtcaattttgtttaacttttcaaaaaacaactttttgtttcattgatcttttgtatttcttttcatttagtttcatttatttctgccctgatccttattacttctactaattttgggtttggtttgttcttgcctttctagtactttaagaaacattgatagattgttcatttgaagtttttcctctttcttgatgtaggcacttagtgttataatcttccctctgagtcctggtttccttgtatcgcattggttttgtatgttgtgtttttaatcccatttgtttgaagaaatttttcaattaccatcttaatttcttcattgacccactggtcattcaggagcacattgtttaatttccatgtatttgtatagtttccaaaatttgttttgtaattaatttccagttttatttcattgtggtaagagaagatgcctgatatttcaattgctttgaatgttttaagacttgttttggacctaacatatggtctatccttgagaatgatccacgggctgagaaaaagtatgtgtattctgtagtcgttggatgaaatgttctgtaggttgggcatggtggctcatgcctgtaatcacagcactatggaaggccaaggtagaaggattgcttaagtacaggagtttgaggccaatacaggtaacatagtgagaccctgtctctccaaaaagtataacacaaaatgaaatgttctgtaaatatatattagatccatttagtctatagttcagttaagtctgatgtttctttgttgatttctgtctggaagatctgtccaatgctgaaagcaggcagttaaagtctccagaaattagtgtattgaggcctatctctctctttagctcttaatatttctttatatatctgggtgctccagtgttgtgtgcatatatatttaaaattgttatatcctcttgctgaattgacatctttatcattatagagtgaatagagtgacattccttgcctcatcttatagttttgtcttggaatctatttgtgtaagcatagctactcctatctatttttggttttcattggcatggaatatctttttccattcatttctattcagtctaggtgtgtcttaataagtgaattgtgtttcctgtaggcaagagatcaataggtcctgtttttcatccattcagccagtatatgtcttttttttttgtttttttttttgacagactcttgctatgtcacccagggtggagtgcagtcacatgatcttggctcactgcaacctccacctcccgggttcaagtgattctcatgcctcagcctctctagtagctgggactataggtttgcaccacccacgcatggctaatttttgtacttttagtagagatggggtctcactatatagtcctggctggtctcaaactcctgagctcaagcgatccacccacctcagcctcccaaagtgatgggattacaggcatgagccactgcgcccggcccagtctttttcttttgattggtaagtgtagtccattaacattcgattttattattaataagtaaggacttactcctgccattttgtttatcattttctggttgttttgtggtcttctcttccttcttttttttacttcctgtcttcctctagcaaaggtgattttctctggtgatataatttggtttcttgctgtttattttttgtgtattcattgtatattttttggtttgaggttaccatgaagcttgcaaatactatcttataaaccactattttaacctgatgccaacttagctctatttgcataaacaaacaaacaagcaaaaggaaaactaataaaaattccatgccttaactttgtcttcctctttttaactttctattttttctatttatatcttatcgtattgactatgtcttaaaaagttgtagtgattatgtttgattggttcatcatgtagtctgtctacgtaggacagttacagtgttataatattctgtgtttttctgtgtacttactattactagtgagtttgtaccttcaagtgattatttgttgctcattactttccttttctttctgattagaattccctttaccatttcttgtaggacagttatggtattgatgaaatgcctcagcttttgtttgtctgggaaagtgtttatttctccttcatgtttgaaggatattttcactggatatactattctatggtaagatgttttttcttcagcgctttaaatatgtcattcgactctctcctggtctgcaaggtttccactgaaaagtctgctaccagacgtgttggagctccattgtgtgttatttgtttcttttcttcttctgcttttaatctatattcttgatgtttgggagttggattattaaatgccttgaggtagtcatctttgggttaaatgtgcttggtattctatgaccttcatgtacttggaaattcatatcttcctctaagtttgggaagttctctgttattatcattttgaataaaatttctctcctatctctttctctacctcctcttttaggccagtaactcttagatatgttcttacaaggcgattttctagacctgtaggcatgcttcattttttaaaaaattattttttctatagtctcctctgaccatgtgttttatttatttattttattttagttctggggtacatgcacaagatgtgcaagtttgttacataggtaaatgtgtgccatggtgatttgcgactcctgtcaacccatcacctatatatgaagtccaacataaattagctatttttcctcatgctcttccgccacttgtcccccacaacagaccccagtgtatgttgttcccctctgtgtgcatgtgttctcattgttcaactcccagttataagtgagttataagtgttattgcctaggttttcttctagggtttttataattttgagttttacatctaagtctataatacatcttgatttaatttttgtataaggggtaaggaaggggtccaatttcaattttctgcatatggctaaacagttttcccaacaccatttattaaatagggaatcctttcctcattgcttgtttttgtcaggtttttcaaagatcagatggctgtagatgtgtggtcttatttctgagttatctattctgtttcattggtctatgtgtttgtttttgtgccagtacaatgctgttttggttactgtagccttgtagtatagtttgaagttgggtagtgtgatgcctccaactttgttctttttgcttaggattgtgttggctattcgggctcttttttgcttccatatgtattttaaaatagttttttctaattctgtgaagaatgtcaacggtagtttaatgggaatagcattcaatctgtaaattactttgggcagtatggccatttcaatgatattgattcttcctatccatgagcatggaatgttattctatttgtttgtgtcccttctgatttccttgagcagtggtctgtagttctccttgaagaggtccttcacttcttgtattttattttctttgtagcaattgcaaatgggggtctattcatgatttgtctctttgcttgtctgttcttgatgtataggaatgcttgtgatttttgcacattgattttgtatcctgagactttgctgaagttgcttattagcttaagaaggttttgggctgagatgatggggttttctagatataggatcatgtcatctgcaaatcaaagatggtttgacttactctttttctatttgaatactctgtttctctttctcttgcctgatggccctggccagaagttccaatactatgttgaataggagtggtgagaaagagaatccttgtcttgtgccagttttcaaggagaatgcttccagcttttgcccattcagtgtgatattggctctaggtttgtcatatatggctcttattattttaaggtatgttccttcaatacctagtttattgataattttatttatttatttatttatttatttatttatttatttattttgaggtggagtttcactcttgttgcccaggatggagtgcaattgcgtgatctcagctcaccacaacctctgccttctgggttcaagcgattctcctgcctcagcctcccgagtagctgggattacaggcatgtgccaccatgcctggctaatctttgtatttttagtagagaaggggtttctccatgttggtaaggctggtttggaactccctaccactcggcctcccaaagtgttgggattacaggcatgagccaccacgcccggccagtagtttttaatatgaagagatgttgaattttaccaaaggccttttctgcatctattgagacaatcatgtggtttttgtcttttgttctgtttatgtgatgaatcacatgtattgagttgagtatgttgaaccaaccctggatccccagtatgaagccgagttgattgtggcggataagctttttgatgtgctgctagatttggtttcccagtattttattgagggtttttgcattggtgttcacagggatattggcctgaactttcctttttttttttttttgtagtatctctgccaggtttagtgtcaggatgatgctggcctcatgaaatgaattagagaggagtcctcacttttcaattgtttggaatagtttcagaagaaatggtaccagctcctctttgtacctctggtggaattcagctgtaaatccatctggccctgggcttttttttttttttttttttttggttggtaggctctttactaccgcctcagtttcacaacttattattggtttattcagggattcaacttcttcctggttcagtctgggaaggtgtacgtgtccaggaatttatccatttcttttagattttctagtttatttgcgtagaagtgtttatagtattctctgatggttgttcatattgctgttgggttggtggagataacccctttctcattttttattgtgtctattttactcttctctcttttcttttttattagtctacctagtgtttccatttatttgtgtcttgttttatttcttttagcaatgttttgtagttttcagtgtacacgtcttttgtagttttcagtgtacctaaactttggataggtttattcctaagtaatttattatttttgatggtattgtaaatgcaattgtttccttgatttcctttttgtattgtttaatgttaatgtatggaaatacaactattttttgttgtgttgattttgcatcctgagactgctgaattcagttattagttttaacagtttttctgtggaattgttagctttttttcacataatataatgtcttctacaaacagtagttataatgattttgaagcacccaattgtcagggaacttgagaccactgtgatggctgcactgttttatcttggttgtttaattgtgatttttttttttggttgttatatccgggaaaagaagtacactgagctttgatatcaatgagtcagaagatctaaaagactgtatcgaaatagaaatgaagcatcatttctatttacttgttctagttactgacatttctatttactgaagcttttgcatcaatatatagaagtaaaagttgaagatatgtatccctagaagattactttatgcagcactctagagagattagcattggttagtatgaagggaaatgtcatcactagcttagaaaggtatttctttaaatactttttaaattagaattataactaaccaagagcaatatcatctcatattaaaaaatatgtttgtagatgccattctttttattcctcaaaataatgccacagagattgctatggtttattttgtttcacagttaatttaaaatatatatttaaatttgtaagtatttatttaggattattttatatctgtaggcttccctatgtataaaataattaaaaatgtttctagtttgtgaatcttcatgaaacttactaggaatttcagaggcactgattttatctaagtcttaggaaaccattgtaatatatctagaaaacaatttactgactataaaggtaaacatgtagaaagagtttcacattatgagccaactatcaattgagtctaacaagtacccaacaaagaaaacacctgcatgagaagcacagcagagaaagaggcagcaagtgctaggctctggggattttcttagaataaaacaatcactggctccatcaaggcagaaataggatattatttcttgtaggtcctattgttttgttgtttagaaatacagagttatatttatagtttatttataaatcaattaaaaatatctccacatttcttttatatatatataagatatatatatatataaagtggatatatattttattatactttaagttctagggtattcaaaatgtgccagttaagaaatgtggagatatgctgctataaaggcacatctccacatttcttaactggcacattttgaatacctattggtttttcaaatttactaaaattgttgcttgtttatttactggcttattgattgcttgtaaaacattcctttatttaaccatttaagcttctagcttattttgaaaaataaaaataaggtaatattcactcaattataggatttgaattcaaaatgaccattttaaactctgagtcttccacaaactacttataagatcttggataagagacataacctcactagttttgtgtttttatctgaaaagtagaattgctgtgattagtaaatgcacatggcctgggatacaattgctaactatatattagtgttattttatcccataaataccttagaaatcccaagatagaataattaaagttgaatataaaaagttccttatgtctcacctgtcccagttcttcggttaacttgtgagaaaacagtgaattgttggtgatgacaaaattaattagtggcaaaattgaggtttgaacctacagttcttaactgatgctccaattttcatgcacatttcttaattctagctcttaaagacaacttttcttagttaaaataagaaaacaagcagttaaaagcagttgctgactactcagggcaatttatatttgtaatattactttcatgaataaataatccagtaaataaatattatagtaactgtcggatgttagatatagaacaggataaagtggccagatggttcttttcaatgtaaaaatattttttcttgcctatttcaagacatttcaaaatctgaaataaagcatttttttttctttgatttaggtgacagaaaactagcacagcaaaagtgcaactgttgagagtaggaagagttggattaggttagggttgaaattactactgggaagattttatattgtaaaaaagagggcctgatattctatgaggaaagaagattcaaacagaataaaatgaaaatatttcagattgttttgaaaagtgatcatgtctgtattgtcatgacaagaatatgtttgctatattgactacaaattcaaagtactgatatatacatacatatatcacctagatgcatatgtatgtatatgcatatatgccactttgtctcatttataatagcttgattggtccagtataattcttaaactaggttttcttcacagtactgggtatgttatatacatgctgaggtttttactttcagttatgctatgaggtatgtaccatctacactttttccgtagaggaagttgaggctcaaagtagttatgctgttaattgaaataacagaaaaatagtttttttctatttttctttaaaaaaaaagttagaagtttgtgaggttagtgtgcatcatttagaccacagaatagtccagcaggaacactcactcttacagatggggctatggattagagcagagctaggactaatgttcagccagtaagaaccaattcagctaaaatgattgttaacatttggaagtacttctgtactacttggtaatttgctgcttccatgaacttccagggggaatccctcatctgccttgtaacaacagcctggctgataccttgtaacctgaaaattcctatatttccccacaatccatcatggcaggaagcatagctggcatagcagaaggttcatgtatcttgatcagggctttggccatcaggaaagaagtgaagggtgggggactgactgcctcctattttctcatctcactggccaaacacagttggaaactagagagcaaaagagtctaggatatatggtctgtagaggttggcctcctcaggcatagaaccagataggaaagaggtgaaaatggatctagtggggcaatcaaagtataaccagcaaaccagtagaatgaaagatcactgcagaaattaacatgacctttaaagcaataaataaatctgtaattctggcacagctgtgtttatgtcctgatgttcatatctgctagaagaaccctaaattaagagaaggaaggcagaagcttttggtttggactctttcaaacgctattaggttatgctgctgtcaccttttctgatctggggatttctgtcataattctctggagtctgtgtagatgcaaggccctgaatttgcctaaccctccccaaatcttgacaaatttcaactctttcctcgcatttactaagagtcacattgttaaagtaggactatctgcttgagagattaatttattataatagtccttggagttagactatagggtaattggcttttcagaaatctggaatgatgaagcataggtaatttttagaattgtttaggaaaaccttactctctctttctgggtataataatgtgagctttctcttgttcagttcttttcaggaaccaaaaatgtctagtattcttaaacctcttttgaacagaacatattgattgctatgttaagaattctaggagaatgatataaaccttgttataaaagagcagtattataaaagcctaagtacaaaagtgcaggaatatgaatgttctttcaactctgatgggaatttacttgcatgagagtgtctcaggaagttgcaaatcatggaggaagccagaattcagtgaaaatccatgcaatatgtgataccgtttcatgagctctgttttgtcacatatttccattacattctatacagctggttattcaatatggaaattatactatctctatatattagtttgttaaggatgccataacaaaaaaccacagactgaatggctttaacgacaggaatttattttctcacagttacggagagcagaagctcaagatcaaggtattatctagtctgctttctcccgagggctctctccttgcattgcagattgttgcattcttcggtgttctcacatggtcatacctttcttcttcttataagaacacaacgtattggattattggccaccctaatgacccaatttaatgtaatttcttctttaagtttctatctctaaatgcagtcacattctgagctactggtgataatatgaagtataaaaaccatgtgataatttcaattgatgctgaaaaagcatttagtaaaattcaacatccctgcatgataaaaccctcaaaaaactgggtgtagaaggaacatacctcaactcagtaaaagccaaatatgagagacccacagctagtatcatactgaatgtggataaaatgaaagccttgcctgtaagatctggaacatgacaaggatgcccatttctgccactgttatccaacgtagtagtggacgtactatctagagccatcagttaagagaaagaaataaagggcatccaaaatggaaagaaattagtcaaattatttttattgcagatgatataaccttagaaaaaatctaaagactgcaccaaaaaactattagaactgattaacaaataaagttgcaggatacaaaatcaacaacaaaaatcagttgcatttctatatacgaagagtgaacaatctgaaaaataatcaagaaagtaatcccatttatgatagctactaatgaaataaaatacctagaaattaaccaaagaagtgaaagatatttacagtaaaaactgtaaaacaataatggaagaaattgaagaagacacaaaaattagaagacattccatgttcatggattaggagaatcaatattgttaaaaaattcatactacctaaagcaatctacagattcaatgcagtccctatcaaaataccaaagacactcttcaaataattagaaaaaaaattctaaaatttatatggaaccacaaaagacccagaatagctaaagctgatgtaagcaacaagaacaaaactggaggaatcacattacctgacttcaaattatgctacagagctgtagtaaccaaaacagcatggtacaggcataaaaccagacacatagcacagtggaacagaatagagattccagaacaaaacccatataactacaataaagtcatttttggcaaaggagccaaaaacacacactggggaaaggatagtctgttcaataaatggagctgggaaaacttgatactcatatgcagaagaatgaaaccgggcctctatctttcaccatacacgaaaatgaaataaaaatttactgaagacttaaatctaagaccttcaactatgaactactaaaaaaaacattggggaaactcactgggacatttgactgagcaaatatttctttagtaatacccagcaagcacaggcaaccaaacaaaaatggacaaatgggatgacatcaagttaaaaagcttctgtacagcaaaggaaacaatcaaaaaagtgaagacacaacccacagaatgggagaaaatattttcaaactattcctctgacaaggatctgaatagacatttctcaaagaaaacttgcaaatagccaaaaggaatatgaaaaggtgctcaatatcactgatcattagagcaatgcaaatctaaactacagtaagatatcatctcaccccaattaaaatggcttttattccaaaagacaggcaataacaaatgctgacaaagatgtggagaaaagggaaccattgtacaccgttggtgggaatgtaaattagtacaaccactttggagaacaatttggaggttcctcaaaaaaagtaaaaattgagctaccgtataatccataaatcccactgctaggtgaataccctaaataaaagaaattagcatattgaagagatatctgcactcccgtgtttattgcagcactattcacaatagccaagatttggaagcaacctaagtgtccatccacagatgaatggataaataaacatggtacatatacacagtggagtactattcagccataaaaaatgagattctgtcatttgcaaccatgtggatgaaactggagatcattatgttaagtgaaataagccaggcatagaaagacaaacttcacatgttctcacttatttgcaggatctgaaagttaaaacaattgaacaaatggagagagagagtagaacaatggctatcctagaagccaagaagtgttctaggggagaagtaaggatggttaatgtgttttatttatttggatctcccctctttttttcttagtctggctaatggtttgtcaattttgtttaactttttaaaaaacctaatcttgttttattgatgttttgtattttgtattttcgttttaatttcatttatttctggtctgatttttattatttcttttcttctactaatattgggttcggtttgctcttgcttttctagttctagaaaaatgcatcattaggttgtttatttgaagtttttcatcttttttgatataggcacttaatagctataaacttcccgcttagtattgctttcactgttttccataggtttggatatgttgtgttttcattctcatttgttggaagaaatttttcaatttccatcttaacttcttcattgacccactggtcattgaggggcatgtcatttaatttccatgtatttgtatagtttccaaaattcctcttgtaattaatttctagttttattcgtttgtggtcagggaagatgcttcatatgatttcagttttttgaatgtgttaggacttgttttgtgacctaacatatgatctgtctttgagaatgatccatatactcaaaaaaacaatgtgtattttgtagcttttgggtgaaatgttctgtaaatatctatgagatccatttcgtctatacttcagattatgtctgatgtttctttgttgattctctgtctggaagatctatccaatcctgtaagtggggtgtttaagtctctggctgtccttgtattggggactatctctctttacctctaataatattttctttatatatctgggtgctccagtgttaggttcacatatatttgaaattgttatattttctggttgaattggcctctttatcattatatagtgacctccttttactcttttaatagtttttatcttgaaatctattttctctgatgtaagtatagtgactcctgctcttttttgttttttttttttggcatagtatatctctttctatccctctattttcagtctatgtgtatctttataggtgaagtgcatttcttgttggcaagatatcaatgggtcttgttttttatatccattcagccagtctatgtcttttgattggagagtttagtccctttacattctatgttattattgaaaagtaaagacttactcctgccatttcgttatttatgttctggtcgtctcttttttatttccttcctttcttcctctagtgaagatcattttctctggtaatattatttagttccttgctttttattttctgtgtagccattgtgtattttttggtttgaagttaccatgaggcttgcaaatactattttatatcccattattttaccctgataacaatttaacactatttgtataaacaagcaaacaaacaaaacaaaacaaaaacaaataaaagctctataccttaacttaatctccctgctttttaactttttgttgtttctatttatatcttgtggtattggctatgccttgaaaagctgttgtatctattatttttgtttggttcactgtttagtctttctacttaggataagagtagtttacatagcataattacggtgttacaatattctgtttttctgtgtactgactattaccagtgagttttgtaccttcaggtgattatttattgctcattaatatccttttctttctgattgaagtactccctttagaacgtcctgtagaatggatctggcattgatggaatccctcagcttttgcttgtttgggaaagtgtttttttctccttcatgtttgaaggataattttttccagataatacttttctatggtaacaggttttttttgggggggagggttgtgtttttttttcattcagcattttaaatatgccatgctactctctcctggtctgtaaggtttccactgaaaagtctgctgctagacctattggagctccattgtattttatttgattctgttctcttgctgttttcaggaaacttgctttattcttgacctttgggagtttgattattaaatgccttgaggtagtctactttgagttaaatctgctaggtgtactataacctttttatacttgaaaattcatacctttctctaggtttaggaagtttaggaagttctctgtcattatccatttcaataaactttctacccctaactctttctctacctcctctttaaggctaataactcttagatttgcccatttgaagctattttctattttctgtagttgttctttcttctgcttgctccattctgttataagggactctgatacattcttcagtatgtcaattgcattttcaagctccagaatttctgtttgattgtttataattatttcaatgtctttgttaaatttatctgatagagttctgaattccttctttgggttatcttgaatttttgtgcatttcctcagcacagctattaatattttaaattctttgtctgaaaggtcacacatctctgtttcttcaggaatggtcccttgtgacttatttagttcatttggtgaggtcatatttttgtcgatgttgttgatgctagtagatgttcttcggtgtctgggcatcaaagagctagatatttattgtagtctttgtagtcttcactgtctcaacttatttgcagccatccttcttgggaaggcttttcagatatttgaaaggacttaggtgttgtgatctaagatgtttttactttaggagtcatcccaagctcaataatgctgtggttcttgcagacttgtagaggtaccgccctgatggttttgaacaagatcttggagaattctctggattaccaggcagaaacccttgttctcgtcccttactttctcccaaacatacagtatctccccctgttccgagccacctaaatctgggtgtggattgacccaagtacccctgtggtgaccaccactatgattgtgctgggtcagacctggagccagcacagcactgggtcttgcccaaggccttctataactactccctggctactgcctatggtctctcaagatcctggggctctataatcatcagatggcaaagccagccagacctgtgttcttcacttcagggcggcaagttacccctagcctcgggtgggtccagaagtgccatctgagcatcagggacaagagccaaaaaacttagaagtctactcggtattctattttattgtggccgaactggcactcaaatcacaagacactttccttcccactgtttccttccctttccaaggacagaggcacctcatgccatccccactgccacccctggccaggaggagtaatgccagactactaccaattacccttaaggcttaaagtctcttaagtcagcttgtggtgaatgttgcctggcctgcgattcacccttcagggtagtgggcttttctctggcccagagcatgtccagaaatgctatccaagagtcaagtcttggaatcggggatcccaagagcctgattgttgctctaacccttgtggcaatattggtacctgatgccagcaagtttcagaggctctccaaagccctcaatttagtacctgagtatcattgctggttattcagggcctgagagcacttcatttagctgatgatgaattctggcaggactgggtcctttccttcaaggcagggtatgtctagaaatgtcatctgggagctagggctcagtatgggagcctcataactctgaccagtgccctatcctgctgtggcctagctagtatccaagatgcaatacatagcccccacacttccttctcctcttcttaagtggaaggaagaggtctcttttggagcctgtagcttttcagcctggggttaggggaggggtgatgctagcatttccttggctacctcagctggtgtctaagtatgtcctgtgcctccgagtccactgtttttgggcctagttcagccctaggactctcctaagagttgcagtcataatggtctagaatgcctttcgagtttgcatagaaacacagagcactttggcccttggtggcaaagtttttgggcactcatgttgggatacttgggactggcaattctcctccggctagcgctggcttaaatgttccctttgtaggcaggcttcagctgagtttggtctggttttcctttctgctctaacagaacagcactgagtttaatgcctcacaattgccgtgttcacccttccccaggtccaagatgctctcagcaccatgccacagctgccaggatggggaagggttagtgttaaagattcaggacttttttctatagcttcagcgtctctctcagcaatatgaagttacaagaaggtacaatgagtgcttacctgatttttggttcctctgaagctgtttttcctgtgtagattgttgttaacttggtgtccttgtgtggggagggggaatgatcattggagctttctattctgcattttgctccgtctccccttgcaataaattattatggaaaaggcagtgctattaattattcattaaatgttagtaacatttatcaatgcttatttcctttaaagtggatagaaaattagatattttatattgaaaaatatcaactgaaatatttttttctccagattcccaactctagactgaaacagatttttacctttaaaaatttctatttattgacattaacgtagatgagaagaatgcatttgcatctttataagacatccagtctctaaagtaaagatgagctctgtgacactataagactataattgcgtaagatggtgccatttaatttaaaatggaaatatgctgaacagcttatatcatatgtcttgttgactagtctttatgacaaaagaataatggcttccaggttatagattgtccttaggactttagtctgttgagttagaaaggcagagaaaaggtgaaaggaaattaccacctatcacaaatcaacttgaacaacatacaattgctccttagtcttttgatccatagctagacatgcttctactgatccataatactttctgactgatgacaaatatgtccaggtactgataaatctatttctactttgaagtttcttgtttatatattaacgtaatccttaagtatttttaaacacttttttcttttttggaagagtaggtgtatgaggggcataataaccagaagtcagtatcagccatctgttatacagtaataattttaattttaatgtattcagtgatgcctagcttaatggtttttaaatttagttgtctgtttcaggaagaagctttattactatcagagatatatcatcatgaggaaaaaaatggagaaggcgatactttgcttgagaatgccttcacaggcaagtgatgtgtaacaatatctactgcacaccactaaagaccaacttaagaccattaaagccaggagacgaagtcaatactgacataagagcttgtggccaattacatggtgactccagatttcctttgttttggttctgccaaatgtgttaaaaagtgagtaatgctcaaagcacagacatgacatggtgtacattatgtgctattagtcaaagacaattaatacaataaattgcctagctttcagaaggttccatggacagttattaaaatgctgagactgaacaataattttacaagcattttattattagtagtcataatgaccaaagcaaaaatcagaataatatagtttcgagtagatgtaaataaaattgggtaatttaggtgatgctacgctatggtaagccttaaaaattggatggagaaatctagaaatgatgcagcaaacaaaaggaagatatttaatttgttaggatgaaagcattatattaagattaatcaaagataattttatctttagttactaataattaaataagttactgaaattacataatggattaagaacattttgtattgtcaactaggtttacttaaagattagaagcaaccatctagtcacaacacaatgatcagtggttgacagactgtagagctaaattagcattcaaataatagcttcgagcacaagaaaattaaaaagtaataaatcattcgaaaggggcagatcatcaaaatacaaaataatagaatataaattgtccttaaaattatctagcttctcatctagtttctaccaccatatgagatagtttttctcaattctttgggtcccatggtcccactatgaaaaataaaagaattagacatcattatttctaaagttttaccttgtgactttattagcgtatttcatcagtcctaagaggcacacctttcacattttaacttctctgaaaccaggatgtgtctatcttaaaattgccattgtctagatagcagttatattgtacttgtcattgcctgcccatgtgctctcttggtcatagctttaaatataatttcagttgagttatgttactaaacatgttgagttttattgatttacaatactataagcaactacagtatcatttgacttgaaataaagaattatttgtgcatgaaaatacagcagtaagagataaatttgatgctatcaaagcaaatatttatcattggaagagtgaacatgatttcataattttctgcaaagaaatgaaaaaattctttacaggaccttaaatagattcccattgcaaattactgttttaggttttgttatatccttttgaaattgcctaatgtactccaagcaatgtcgctttaggcaggagaaatttccaaatcacttggaaatagaagaaatttccagtagcttgaaagtagaagagaaaaagtcaaaacaaaaagagcctggtgtgatcaaaccatgtgccatgcaggacttccattaaagcaatacatcctaatttaatttgcaacattttttttttcttaattgttttagtgagtcttgcaaatatttgtttctatttgaagaaacacagtaagtgccagaattggtttcctgaacttcaggtattgtttcacgtattttattcacatatatgattccagctctcatatagttgactcttaagttacacagagttgtaaaaattggcttaaatgcacaagttggaaaaaaataatttatattttttttgtggagagcagtaaaagttttagactccgcttcgcaatgtctgcataggactagctatagagtcaacattacattggattttgttcttgtagtatcacaatgaactcacaagcatactctaaacaaagagacaaaatagtatgcatcatttcttgaactgcactggcagttgagattcattagaaattaagatttaactgccattaattcactgtggttatcacatgcagaaaataataatcagaggctaaatgtaatccttgcagtagcaatcctgacaatttttataacttgcaattagttataaaagagaaatcctggattactcgtaaattgtgaagtgccatcaaatactataatgcgacagtaaagtaggcatagttcttacccacatattaaagattaggcttaggtattaaactgtgaaaaactgctttccaaggtatatatatttcaaaatagccaactctgcaacattttctgaagagttactttctgttctttgtgcgtaggttatttttcctcatgtgtgcagcagtgttttgcaattattggccatcttttactcctgatttcccttacagaagattgattagcacaatcagtcactggaaagcaatttgcatcaccgaaggtagcttcttttctctcttgattagcagccctactgcaagttattcagcaaaaatagataatccataagaacactgctagacgaacattctgataagacaagagggttggagttgaatatcactgacagtgtcccaggtagacaaatgatcaatgaagccttgctgtcttctatttgtgtgattttcctttattgtgagaattggacctttagtactgtttttgtttctcattcctatatgaatctttgggtctttgagaacacatatttgcctgtgatttgtgtaaaaaaatgaataatacctattatctatcagtatcacaaataaatggtaccatatttctatatagatattctgccagccaaaccaaaagcagtgtctatgtgaagaaatgagtcaaacgaagttccattgaatcatacagtttttctattaaattaggtactattatgaaacagatattagttctctagttttgatttaaaataagtttagaacgtaaatatgtatgctggcagtagaaagatgaaaggagaagtttaacagttgtttctttcgaggttttgctttactttctctgcttagaaggaaaaatgcatggggctgcagaatgattgagtagaaaagttgatagatctggggactctatataataggttaaaatcctcagcaggctcacttaatatctgtgtggctctgagcaagccaattaacgtttctgaacctcagttctcccatctataaaatgggcacaatattaattaccttgtcatgattaaagatattgtatacaaaatgtccaactcatatcaggcacagtaaatgactgctatttcatgatctgtatctatatctatatggatagtaaaatataagcccattttcatctgtagctatatagataataaaatataagcccaagttggagctgtactttcttgccctcacctggaggtgaaataaatagaaaaccttcatttaaacgtttgactccatataaagctgaagtatcaaatgactaaaactcagttctgcattagatgaaaataattggtcatccaaaacgaattaagaaccatttaatttttaaactttagattctaaataaaaggcttgcatattggtatttttaacaactaacacaacttaaacttttctttcttcttttctctttgtcacaatattacattatagcagtgaaatcggagtctttcacctttctctactgaaatgctcccaaactccataacctactctactccagcccatactgtctcattgtcacagatacagtccaattcctcctgtctttatggcttactctcttctgtttccaatacaaataaaatctttccatcttctattatcttttatttggcccatttctccaattctgcccaaccaaaagccccaaaactagcaggcaaagagttggacagaggagcagctcttaagccaaaactcttaagtcaactacttctcacatttcctccccagttctccacttccccttcctgccaaatgttgaataagaatcaaattcagaggggccaagatctgaacagacatttctccaaagaagacgtacaaatggccaaaggtatacgaaaatgtgctcaacatcactaatcatcagggaaatgcaaaccaaaaccataatgcaatatcacctcacacctgttaggatggctgttattaagaagacaaaatgtaacaagggttggcaaggatgtggagaaaagggaatccttatatgttgttggtgagaatgtatattatgggaaatggtatggagatctctcacaaaattgaaaaaagaactgccatttgattcaacaagtccatatctaagtgtatatccaaaggaaataaaatcagtatctcgaagagatatctgcatttacatgttcatggcagcattattcacggtacccaatatatggaaacaatctacttagattgttgtgcctgtagatgaatgaaaggacagagaaaatgtgtgtgtattttttttttgtatgtgtgtgtgggtgtgtgtgtgtgtatgtttaatggaatattattaagccttagaaaaaaccttaggagcacaaagtacaatggtgattgctaggaactggggtagtggtggcgatggagggggaaatttggtgaggttactcaaagggtataaattttcagttatgtgggatgaataagctctggagatctaatgtgcagcatggtcactacagttaatgataatgcattgtgtacttgacatttgctgagagtagatcttaactgtccttaacacacttgcacacacacatacacggtaaatatgtgaggtgatggatatgttaatcagcttgattgtgataagcactttacaatatatatgtatattaaaacatcatattatacactttaagtatatacaacttttatgtgtcaattatacctcaataaagctggagagaaaggaaaacaaattcagatgcaccaacttctgttttattttactcaggatgttaagaaagaagattctatgggctatcttatcctcttgtttataatgcctatcattgtgatggcagagagcaaaaacaaaattttgtgtattacagaaaaccaacaactggtttaggattataggaattccttggtgggtccctctgaaaacaaattttaaaaatgacatgaatcattttcaaaattgggacctgttttatttatttgtagggaaagttcaattaattgaatgtctgaataggctaagagtatggataataacaggtaatataatcaaggccagaatttttgtatttcataggaagaaaagatgaagctttttttccgctgaaagattagggaagaatgttatgaaaaattgtagggagggttccagccaattgtgctttatgtttttgtcttttatgtttgggagcattccaaacttatgttttcaacatccagaaaagaaaggcacaatataccggtcaattttctaaaatacaaaataaagtgtattttacatgtcatcatgtgtgaattagctattaagagctcagactggttggaaggtagcataacttcctctgaattacagtgataattcaaattttaaagactccgtaacagtttggcaaggaagaaaatatactgagagaacagaccaacctatgacaaatgtaaacttatactttcccactgttaggaatatgcaaactgtacaaaaaagggaagcaagggcttcagaaaattttctgaatattagcataaggttaatgtggcatatttttgcttttatatataaaactaattttggcaaacagtggcgctctatcatttcctccttattataagatgcgtgcaaccaattcagttatttcttaaaatgtatacatttgattgaaaaagcacttattgaacccattatatagttactcatattcactgagtggttggtaccaagaacatactgtgtgctggtagtgctgtgtgtattgtcactcggccattgtagtgacacctgaacataagatttatataattaatggggtatgatacatattaataagtgcttcaagtgatatagtttcaaatatagggaggtctcttcttcactgtgacagtcacacagccagctataaagaagtgtgtgactgcaaagccaatataaattagacctgcaattttttacttaacttagaataacttttgtcccatgaaattctatctgtgtgaccttacattcctttgctatatgggaatatttaaaacaggatatttcatttgatgattacatgggagaaggcatttcaagcatttgcaatctttatctacatgagaaagtttatgtaggtagtgtctactagaaaatgtattctagaattcttatgcttctaataggcaatttccttcccattggacaaattgaatatgtttcctgacacttaactctttctaaaaaggagtcttttatcttacacctgatttgtgtaatatgtccccaatttcataagctcttctacatttacgaaaataggtgccatcaattgctattggtggattcatgcttaataaactgcagaatgattttcttaaaatgccaactagatcatgccttctcccccaaatttttcatgcacttcccattatacctaaaataacatctcaaatactaaatctttttataaagcccttttgggagctgacttctgccttcctccacaaattcttcacgtttcatcccctccccctaccgcccccccgccaccatgctactcactcttgaccttttttcattccctcaaacccccaaataactttcttacctcagggcttttgtgcatcttcttgtttgctcttttcatgcctgacttattctcatccttaaggacacgctatacatgattacttctcagaaagaccttccttgaattttcaattgaaattaagatccctcgtacaattctacaaaacaaacttagtttccctttatgtagcacttatcatccctcctagctgtgcttattgatgtgataatttgatagtctctttccccttaacagtaaactgtgtaattgcatgggctttatctgtttcagtcaatacagtatctttagagtgtagtatagtgcccaaattcctcaaaataaatggactgaaaaaattcagtcaatggatctgcaaaaagtaaatataaatatatctccttcccagaatatcctgtccacagggtttttgttttgatatttttaaacaggtgattataagtggttgtacaagtagatattaaggagccctggattgttctttgtaatagagaaagaaaagagtgtcattggcagactatggttcaattgataagttgaaggagaaaatgggtcagagtgtttcgggcagtggatttgggggtcaatctcctgtagctagatgatcaatggatttgaaggatagacatatctaacatgcaatttgaatttacttttacatattttgctgatgtattttttagtagaattgtgcttaacaatattctgtattcctctttggttttggtgagttttgggatctcgaggagcagagtacatgtcccataattattatatttaaatatatagatatatatttttaaaggccccaatccctgtctctaacaaagagtttagggttgttaaacttaagggtatcataaagttgatccatggctacaagtataacttcttagaaataagctccagacattgatattggtaatactgtctaagaattatttgataatttagctaacactgtggcatctctcccataaaatatttcatactatcattaaaactacatgaaaccatttataaaaaggcatttttactttttattgctttacaattttccaggttccaggaaggctaagttctatacctgctataactttttgcagctgcaactgaaaaaaaaaatactagctacaataaaataggcaataaaatgctcttgaaatacacacaccatatatataactattatacacacatagatatagatatggatatctctatctctatctctatctctatctctatctctatctctatctctatctctatctgtagatcatgccaccatactccaacttgggtgacagagagagaccctgtctcaaaaaaaaaaaaaaaagacaaaaaacccctaactctctaatgcttgttccaagttaacagctccaagcttttatttttacattcttaaaattacaaatgttatatacatgcatcagaaaaattagaagtattgagcatggttaaatatgttcacaaccccaactcttttaatggtaaacatttttattatttcattcctgatttgttccccttaaggctgatgggttttgccttctgtccctccctctccccctcccttccttccttccttccttccttccttccttccttccttccttccttccttctttccttccttccttccctcctttcttcctttcaagtttgttgtttcatttgtttttatttttattttttgagacaaggtcttgtttagtcacccaggctgcagttcagtggcatgaccatggctcactgcagccttgaattcctgggctcaagtgatcctcccaactcagccgcctgaatagcagcgaccacaggcacacacctccatgcctggctaattttttgatttttcttgtagatatgaggtctcactatgttgcccaggctggtctcgaactcctggactcaagcaatcctccctcctcatcctcccaaagtgctgagattatagatgtgaaccacaactgctggccagttgttttaaaacaactgttttttttttttttaagtaaggaaatacatcatctgtttgtaagatagctcttgtaaaataaaatgtgtttaaatataaaacaaaataaactccagtgatgagatactacatacatcatgtgaaaacaacagtctgatcttcatgttatgagtactagaattacaaaatcactacacaattaaaaaataaaaaatacatttttagagccaaaaattactaagcggaaaatgtccaagtttccagtttggcaaagattggatatagttatatgaaatatttaataaactgaattttcccacattgtgtaaacaaaatgactaagtctgtgtctggcgattacagtctgactccatagctacacaaaacatgcagttttgtataaccgtagttcttaggttaagagagggcaggtaaagtgactgcagagaacaaaaatgtgggaagaaaaaatattgtataccagatagcatacaataatggtgaaaataaagcctattaatgcatctcctaatgatgcaaaggtcatcttccaactttgaaaaatgaattaagaaagggcaagagtttaaataattgcaatgtcacatgaaaaaatccgcatgtgatggataaaaacacaatggaggatttatacatgttagttggaaaaaagaagagctgtcaactttctttgtccaaattaagaaagagtaactaagtttgtcaatatctaacatcacttatactgttgttaacaaattaataatagcaattctggctccatgtactaattagaacttttgaccacgtgctgattgaacccagtgagggaggacaccaaataaacctatgtttatttttagtttaatttggtacattccattctttttttaaagcatttgtcagcaaacagatttagtaaaagaacaggctgagttggcctatatagctatggatccctgagattgctttggctagttaaatctcagttttattgaatccttaataacaggcataggatttgctgggagaggaggagtattgaaaagatctgtacaagatgttttctgagagcccaacagaaaagctcttaggttcctggttcagtggtatttttctttatatcaagttgtttctttatttttgttttattattcccactcaaagcaagactgttagcatcttcacttgttttatctcttctgggtttttttttttttttttttttttttggcgggggtgtggcgcgatggtgaggaggtattcctctttatgaggtgaggatgtcctcttgacttctactacaggattaggtaattttgtttctccatttcctgaaagactagcttggtttaccagatgtgttaaagaaaagactctaggctaaagaacaaagactttgttggtggagaaatagctgattctgttgcagtttgaggaatgctctcactctattaactttcactgaaatttacttgtggcacagaaacttcaatagcctttatcttggtcacagatgctgctataacagctgttgcaagactatatctgcactgatagctctcagaacagttcaatgaaccagtcttcagagcacaggcagattaaggcacaggcttgctgttatcactgtccattgaaaagcattgcagcaattttcatgcatacttcaaaaatcttggtgtttattgcttgcctataaactgtatctatgcaagactgaatatcataggagaaatcaagattgaggttgcctgagtgttttgtttttgtaaacactaactcaatcacctgtattgtatgaaattcttccttattctttttaatcatcttttaattcttactgtgtaacaattgttccctgttcctggctaaaattctggacatgctccctagtttttccagtctctcttaaccaataaaaatattttaatatcttccaagcattaacaaattcgatttcatttcataatgactactccaactcagtgttatttcagatgccaacattattcagtgttaaacttttctcctcccaaactcagatctgcttgagtactggaagcctacagtaggaaaaggatgtgaactggatttctgtcttagttgtttgctaatcactatatgactgggtaaatgactggcttagttggaacctggtgttagaaaacactggtgatagtatttttccatgatgcctttctatcaccatggcatacattaatggagtacttagcaattttcctattgaggatctcccatttcaaccctttggtgaggggaatgccttgtgtctagctgtctatatacaccttcatccttgccccctgggtctttagctgtttatttttcagttggtattcctgtgtttcctcagtcagtcatctgtgctggagtgaatcctcagaaaactccagactgtaccgctttctcaaggtcgtatttggtccccagaaaaccttcacctgtgccctacctttgctggaaaaggagctggatcccagggcagccctctctactccaccatcaataaggggtagcaccagccacagatcttgcctttagaattcatgggtataagtcacatgtctgtcctcttgttcttcacacccttggaaacatatttgaaactctccttagggatcctgaagctcctctcatgaattgaggtgaggtgaggtatagcacacttaaatctttcttgaaataaatcatctctccactacacactcactacataaccagtaaagtggctaaaatgaaaaagaaaataccaagtgttagtgaggatgtggagaaactgaaacccctatatatttctggtgggagtataaatcggtataatcactttggaaaatactttggcattatgtactaaagcttaacatatccattctctgtgacctagtcattccactctttaggcacatgtgcacgtatgatcaacagaagtgtattcttaaaaaccctattaataattgccccaaactgaaaactgcccaattacccattaacaaaagaataaaaaataaaatggtggtatagtcacacaatgaaatgaaatatggtattaagaatgatcattctacaattgcacatgccaatatatcaaaaacacaagatgaagccaggcacaaaagagtacacactatatgacatcatttatataaaagtcttaacacaggccaagttactctatgctgtgttactagtaaagaatagtgcggtgactagctagaaaaaacttgagtgaggaatatgtggtgctagcaatattctattttctgatctggtgctcatgtcatgggtaattttagttcataaaatgtattgaactgttgcttgtaatatgtgcatttgtattttgaatattatgcctcaaaaagaactataaaacggaagtaagaaacaacaaaaatgaaattagccatcttaactttttaatctcaatatcttatataaggtttggagggttgatctgttcatgtcaccatctttgcaaatcctgcatagatgaaccagccccttggtttagagagtgtggttaccaggcaactgttgttctcttctcagcctttgtgacctctttctgagcctacggtaggaattgcatttatcatctagttacctaaatgacatccttggtacaaagatatcagaagcttggggatccaaacgaggactctgaccatgctcattggcagggactgtgggtcacaaggtgccagaagccataaaaagataaaaaacgtaccaaatgggaaatgaattgacagccatttttacattagccttgagagtcacaattctgggctcattctgcccagttcttctggtaatatccctatgagttcactatgggatatggattgacaaagtgatgaagctgaattggaagagcatttatggaaaatatgtcagagagcagaagaggtttcacctacattaatctttgtcaattattttattatgatgcaggcaggcactctgaaactcacaaatatttaatattctctgagccaaattgttctctcttacatccatatataccctgtaacccaaaaagattgcacctattgaagcagtaccgaagtcgcaggagatttggacagactctgaaagaggatgactactagccacgggcatgaagatttttccatttcaagatacatactgataagttgttttccttttgacaatgttaacagcaatatgcaggattatcaattttcccacatccccttaagtattagctaatatttacttaaatatatgcatatatggttttcataggtagaaatggcctttcaaacattttaaatctaaagacaaagcatattagctataattttatcttctactttttaggaaagtttttttcagcacaaagtgactatttcatcaagttgctgttctgtctaaatgtgaaactgagcttctgttcaatctctaggaaagaaactccataaaagatataaggacaatggtctcagatttctcaattagtttaacaattgacaattacgttaatctgagaagaccttggtggatactatctgagatggtatcactcttttgttcattgtattatctagtgccaagctaatgccagaattaattattagcaattattgttctttctttcaatagctggcatatggagcaaattctgtttttttcttgtttgtacaatagtttattataatgcatataacttcagaatagattttcttataactatctgaaattattattatcatgatggacaagactatttctgaatgggaaaatttcttaagataaaccaaggataataatgaggctcttacaattttctatttttgtatgttatgaagcaataagagatatcctttacaaaacttactgagaattttacagcactattccaagatgcttcatactttgttaaattattacaatagagttaatgattattctgttagtgttagtattcttaataataattttaattatcatataccaatttttaagttttattgaggtatatttacacaccataaaattcatcaatcccaagcatacgatttgatgatttttagtaaattagagagctatttaaccatcatcacaattcaaaaagattccactttcttatttaccgtcactcctcagacccacccccaaccaggggtaacaactaatctgtttttttttttctatgtatttccttttctggccatttcacatatatgaaatcatacaatatgtggtcatgtttgtctgtcttctttcacttagctttttagaattttttgagtttttacttatttattttttgattttttatttccattggttattggggaacaggtagtgtttggttacatgattaaattctttagtggtgatttgtgagattttggttcacccatcacccgagcagtatacactgcacccaatttgtagtcttttatccctcacccccttcccagccttttcccctgagtccccaaagttcactgtgtcattcttatgcctttgcattctcatagcttacctcatcgtatgttatgagtgagaacatacaatgtttggttttctgttctgagttacttcacttagaataatagtctccaatctcattcaggtctctgcgatagattcatctatgtcgtagcatgtacctgtagttcctcccattttattgctgaataattatctatatatactacattttgtttattcattcttcaaccagtggacatttatgttgtttttagtttttgactattatgtacaatatcgccaggaacattttcattcaagtctatgtgtggacaaatgttttcatttcctgtggggtagatacctatgagtaaaactgttgagttgaatagtaagttgttccattcagtgtctcaaccacaggcagttgtgatgttggccttccctgattgcttgccaccaatatcaccactgtctgagacaaggcccctgaacatgtattaccaaatcaagctagactccactggcagtgaaattcctgattgtgatgacttgctccatcctagtagaactaccacccagaatgagcttgatggggaaggagtaaggaggggaaagaagagagcaactatagggtaaaatgcagtagactgacattcttcctacctgaaaccccaagttcagcagtttttcaagcataaacaaatgctttccggattgttgcatgcctttggtcaattttcaaacaatattgaaatgaatgttttgacaattttatctagttgtatcattgtgttttgggcagaaggtttgccaatctcctcattctacaattccggaagtcttccctcctccaaataccagttttctaacttaaaaaaaatgaaaacaaatatatcaaggcaccttcttcaagcgcatacatgttcttcaggcatatacatgtttactgaaatagagccttaggggaagaaaggttgttaaatgagtgtcaataggctagacagtattatttcatgaaaatatactaagttgagaatacaatcaaatataacatgacatctgattatcccttctgatttgaggaagctatacaaaatatgccttccttccttgcctgtgaacccttagctctgtctcctgaactcagggagtctgttgggcttcctctgggttcgttctccatcaaccatgggttgagaactctgtaagcagtaaagtggggcaaacatagatagggttcatcttacttgttttccatctttcaagaataactgtccttcattgtacattggttttttttaaaaaaaaacagcatttcgtatatctaatatgattgttttgttttcaggtgggaaagtaaatctggtacattttactggatcctgttcagaagtgcaagtcacaatcaataactttttgatcctatatgttgtattatttttcttctcaacttaaaaaattatttttaatttttgtggatacataggtgtatatatttatggggtttatgggatattttgacataggcatacaatgtataataatcacatcagggtaaatggggtatccgtcacctcaagcatttatcctttgtgttacatacaatacaattatactcttttagttgttttaatatgtacaattaaactattattgactatagttagcttgttgtgtttccaaatgctagaccttcttcattctttctatttttttctctccatcagcctttattttaggttcgggagtacacatgcaggtttgttatatgagtaaattgcatatcactggggtttggtgtacaaatgatttcatcacccaggtagtaaagagtgcatggtaggtagtttttcaaccctcatcctcctcccatcctcaaccctcaagtaggccatggtttctattgtttttctctttgtgtgcatgcgtactcaacgtttagctccaacttataagtgagaatatggtatttggttttctgttcctgcattagtttgctgaggataatggcctccagctacatcaatgttcctgcaaagggcatgattttattctttttaatggtttcatggtattccatggtgtatatgtaccacattttctttattcaatctacctatgatgggcatgtaggttgactatgtctttgttattgtgaataatgcagcaatgaaaatacgagtgcatgtgtctttttgatagaacagtttatatttgcttgggtatatacccagtaatgggattgctcggtcaaatggtagttctgttttacgttctttgagaaatctccaaattgctttccatggtggctgaactaatttacattcccaccagcagtgtataagtgttcccttttctccgtgtcctcactagcatcctttattttctgcctttttaataatcgttattctgactggtgtgaaatggtatcttattgcagttttgatttgtatttctctaatgattagtgaaatattgtactttttagcacgaggattttcatttgattttttgtttagtagtatttctatttctgtatccatgtggtaggtttctatgtgatatatattttctttgtaaagtttatatttgtacatttttaaaaaaatacaaatggctaatgacttttaatcagaaaaagacgaaaattaatgtagatattgtatgcaattttgttctcaagttagatataaaaccctaaaggctttcataagggaaagaaagaaaatgagagtgtaggtgatgagagagagtaggggaggagaaacatatatcgaattgaaatagagataaaattacaaaagaactgcaagatctaccaagacatgtattaacattgacatagtatctaccacttgcctacccaatgataggtattatatatacatctacattacctttgtttcactttactttttaatttcttattgaatttttttttgtatttattcactttcaatttttttgagaaacttttcttctaaatgttgagaatacaaggataaaacctgatttagaacttatattgtaggaggttattgaagttgaccatgaataagcaaatgacttagtggtctaaagaagaaaaaaaatggagtcagaatgtatctaccctgttacttctcatctcaagctttccattggcaaatgatttgatgagcacatatatctctatcagtcaattttttaaaaggcttctctggtaattctgattgatagttaaatgtttaagaacagcttctctaacacatgattttacctgcttgtattgcaaataaccagatctaaaatcttattacatttgtttagttgttgaattttatcactgtatttaagctggtttaaacttcccttcctatcacactctctgggcataagccagtgatgggaaatttatgcaaaagccattgagttagacattaggtaaattaagtacaactcctagattgcaagaactttatgcggaatatacaacgaacaaaccaaaacccatcatattagggagcctgtaatatatatctttgaaagagtgcaactgaagtgttacagtggcttaaagagttaaatgctttctagaaacaggcttttgataggattaaagaagagacagattttaagataggtagatacgtggaaaatcagtgcattccaataaataacatacacaatagaaatatacattcatatcttccctgaagtgatttgtaatcttgatgagctcaaatagtgttctcatatgaattctactagatcatcatattttcatttgttacatcaccatagattctgtctcccagacttgacttaatagataatagtttatctctgccttttttgggaacttccttggaaatggattgactctagttcaatagctgacaccaacacaagtggatcttttgtttcagaatttaacatattgacaattagtttctagagtgaggtagaatataatgcataaacaccaactatcaatcactaactttacactttactaattccgtatgatgtggtaaaaatgatgaatagggccatacttggaggaggagtagggtagaggcaatggcccaaagatcaagtttgcaggtgacaaagcattttaaccaacaaaattaccatgactttcttgagtgtctgctctgtaaaatacaccatgctaggtgacagataaaaagaaatataggatgtgatgttgcctgccctcaacagcttataattgaattggaagtaaatccctcctctacataagaatagcacaacaaaatgcatacagaaactaaaagaaaactctccagcagcagtttttatttttatttttaagttccggggtacatgtgcaggacgtgcaggtttgttacataggtaaacatgtgccatggtggtttgctgcacctatcaacccatcacctaggtattaagcccagcatgagtgcattagctacttttcctaatgctctccctcccccaaccccatcccccaatgggctccagtgtgtgttattcccctccctgtgcccatatgttctcattgttcagctcccacttgtaagagagaaaatgcggtgtttggttttctgttcctgcaatagtttgctcaggataatagcttccagctccattcatgtctgtacaaaagaaatgatctcattcctttttatggctgcatagtgttccatggtgtatatgtaccacattttctttattcagtctatcattgatgggcattcgggttgattccatgtctttgctattgtgaatagtgctgcaatgaacatatgtgtgcatgtatctttgtaatagaatgatttatattccactgttggtggaaatgcaaattagttcaaccattgtggaagacgatgcagtgattcctcaaaaatctagaaccagaaatagcatttgatgcagcaatcccattactgagtatatacccaaaggaatagaaatcattctggcagcagtttttaaataacttctatgaagagtaatgcaaagaccttaaaatggaattacctgaaataaaaaaataaaataattatagtttatttgttttaaaaggtaacaacctgtaaggtatgaggaagctgaggcaaagacacacacaaacacacacactcacacacacacacatttttttttgtagcgatggggttttgccatgttgcacaggccacataactggaatctgtggggctcaaaactatgtctgatggactccagtgcccaagctggcatgtcacttccctgtaaaggaataagcatgaatcttactttgtaccaatgacggggcaacacaatgcttttacatagtttataacccttttctttatcctattcccaagttctccacctgtacacacacacacacacacaaacacacacacacacagacacacacacacatctttttatcagtagtaatgtttaattatttatgcccatgctttccaatggctcattgtgaattagctcagcaagtttagagggacttcatacttatatagagctgtcctttttcttctagaaagaaaagggaaggacaagaagagtctgggctgcactgcagagctctctcatgccatttgaaaatactttactgttcacttgcttatctctcaatatgtctctctctctctctttcactcaaacacacacagacacacacagacacacacacactcacacaatcagtttgtcagttaattgcctgtggctaaagttaatgttctaacaaactaggtattaactgaagtaatgagtggtatcatctaagttatcaccattataaaccatatttaacagtttagaaaatcaataatattattaaacaaagtttagtgcttctggaagagttccttggcaaacagttgatttctgacagattgtgactaatttttctgcttcctgggaggtagagcatgttcttctgccttagtaactattaagagtttgtgcattttgaaaaaagtcacacacacacacacactatatatgtgtgtgtgtgtgtgtgtgtatatatatatttatgtttttatagagacagggttttgccatattgcccaggctggtcttgaacccctgggcttaaatgatctgcccaccttggcctcctaaaatgctggaattacaggcatgaaccactgcgcccggccacacacacacacatacgtgaaccatagtactacattttaacttctatcagtgaggctgcttatttatagatctataactgaggagaaggcaggcagtgggggtggcgacaatccaggcccgatgagtgttcttctttgatttctccacacacaaaccctttcattgccttgggataagtaaatgaaaagtagggagtagcgtgacatacttgagagttttctttaaatgcgagtttgccgtccccagcagtcaggaatggtactaatctggtggaaggactcttcatgctgtggctatatacttaaagttgctatttacaaatgtcatcttggagctgccagatagaggaatgcagattcacagaagacttagcggcagcaattccaagggaagatcatctgtgctctgtcaaaatatttcccttaactgagcttttggagactcaagttgtcggaaaataactgggaaatatttggtaggacaacaaatagaaaacaacaccattccgactgaacattcttgaaagaacgagtcatggcctgtatttaagagtgtgctattctaattgaaattttccatctcatacaccaagtcccttcattaagcacatccttataggtcttatcctttgtgcataaaatctcattttatgtttactttttccctcttcactactatatattctacagcaaaaagttgtaaacatgaatgcataagttattaatgcaccacaggagcaaaaatatggcaaattctttgtaaaaggataaaagtgacatagtataatgtagaattaagcacactccactgagagacaggacacctgctttcctcttttgaatttgtgactaaactattgggcaaccactggaaattgcaaacatccctgtacctaaagactctcatttgtagaatgaggaaattgaatgagatattgcttaatgtaccattatattctgtagtatactattatattccagcgattactgcacaactcctacatggtaaccatgatgctaaacattgtcctgtttcatttgatcctcatcacacccttgagatgtaggtgtcttcaacctcatttcactcctgcagagccaggccttggagagaataaggagagtgccattggtacagcctgaaagttgctaggctggtcctttgtattccgataaatgtactgtgctcctcacctgaacaaaaacgttattaatgggcacaggtacttcttgtcatccaagctgtccttctaggatcctgtatttcaagtacttgacagatgaacaaactatatgaatttgtcaaagcgttggagtacaagttgattaacagccacttccctgagctcctagcccttctttgttgttgctctagacaacaaccatcgcccccgccaccaccaccagataatccatccagcaactaggaaagaatgccggacacaatcttctaggactcgctccagtattagagcctttatccactctgcctggacacaacactgtactaccatttgtgaagtgctttaaatagtacccttgacattactatcatagccacccctcctttccttttacctgcaggcctcggacaagatgagctgacttctgccctaaaaagatgttttccaaagttcctcattgagggttaaagttgatttagaattgaggctaatttagctgagattttcaaaagcggcttctcaagctctttgcctgggctcggtttcattactctgactttgtatagggacctggttcccgatgatccctacttctctagaatgtcttcagctttgctggcccttctgtccatccttattgtcagtacttgcctgacacgtcctcctcccctgattaccagtttgcgagatgatctattccttttaaaacttgtacacattttatgccctgacctaagacctcttctgtccttcagcagaatttattccctcaaaaatgcatttggctggtttgaggcctcttgacttctattcaacccaaggctataggcttctggggagtttactaatgttatatctatctttctaccttaaaagtaacaaaggtgttttcttcttggctgctcaattttttactcctatcgttaccactctccattatacaaaatattttacttattgaccttattttgtagtaacatagaaggtaagctctattaaggtaggatttatttctatcttgttgactgatgggtttcaggtgcttgaaacaagacctagtataattaggttcttggaaaatatttgttgaaaggttgaataaatgtatggacccataccctagtgcctttctgcctttaaccattgtgttacaaaagttatctcctaataattttcatattatataaactaagaataaatagatcattgcataaaaccagaaaataatttggcagaaaatttttgccctagaatagacagagttgtgcttggtcagaagagtggtggagaattgatctgaatgggtaaattgtgtgagctgagtcggaggtggactagaggccagagtagctattgtcctaattactcagtgaacttcatgaaatttgtctgtaaataacatacttatcaccctcacagacctctctgcacaaatgctttcacatgaatttgagctctcatatccctttctaggaggattttatggatgtatttggcatgtctgctgcagtgtgaagctaatttaccttcaggaatatgttctcaatacaggccacagcaggcaggcttcaggtacaccccgttcactgccatatcagaggctgattgctgtgcagagagtttcatgaaaattattttattttgtatttctagatttgcccctgaaatagtttttatcattgtattgatgatcttaatcaaactacaacagaaattctgaaagtaattaggcttaagtaaaacatagatgcatacataccaccagccaaactcatgaataccagtaacaagcatttaccatggtcatttctgatattgaacattgattcaatgttgtgaaaagctgtatttttaaatgctttttttctaggatgttgatcactacccacaagccatgaccctcctccaggaaactaattcacccacagcctctcctgcctcaataggcacgttttgtaacctaaattcaagttcaggccatatcaaggtggacaggagaggacttctgactgaagactcattaatccatagacagccctatactttgtgatctgatagaagaattatgccaacccaattttctttctcaataatttgaacacaggcagggcgtggtggctcacacctgtaatcccagcactttgggaggctgatgggggaggatcacttgagcccaggagttcaagaccagcctgagcaacaaggcaaaatcctgtctttaccaaaaatacaaaaatcagccaggcatggtggcaggcgtgtgtagtaccagatactcaggaggctgaggcgggaggatggtttgaacctgggagacaatggttgcaatgaacaaggatcatgccattgcactccagcccgggtaacagagtcaaaccctgttcctgcccctgcgaaaaaaaaaaaaaaaaaatttgaatacaaagagtaaggaataatttaccaattggaactgcaggcagaagctgaaggaatgcagtgagaatataaaaagttaacatccaccgaatgcctaccatatgcctgacactatccagcatgttaaacaggctatcttttacatctccataacagctctatggcctaggcattgctcttaatttgcaggcccacagaaaataagttatttagttacttggctatgcattagctagtggggccaggattcaagcctaggtctatgtgatttcagaggctctcctcttaatcgttgtatggtactgattacaaaggaaagagactttgttcaagttcaggtggaggataacccatgagcatctagagaataccagttgtctgtgaagagaagtggaatggaatgaaatggaacagagcaaaggaaggatagctattgagaaaatatttcctaggagaaagaaggagggagaggctggtctcaagaactgctttagtttagtgtggtgttctgctgttagatttaatttcaaaccatctgtactcttgcacattacttgagaaattctttgtcctttgccaataaaataattttttaaaacttgtatgtactaatcagaaccataaaaatctattttaaagagagaacaaacacaattaagatgtgtgtgctacaagcgtcccattctttccttctgcttctgccttcatctgccagcctatttcccttgggaagattggtacagagatggacccaatgaagctagggccaggaggtctgatgttcatttctggtttgggagttccttcactgaatagtctccttacaatgaggaagacggtagccataacaaaatacctagagtccagtaaatgccagcttctctttcctccaatgccacatgtactatgcacttctgttgggaagccttggtcccaggggtcatgcaactgcagatgtgtgcttccccaaattgcattacccaggcagctctccattttaacaaccactcctggaccccagaatctaaggtatcaaggaaggtcttggataaactcttaacactcatgcgtctgctttatccgtggaataaaattctcacctcctaaattggagttttttctaaaaattcctcttttccatctttggatcccttcactttgttctttgccttcacttgccttcactttgctctttcaacaagtccgggtcaagttttaaactcatctcctggagtaccttcaaattctgtccctttgaaaattgcaaatgaagaaatgctctataaaggaaagaccagaatgacttaatcagtggttgaattgattctttcagttttacaaaaatctcagtaacctcacatcaattatatgacaatgcatttagtttgcaaaaagtgctatgataaattagatatctaaatatcagatgaaaccagggctttccgggatttccttagatatttcctgggctcgtgtatctggggaccatgtaggttggcttttcataaagaaaggtcaaaactgcaatggtttcctctgttacatagattatgaatgggatgattaatataacttcattggccaatccatcaaaagacattatttttaattaaaataataagtaggagacataaggatacaattccattttaaaatatacaagtaaaaccgttttttgtgagtttaaaaagcaggacactcgtgctggattctttatctaccatgagcatctattgtttttatctgttaaaaagtccagtttattgaggtataatttagatactgtagaatttaacattttcatgtgtagtttgatgagttttgataaatgtgtacagttatatacccaccaccataatcataatataaaacatttcccaaaagttccttcatgtcgctttatagtaaatgccttttccccatttccaggctctgtcaagcactgatctcttttttttttttttttttgcttttttcagagcgatgtcctaaaataggatcatatgttttgttaaccttttgttcctggtacccttcacttagcatcatgcagttgagatacttcatattgtcacctgtaccagtagtttgcttctttttaatgctcagtagtattccattgtccagaggtattgtaattagtttattcatttaccagttgaaagatatttgggttatttccatttttggctattatgatcaaagctgctatgaatatttttttatcagtttttgtgtaaacatgttttcataactcttgggaaaatacacaggggtgggtatttcttttattttcaagtaaatatacacacatataaaatgaggtatgaaaactgtaattatatatatataacatatattatatatacattataatatattatatattgtttaatattttatatattatatataatataagtaattctttcagatgagacaaattcatgtattaactggaaaccccaggttattacattaactaagtctttcattcgaatgagactgttttgtgtttaaggtttgatactttggtcctctctgaaaagtacctgagaaataattcacaaattttaatggaagctaagcctttcaaattcagcattttgtttttatttttatatttcagacaagatataatacttgttgactctatcagtagcctgttcatctttcaaaggttttgattttgaattttgcatttcatgattttgaaaaactttctaaaacaatacattttcaaaatttctgtatagaatgataaaaattaaccagtttttcttcattgtacacaaaactccttaagataaaatttgttgatagagtaaaagttataaatttagtttaattatcctttgctacagagttggaaagcaataaagggtggtaagaagttttaacagcaagcacagtagataactttagagaaaaacatcttacagtttttcttccttatctggaacccactagttgagtttggtccactcaatccacatgatcatgggacaaggtgagtccctgtctgccctcttggtagatcatgacctcacctctctgcctgtagtatttgaaccaggatgaatttctagactattttaggccaatcaaatgcttttccacagaaatctggactgacactgaactaaagctctttgtgtgagtatgtctgagtcatagatgctcaggggctgctgagacagctgtttttcctccatttaactgagaagaagaggatgctcatttgcaaggaggaatgaagcagacgtgcagagaaactgagacatgagatgcatgttccaatgacattcttagcactggttccactctagagtttctgatggttcctgaggcccaggacacagtcttcttgtgatctgtgaagcacttaaagagggaaattttagtttaacagggcttgatatgatttctatcacttaccatcaaagagtttctaactgctataaccagaagtttttcactactctccccctaaataattgtgggattagataagatgctcaaattctctgagttttggtgttttctgggattggtggataagaacacaggatttggagttagtcaaaactgacttcagatatggattctaccacttctcttttctgtgagttgggaaatgttgtttaactcaattgagcactcttttctccactataaaagagagataatagtaccttgaatttctgtgagattttaatgaggaaatacttgtaaaataattaggataattcctattgtgttgtaagggttcaataaatggtgatccttgttattacttataattctgtaattgtttcttccttcccttcccctttttcttctttctttccataaatattttattgttctatgtgctaaaacttatgttaaggatatttcatgttgttaaaggtaaaagacacattcccccaaagaactggaattctcactgggaaaggagattcataagtatagccaaggtgtcactttccaagtacagtaacagacatgtgtacaggggcattcacccacaagtcaggctaagaagagaggcagccaaggttcacatagccctttcacaatttcattgccaatgaagaaagtagatgtggcatacaagggcctacaggcaatggcatttcctgacttgaaagcctacgtgcagagtaagatctttatgaaaggcttcttgagatttggtgatttctacttgggcctctgaggccagacacactatgatggtgtcaagctcctgtaaagaagaaatagagtggtgggctactgaagtcactgacctagtctttcaaaaaatgacaaaattaccatatggtcaatggacaaatggtcttgataggcttcctctaataacctgtaaaactcacttaatgtttgctgctctaaaggcctgtattccaatgactgatgcctattacccaatatcagagagctctaatgcaacattcaaaaataacagcaccacaggttaaataaaaacatattcctctaaaagtccatcttgaactaaactgttccatttccttattcaagttagaaacagtggtgcattttgttggattttattttactttattttattatgatttaaatttaacttttaagtttggggtacatgtgcaggtttgttatatagataaacctgtgtcataggtgtttgttgtacagattatttcttcacccaggtattaagtctagtatccattagttacttttcctgatcctctaccacctcctaccctccatcctctgataggccccagtgtgtgttgttcccttctgtgtatccatgtgttctcatcatttagctcccacttacaagtgagaacatgtggtatttggttttcttttcctgtgttaatttgctaaggataatggcctccagttccatccatgttcctgcaaaggacatgatcttgttcttttttctggctgcataatatttcatggtgtatatgtaccacatttctgttatccagtctaccattgaggagcatgtaggttgattccacgtctttgttattgtgaatagtgctgcagtggacacatgcatacatgtgtctttataaaagaaagatttgtattcctttgggtatatgcctaataatggcattgctgggttggacagtaattctgtttttaggtctttgaggaattgccacaccctctctcacaatggttgaactaccattgtgtagtgtaactaatggttacactcctaccaacagtgtataagcatttgttttctctgcaacctcaccagcatctgttattttttgactttttaataatagccattctgactggtgtgagatggtatctcactgtggttttgatttgcatttctctaatgatcagtgatgttgaggtttttttttgtatgctttttggctgcatgtatgtcttcttttgagaagtgtctgttcatgtcctctgccccctttttaatgggattgtttttttcttataaacttaagttccttgtagatgccagatattagacttttgtcagatgggtagattgcaaatatttctcccattctgtaggttgtctgtttactctgatgatagtttcttttgctgtgtagaagctctttagtttaattaaatcgtatttgtctgtttttgcttttgttgcaaatgctgttggcatctttgtcatgaaatctttgcccttgcctctgtcctgatgatattgcctaggttttcttctagggtttttatagttttgggttttacatttaagtctttaatccatcttgagttgatttttgtatatggtgtaaggaagaggtccagtttcaattttctgcatatggctagccagttctcccaacaccatttattaaatagggaatcctctccacattgcttgtttttgtcagatttatagaagatcagatggttgtaggtgtgtggtcttatttctgagttctctattctgttccattggtctatgtgtctgttcttgtaccagtactatgctgttttttgggtactgtagccttgtagtaaagtttgaagtcaggtagcatgatgccttcagctttgttccttttgcttaggattttcttggttatttgggccctttgatggttccatatgaattttaaaatagttttttttttctaattctgtgaagaatttcagtggtactttaataggaatagcatggaatctataaattgctttgggcagtgtggccattttaatgatattggttcttcctatccatgagcacggaatgtttttccatttatttgtgtcatctctgatttgatttgtattctccttgcagagatatttcacttccttagttagctgtattcctaggtagtttattctttttgtggcaatttttggccaaagctaacagaagccggaaggcagaggagcctctgatgcacactgcaggcctcagcttcccagggcacagagaagagctgttggtagaactagggcagatggaacataaccccaacagtccccaagtcatgatttggttattctttttgcaaagtgtcaggctttagctgctgcttttttgtttgagtgtctttttttttttttttcatttaagcagtctttatttccacctctatttgcaaatgctccctagcaatcgactaatggagtagctcatttcacctatcagtcagtttctctacaatagctggcaaacattgctctttatgtggtagctggttgaactttataaattgtgtttagaaactagacccataatttttgaagataataaaattatatcagtaacatagctttggaagtccttttgaaatagatgatattagaaaaattaacttgggtagcacgtgtttagggttggtgaacttataataatggaagcattttagtatttggttgcttttttcctccaaagaatagacaaaacctaatcaaatgcttatgaaacaaatgccatgctataaaatttcataggttttatttgcttataacgaacctagtggagctgcttcagcaatgtgatggacgattttctgtacctaaattgtgggaccattgctctgattttccattttgttgctatccaagcagaatgcagaagggtacaatgagtctgcaatgccacatcacatgtatctttaggtctgatgttaaataaacccgagagtaaatatcaaatgaagaaagaatattacctataaactccatgttttaggatctgcgctctttatttcattcaattaatttctgatgtgaatttgttttgtaacactattacacaatatatttcctcaagctttgaaatgcactgtgtctttaagtctgtattttaaaaatttaacaaataatattaggtggcttctagatgcaagctctcccaaaggacctgcatggtatcacaggataagtggttctatctgtagtcagagatgaggacacagttgacatttagattctcatgagggttccccgggtgggtcatgctgtaaggtgctgcacagctgccaaattgaaaggcagggaatcagtacaagtgcacagtccatgaacatgaatttgagcaagctatacagcaagatccctgtgaaaggacagaaaacaaagggcatgtcatgaggtcatggtggagaaggggttcaaaggataaacctcgggtctcctattcctcactccccccaggagattgtgtcaacctcaagatgctgtggtcttggaccttgtacaagggaatacagaggagtccagggtggccgcattcgtgaataactagtgagtgaaaacagaggaggaaaaaggaggcgagtactttctacttaggtccttaacaattatgatccagtgggctgctgagatgtcatttaaccccactctagtcagggcagtaagcacaggtgattccagggcagatgtccccattcccaagtacctttcatgtaaaatatctccagccttcccttacggcttcttacccctcccttgctgtctgtataaagtcctgcattattctccagtaaggaagagtacttgaatgtttctactaacatgtaaagaagtcaacccacgtgggctcacagattagcatccgttcagatctggtacataggtggtttattgattagtgaggtcctcataccatctagacagaagaggacacaaggcagggtcgctacctttagaatgggaagaaggatatttcactcaggttcagagttgccaggagaataaagggcctaaccctcaagggatgggtggcatgttaggagaagggacagaggggatccttaactggatgtgtctccccagaacctcacttaggcctggctcttccatggtgatgtagctcatagggaaacagtccagcaggggtatctttctgaagcagagccagggcaaggcaaacaagccatatttaaccttgtctcttagccagtcacctgtagggatttcttacctctttgcttttaaatttcttttgattctgtttctctcgtgttcttttgtgatgaaatagccacgtgggacctgagcaacttggccctgaagtggcacctgctcatcttggattccactgtgaggagaagttatgaggcaaagcaaaacgtgagagaattgtccttacattggggtctttttaagaaatacatttggtgtatcctaagggaaaaggaacacatttgagcttcatgtctataactagactttcaagttatgatttgccatatattatttggtccttttatggtaaaacaaaaaattgtaatgtaaatattgtattttattaaaagttccctattaaagttaacagaataagaacgaactaattatttcactgaagttgctaagtgttggcattgtgcttggcacattcctgctatgatcttaggaaatgcagaattttagaagtatctaagttggtattggttggagatataaacatataatcattttatttacaactgtgatttaaaaatactaaccttcgcctgattttaaatgcaatttatttttctgttttgttatatatgtaattcttaaagttacttatttataaatcgaaagctaaaatttataatttactatctgtattttcagacccctgacacttcattaacttcttgattcataaacaatggaccaaaagtcccagttgatagatgcaaactcttctgctggatttatgtactctaaccaagagccttagtgtaaatcattgtcaagtttacaaatgttcctattagttagtgctttagctgtctgatttgaaaacacctgctctctttactgtccaattctgatatatctttttaatatacagcacattcttataatttgttactaccaagtactgatttataaggatgttgtaataaattttataacgtaaattttaaaggctttggattaggtacacaagatttttgaaagctttatggctgaaaaacaattcttagaagccagaagtaaattttatgtcaatatcctacaaaacaagcatggcatactcgacttaagaatatttgtattttcttcctatatcgtcttcccattccctgcattaagactttccttttcataaaagtctgtaccattgttggctggacctaagcagacatgcaaaggcaaacaagtattagtgtttaacctggacagattgatataattactgtgtactaagccccttgctgagttttggggagcctgaatggttttatcttggttctcccttccatctgtccttttcttctgctggggacacattgacacatatttggatttaaatccctgcttggggagctcagagcacttgttgagcagccttttaattacatatctgtaaagtaatttattgtttccctgtctgagggctgagggatttatgtttatcagctttatgctcttgcgtaccgatgactggactactggccagtcagggagattcactctatagaggattagggcaaggacttagggcattgagtaaaattaccattttagaataatatccttgaaggtgctatatacagtaaggggaaatggataattttcttctcattattatatcaaatttagcagatctgtgtggctcactttgttccttagattcatgtagttcatgtttgtattcttctccctctcagggtgggatgtattgttgcatggtgacatttactgcaaaggttttatcttaccaaattgctgacagctgcctaaagcaggcaattacaagcatatatttttttggatgaacgaccaaatagtacacagaagttattatcctgtagtctccacacagccctgaaatttatagaaatctaagagatttggggcagggaaaaatggcggatggaaaatttaccatttgatagttgagattgatcataaagcattttttaataaaacattatttaacaacacaaattttagaacaaagtaattctgttttgtttttttttgttgttttgttattttgttttagaacagatctgctttggagctatccctgaaccaggcattgggattggagttgggtacacggaggaactaagacaatgttctagaatatcaaaacatggtctgtgtcctcaagaacaagtcaaggtagtaaggccagtgatatggtttggctctgtgtccccaccgaaatcttatcttgtagctcccataattcccacgtgtggtgggaaggacccagtgggagatggttgaatcatgggggcgggcctttcccctgctgttcttgtaatggtgagtgagtctcacgaggtctgatggttttaaaaacgggagtttccctgcacaagctctctttttgcctgctcccatccatgtaagacatcacttgctcctccttgccctctgccatgactgtgaggcctccccatccatgtggagctgtaagtccattaaacctctttttcttttttttaattattatggatacataacagttgtgtatatttatggggtacatgtgaaattttgatacaagcatacaatgtttcattattaagtcagggtaactggggtattcattgcctcaactatttataatttctttgtgttagaaacattccaatcttttttttattatattttaagttctggggtacatgtgcagaatgtgcaggtttgttaaacctctttttcttcccagtctcggatatgtctttatcagcagcatgaaagcagactaatacagtgagattcaaactcaaagtagtaaataaacaacataagatttttcaccagattctccagggcttcagctaggtttccttgctgagtaggtttatgagccactgcaagtcatatcaaatttttagagccttagttaatccactttaagtagagaggatttgattaacattcattgagtatcttttattttccaggcactgtagaaactactagggattgagtgatcaatcatccatagtccaacttcacagaattaaagtccagaagagaaggcagaaatttctataactaataaagttacatatatgttacaaaagcctgaacaaatactgcagaagaggagaaaaacacctaaggttccttttaaccctttgctactagtgattttatgatagctgtttataaatccataagtgaaaaacattatacacataatattgcttattttatttattccacacacacaaaaatgacctttagtgcatagtaatctccttcccattgagacaatacttttgcagagacatattattgaactatgtagttgctacatagaattagtggtttcaaacaagagagtgaaaaataaaattgaataaaaattgaaatgaaaagaaaacaattatataggagggattatatttgttatatgtatatttttgcatgtaaaacaaatggcgatggtatgcatcactactatataaattggattttatcatgatggacaagaacactgctggcatggatgttacattttgaaatataaatgaatttggagcagtaaccatgccccctcccttttttttttgagatggagtctcactctgtggccaggctggagtgcagtggcatgatctctgctcactgcaacctccgcctagcggcttcaagcgattctcctgcctcagcctcccaagtagctgggactagaggcaagcaccacccctcccagctaatttttgtattttagtagagatggggtttcagcatgttggccaagatggtctctatctcttgaccttgtgatccgcccacctcagcctcccagagtgctgggattacaggtgtgagccactgtgcccagctgtttttcttttctttttttttttttaataggattttaggtggataataggaccatacagtgaggtctctaaagagcattaactgactaaaatgggtttccctattgaggaggtctcgtcattgaagattgggcatgtagagtgacatttgtgggcttcacaggcctctcttgtagctgtgttccctccttcttcatggaaaggtttgggattgccttgcctttctgatattgcctgacacaatattcctcagtgccttggggttgtagttgaattggattgattcctttaagcttgggtatgttccaaatttgcccacggctttgctatgaccaccacaggcttaaactaattataacatttaagaacataactcaggtcctcttccttccacgagagcaaatttaggaaccaaatgtttttcccaatgacagcttaactgaggtaaaaaaaacaagtttttttcaccttgaaaataggaaacttctaagtaaaaatgaaagaaaatggatttatacctaatgttttctttctggaccagcctttaattaaagccacagttacatatgggcattttaagtactcattttcttcatctccaatattataattttgcctttattcttcattcaatgcattcatttgacatgagatctttgaacaaaatcatgcaaatgtaaacatcaaaatataattaccaaaatgataaaaaaaattcagcaggtggataacctctttgaagaagagaaacaatcatagctaataaagctgccaagtagatatgagaaattcactgctttctgcaaatctaagaagagaatgggtagttttaattattcattacgctgatgctcagggaaaaataaattaaaagcctcttattttatgagaatttaattcaatttatatgctgtccttctctactacctttcccatgaggcttgttgaactatagatctttgtgaaaaatagctttctcccttccattagtgtttcttcctgccacaatcatctcatgtaccccatgactgcggtagtgacatcagacttattttaattcacagccatgtttctactaatgaaaagcaagataggcttaaaaacaatgacgtccaccttcagataagatgctagtggcacagacatatatgcttgggtttggatatgtcccgttcaacattttaataagtgagttgagttaattcatgaaaatgatatatatttattaaatgtgtggatgttacagaaatggaaaagtcagttaatatgataaatgatagaatcaagtgtcaaaaagatactgaaaaactgcaaattaggaaagtaacacatttatatgtaccttgagtctcacccttatctgactcagatgatacttagatacaactttggactttagagttgatactagaataagttaagacttttgagtcttttgggatggaataaatatattttacttgtgagaaggacatccatttcagggggctggggtggggaatgcaatggtctgaatgtttgtataccccaagaatgtatatgttgaaattttaacacccattaaaatgttattaggaggtgagacctttgggaagtaattagttcatgagagtacagccctcataaatgtattaatgccttataaaagggaccacagaaaactctctctccctattttcccaatgtgatcttataaagagaagatgacagtctgcaactcagaagaaggccttcaccagaacctgaccatgctgtcaccctgatcgtgaacttccagactccaaaactgtgagaaataaatttctgttgcttaagccctccagtttaaggtaatttgttatagcagctcaaactgactgagacattaatttaggataaaaaatcagttatatctataaacagattggggaaacctagataagtggtagtttatgttaaaacaataacaacaacagtaacaacagcagcacaaaattaaccagaagttttagttgacttcaagctcaatatgaatctctagtttcaagtccactgccataaaacttaattttggaaaatgtgatgaagctatatagcaaagttgcctttgggggataaaatacattctgaaaatgctccagtaggacgttcttgcattccttttgatgtatgggctcatggattgcacgtaccttttattttgtgtcaggaaaacccagtattgaatacaaaaatataagaaattagcactggaagttgtgattacatttttcttttccatagctcatttattgaaatgtctgactttactcatctgaaattgaaactaataacagatatcttcctgggcttgtgtaggcataaatttgatagtgaggacaaaattgcattaaaacctaaagtactattccatgttaattttaagtaatgtctttccacaggtatatcttatttggaggcatgtaagtatgttagcacacatagaaaaataggatttggacactcatgtactgttggagggaatataagttgacacaggggacttgtacatagctttcaaatttttaagtacaaatgttttaatcaagtagttccatttctctttgtctctcctatagaaatactcatatatgcacagatatatgtataaaaactctttttcagcagttttgtaatagtaagacgttggaaaaaattttaaagtatattaatagggaaatggctcagaatttgtagtaaattatagaatataaatactatgagatactatgtagtggcaaaaaaggaatgaggtatactgataaggaaagatatccatcaaaaaagcatgtcaaaaaatatataaaaaatggatcaaatgtatgtaaaaattaaccttcgtgaatgtgaagagtgcacaaatatatttgcgtatgtgtatagacacacacttacatatgtaagatccgtatctacagatctctcacatttgttctggactgtcttttcaaggatgtgtgtatggcaaacagcctcggaagacagaaatagtatctctctatgggataggaggcagagggcagatttgtttgctgcccaggataacaattttttatcccaagggcaaatgtgggtcaggttctccagaagtccccttcaaaagattgcagtttccttaagccagggttgctcatggacacaggtgttactttttgctgcctctgtgaatatgtgtgtggggtgggtgtagcaattaattgttccatctgaggtgataaagggtaaatcctgaaatactagcagtacatgaacaactactgtgaatttacctgtgtgcatccagagggcagagctagaggcaatcattgaggagaagttacaaaggaaaaggaggcagaatttgcatcaataaaaggagaaatttccaaatacttaaagaaacaacctcacacgtggtaaaatggccgttataaaaaagaagaaagataacaagtgttgatgaggatgtgcagaaaagtgaatccttatgcactcttgctgggaatgcaaactgatacattcactatggaaaacactatggtggatccccagaaagttaaaactagaactaccatatgttgtgcaattccacttctggttgtatatctcaaggaaatgaaatgagtatgtggaagagatatctgcactcccatgttcactgcagcaatattcagaatagacaggatatgggatcaattgaagtgcccatgaagggataaatggatatagaaaatatgatatatatacacagtggaatagtatttagccttataaaagaaggaaatcttgtcatttgagacaacctggatgaacctcaaagacatgtatattaagtaaaaaaaagccagacacagaaagacaaatattgcatgtcttacttgtatgtggaatctaaaaaagttgaactcatagaagcagaaagcagactggttacgaggagctgggggttgggagtgaggggaattgggtagatgttggtcgaaagatacacaattttagttagacagcaggagtaagttcaagggatgtattgtacaacatagtaactatagttaataacaatgtattacatacttggaaatttctgagtgtagatttctcaccctttatagtattctcaccatgaaaataataaatatgtgatgtaatatatatatatatatattaattagatcgactttgccattccacagtgtatacatatttcaaaacatcatgttgtacaccataaatatatataatttttatttgacaaataaaaaataaacaaaaataaaaatagaaatatataggtaaatttctctttagtaaattattattgctcaccttaaggttccttttcctcattattgttgcatcattaaagagttatgatcctcatctagtgggttaatccttattggatttaatattctaagtacttaaggagtctgatttaacaaatttgatccttgtctcttttccctatgctctcttcccccatccctgccatatggcttgacttcatttgggcagttatgtttcctccattcatgtatctttccttattcatagaattaggatctaaaggccagaatttaatttgaaaattgggtgcaatcgcatgttctcactcataggtgggaattgaacaatgagaacacttggacacaggaaggggaacatcacacaccggcgcctgtcgtggggtggggggagggggcagggatagcattaggagatatacctgatgtaaatgaccagtcgatgggtgctgcacaccaacatggcacatgtatgcatatgtaacaaacctgcacgttgtgcatatgtaccctagaacttaaagtataaaaaaacaaaaaaggttagaaaagatggagacacatgagaggctaaaaagcctatatttaagccagcaagcaaaaatgtatgtaaaggtgcctcataaacactgcaaataaatccagttgaactcgaaaaaaaaaattgggtgccatctttctgctaattgaaatactgacggctgcactgggtctgctttgattttgggctgtaagtatttggtcctctagaccaagggattatggaatctaccaaatggtcctgctcacctctattttgaggtttagggctaaagcccccattgaaaaaaagaaaaggatgtctttctcttctgtacctcttaatatacaccacccctgcccccttagggaggcaacagggaagatcttgctgggccaggaaagattgaagtaattctggattcctggtccagcaccactgtaacatcgttctctaacagaactgcagtgatttctgttccccaacagatattggcaggactatcaattgcagcagtccccaacctttttggcacgagggactggtttcatggaagacaatttttccacagatagtgggggtgggagggaagaaactgttccacctcagatcatcaggcattagattcttataaggagtgtgcaacctagattccttacatgcacaattcacaatagggttcccgcgcctatgacaagctaatgctgccactcatctggcaggaagtgaagctcaggctgtaatgctcactcgcccgctgctcacttcctgctgtgcatctcggtttctaacaggccatggactggtaccagtccgtggcctgagagttggggacccttgatcttttggaccagagtggttacaatagatgacttgtatgaagtttccataatgcattccttttgtataagaattgcttctatctatatgtatcttgtaacatcgtatttgtaccttaaataaactcaataaaattatttgaaaaattacttattgtattctctccatatagcatagatattagtataattcagattgtaaaatggaggaaggaataaaaatgtaaatgattatctgcgaaaacagcacatcttaaaatgtagtttgttaggtgtcagtgctttacaaacaaaattacaactaaatataagtgtcagaggagcctgaaaagacaaatatcaagcaaatctcaaacatgtttcaaaacagttttgccacaatcatagcagcctaatgtccattgtattaaaaataccttaattcatctcccttctatgattttccatccttcccttttcacatgtaaaaggcagccataatttttgcatgtttcttacagtaattttattggagttttctaacctttaccattggcatatttatcttcctttcgggcctggttctactttatagaaacaccatgctattgaaatctccagacagggactgtggggtttgacctctcatcctcatgcattgttaatagaacttccatcccttttgttaacactttgaaaatgccaaacaataatttacagctcctcactcctgcagggcctttgtaaagaaatctcacagatggtatgaagaactcttagacagtgcatgcagggctacggattgcaggaatgtcttggagcctttgtgcactcaggacgaggcatgaaccatcaatgaagaaagggaaaaaagaaaacaataatagaacccaaacttgtagcctgtaccctagaatgcttatgaacgaagctgtcaaagaaccgtaccctgtatttatggagtgtgatgtttaattggaactgaataaatcatatattaaatagatatattgaagaaaaaataggaccatagatacacatgcacacatacatacacaccacatacattacaaataatttaatttaatacatgcatgcattgtttatttttagagatggttttcaaaacacaacatattctagggaaagggtcagcaaattttttctaaaaaggaacagatagtatgtgttttcggttttctaggccacatccaatctcggtgtcaatgactactcatttctattgttgtagtacaaaaacagccctaaacaatatgtaaatgaatgtgtgtagctgtgttacaatagcactgcatttatcagcgctgacatttgaatgtcacataattttaatgtcatattattccttttattttgttcaatcatttaaaaatgtaaaagcttttatttgcttgcaaactatacaaaaacaagtggtgaactgtatttggctcatgggtgacatctgcttcaaaggatcaatatctgtgggataaaataaaaggttatgatgtctaaaatttgaaagtatgttagatttgagaatatctcttaatacttaacataattgagtaactttcatggacatgactatttgaaagtgctaagataatcacaaattagttctgtcctctctgtgtttcctctgcagttgttatataggaaatttcctgtcctctgaaaagttatcagcaaatttgactgtgtttttttttgtaaattatcttgtactggacagccaccatctccatttgaaatttaataatgtgtaatgaaagtaattactaaaaatggctatcaaatctaaattaccaaatgaagctaataacaaagaaactgatatactgttcttactgtatacgtgtcatcacactcaatctttcatttttttcatttaaaattttattttaggttcaggagtacatgtgcaggttttttatacaggtaaacctgtgtcacagggacttgtacagattatttcatgacccaggtactaaacctagtatccaatagtgatttttttctgctcctctccctcctcccaccctccatcttcaaataggccccagtgttttttgttcccctcttggtgtccatgtgttgtcatcatttagctcctacttataagtgagaacatgtggatttgtttatctgttcctgcattagtttgctaaggataatggcctcgagctccatccatctgtgttcctgcaaagaacagcatctcattgctttttatggttgcatagtattccacggtgtatatgtaccacattttctttatataatctgccattaatgggcatcgaggttaattccatgtgtttgctgttgtgaatagtgcagcaatgaacatatctgtgtatgtgtctttatggtagaacgatttatgtaccgaaaggtatataaatcccagtaatgggattgctaggtcaaatgttagttctgtttttaactctttgaggaatcaccacactgctttctataatgattgaactaatctacactcccaccaacagtgtaaaagccttcccttttctctgcaacctcacaagcatctattattttttgactttttaataatagccattataactggtatgagatgatatctcattgtgtttttcatttgcatttctctaatgattagtgatgttgaatattttttatatgcttgttggccacatgtatgccttcttttggaaaatgtctgtttatgtcctctgcccactttttaatggggttatttgtctttttcttgtaaatttgtttgttccttatagatgctggatattagacctttgtcagatgcatagtttgcaagtattttctcccattctgtaggttgtctgctcactctgctgataatttcttttgctgtgcagaagctcttaagtttaaatatatcatatttgtcaatttttgcttttgctgcaattgcatgtttgtcatgaaatctttgctgttcctgtgtccagaatggtattgcctaggttgtcttccagggtttttatagtttttggttttatatttaagtctttaatgtatcttgagttggtttttgtacatgacattccatttaattatagagcttcagccaaagttttcttcaccacaattatttcgttgctgatgaagtctgatttcattgttttaacgtccaaacaaacattggtagaatcttaaggtatatatatatatatcacatacaattaatatattatgttaatctagccccctaaatacaagaaagataagggcttgaaataaatcaatggctgaaagagaaaacaagaaaatgtaaaataaacatataagttgtcatgccatatttatataaagtgtttatattcattattcctatgtttctttcttactttttccatgtttctttctttcattttccaccatcgtatttgtattagttatccactgcttcataataaattaccgcaaacttaatggcttaaaacaatctacatttattacctcacagtttttgtgggtcaagagttcaggtccagctgaactgggttttctgctcagagtcttacaaagctgtaatcaaggcattagctgcctatagtctcatctagagctaggtgtaatcttccaaactcatgtggttgttggtttctttctttgtggttccttgtgattgcaggactgaggttcttgctttcctgcaggctgttggcctgggagtaggtggtcactctcagctcttagaaatccccacagttcttgctaaatggtcctatcatggcatagcaacttacttcttcaaggccagcaggaggctctctcttgcttggatctgttaagagaaagttttataaattgtgacataatcaggggagtgagtactccattacctttgccataatttattggctagaagcaagtcacaggttccagctgacctcaagaggaggggattatacaaaggcatgactcattgggggtcgccttaagatatgtccactacaatactactaatatggatccagaatgaattgactcaaatattagccatgtaagaataatattgggatatgttcttggagagtatttatcatactgttctaaaattcaatctgtaaatatttctcaagagacatccaattagaatgcaaaatcatcgatcagggtttctcaggctggaaactgttgatattttggctgaatattctttgttgtgggagttggcctatgaattgtagggtgttttgtagtggcactgatatagccactggatgctagtagcaccccctcctcaagttgtgacgataaaaaaatgtctgcagacattgtcatacatcttccctggggtggagattaaatcaccatcagttaagaaccaccaccacagataatttcagtctttaaattttaatactaacctgaggcagtcttaccattattaaaccttaacatgttcaccttacagtggtccttagagtgttttcatggaacaagagagaaataaatgatttgggaatatattttgaagatttatgaaagtgtggaggaaggtggaatctaggaaggacctatttctggcctggataactttataaaaggtggaaccattgtattagtccattctcacactgccataaagatctacctgagaatggataagttatgaagaagagaagtttaattgactcgcagttatgcaggaggtacaggaaccatggttggggaggcctcaggaaacttacaatcatggcagaaggcaagggagaagcaaggcatttcttcccatggcaggagaaggagaaagagagtgatggaggaagtgctacatgctttaaaacaaccagatctcctgagaactgtatcacaagacaacactagggggatgttgctaaaccattagaaaccacccccatgatccaatcacctcctgtcagttcactcccccaacactggtgattacaattcaacatgagatttgggtgaggacacgaagccaaaccatatcaaccatgaatagaaaaatagaatacaggaagaggtgcaggtgttaggggtgtatagtgaagaagaaaaacaacatgctgactgtgagttttttaatggaatatccaagtggatgtatgaaacaaataatcgaatatataaatctaaaactctggggtgatattagaaccaagggcgattggcaagtagatggtagttacaaggaagaaagagatgaataaaattactgaggcacagcacgtagataaaacagagcaatgatttgggtagaggccttggaatatgaaagatagagatagaaaaacaagttaattataaacttcaaaaaggaacagacagagttaggattagaaacaggggaaaagaggataataacatgacactgaaggtaattgatagtttaaccaaagaaatgtgatgattggtgccaaataaagcatcaaagtccaggaagatatctattgaatttgacaatattaaatcagttttttagatttttcagtggaagtctggaggtttatccttcaaagcctgctttagtctccttattcaatgataacttatttcagtcaggccaggtcatactgattttctcttacatagatgtccgaaggacctcgctatgcaataatattattcaagtttgcattttatcatggtattttcaaatattttggctttaggtacaaagatctctccaaagggatgcataactctcttttctcaacccttgttctgtttttttttttacagagacctcatgaaggggatcttgtttaaagctttcttaaaaccttagttgtgaagggttgagaatgaaccaaagtctaagaatgttgacttctaaagaacactactgatttccaattcagtgttctttattcttggctatatgtctatctacatatcttggttaagtatttagattttaatagtttatataagagttaccatgtgttgtattggggtatttataaggaaacagtgtgtgcttctagaaacttattcttttgcaactgaatttttaaaaatccagtaatttaattgaataaattattcacgctcattgcagcgatactatcaggaagtctaagatgaattctgtagtctttccttcccttagactctaattccaatcctgtaatgtaattgttgtttgtaatttagtgtgatttctttcatccctttttcttttttatgcacatgtataaaatcaaatatacccttatatggttggggattaaaagcagttttactgaattagaatgacatgtggagaaatgggaaaacttgcacaccattggtgggggtgtaaattagtacagtcattatggaaaactgtatggaggttcctcaaaagactaaaaatagaattaccatatgatccagcaatcccacttttgggtattgacccaaaagatttgaaattgatatgtcaaatagatgcctgcatttccatgttcattgtggcactattcacaatagccaacttgtagaatcaacttagtttccatcaactaatgaatggataaataatatgtggtatatatacatgatgaaatactattcaactgtaaaatagaagcaaatactgtcatttgcagcaacatgcatgaacctggaggacattatgctaagtgaaataagccaggcaccgaaaaacaaataccacatgttcttactatgtggactgtgaaacaatctcaaagtagcagagaattgaataatggttacagaagctggaaagagggaggaatggagatatgataggcaaaggacagaaaacctcaatgagaatggaagaatcaatttattttctttactttgagatatattgcacagcatggttaatatactaataataatgtgttgtatatttcaaaatcactgagtaaatttccaaatttctcaccacaaaaagataagtatttgaagatagatatgttagttaaattattccacaatgtattcataaatcacagcataattttgtatctcataaatatatgaaactataatttgtcaatttataattaaaatataaaaagtttaaagattaaaaaaattagaatgacaaaatatataaaaaattttgtaatttgatattttaaaaatttaattccatgttaaggacatcccttctcaagtcagtacacctggatataccacattcaatataagcgtggtatttcagagtagtagatttattaattattaacttagttgcttattcatttagtcacgtattcattaatttagtcactcattcactgatgcatattcatgctgttttcaagttattataaacaatgctttaataatgaacatttatattttatatgggcacattcaactaaaagtgttttgtatatttaaaatgccattaaattgttggagtcctttcccactttccctgatatagcttttcttcttctcttctttcactttccgaaaactactttttaattggcttctaggtagcttttacagtcccttagttcagtcaaccaccaatcacatcagattttaagggttgagttttgggataagatttttttttttaattatttgttgctaagtattctccgtcatttaccttcctctctgtgttacgggattgtttgggttttgttttttgttgttgttgttgttgttgttgtttggtttttgtttttgtttttgccttgccacatccttatggtgccactagcttgggatccaagcaacaaagacttttcatctattgcagctaaaaaatggtatgtgattggtaactctagcattaatgtcaaagctgagcatagatggcctgtaactgaaaaactcatttaggtataataaaatccactctttttacttgattgtagttactgtttttccagtgattatagattgctttggaaaatacaaatacttggctaatggttttattctgctacaattttcctcatcctctttttatcttcttaaaaatccttccttcttattctccatcaggttttaggatgctgatgagcctagctaagatggtgagagattagaatactagaaaaataagggcccaggaaattgagaacattacttaaagaattcctactcagcagaaatgctccctatgcctctgaatccactctcactatattgaaattcttgatgtaatcaaatattcaaaactggaaaatctataagaattttcagcataacaaataccattgatttccatctattttatttcatgccgcatcattgctaagaataacttgttcctcatgtattttaaaataccagattttctatagaacataggaagaattgaattacatgatatttttctctttaataattgtgcaatgtacaaagatcaagaggatgagaattgggcttttgtcagggtctgctacttactagccatgtgatctcggtcaaaccatttaatttctttgggccttggtttcttaatataaggggaaagcaaatagattctccaaagaatttctaattccaaaattgtatgatccttcaattccattgaggatagaatctcattaaacttggaccagtggagtcccttgaaatgaaaatgtcttggtatgattgccattgtaatgtgtaaatgttctgaaattaaatcaataaagtgtaatccttactgctcttttttatgcatggttttattgtgtgatgttaaacagctactgcattctattatggctgtagtccttcagttctggttgaaataactcctatgtatatactgagaaacaaggctaatgcatgattcagcacctttataaatcaaagattctattacaggcggaaaatagcccaacaaaagctattctattacatttcaataccatagaaaagaagagactatatcaagtggcaaacataagtcctctctttttattttgcaatgcaataaaaaggctatgtaggatttagtagtttcttctgtcccgtggttactacattaacacttacattgaatgatattatttaaaagtccatttttttttcagaatgtcaattatcttccaagctttggtaaagagatggactctgcagagtaaagaggattatttttttcaatctagttcaattggagttttatttcctgatggctaaccaggaacagcttcacaaaacctacattaggagaacaatccacatatataggttttgaacaatatgcacacatatatatgttcgtatttgtatataagtacacattgaatatacaaatatatacatttgtacttatatataaagtgaattgatttgataaaacaattatattaaatataaatctaggtgcaaaattttcttaaagtttttattgttgtgtagtccatccccactcctccaggtataaccctaaagttccaggcttatattttattgataaagaggaattagacatttgttctgaatatttcctctaccatttcaagaagacaagctcggaatagtcattatagctgccatttagaaatcaataacaattacagttcccatatatagtacgttgagtaattcacttcaccccagtcccttttggcctggaacttcaaacttgcaaaatttatttggcataggcaaccaattaactttagaagaggcatgatattaataaattatttaatgcataaagccccttaattacatattagaatactacatactagatagcagcaactatggaaaatatgtgataataatcctactctatagaatttcaaaatttatatgataaaacagaaatgacaatcttgtggaaacttcaaacttacaaaatttatttggcataggcaaccaattaattttagaagaggcatgatactaaataatttaatacattaagccccttaattacacattagaatactacataccagtatttcaaaatttagaagataaaatagaaacgataatcttgtggaaatttttagggaatgggaaggtttgagaataagggagtgggtgatggagaaggagagatggcggtaaaataggtattttcaaaaccataacccccagcaggccataaatctggttactttgattttctcattataattattcagtttgaatgaagctacctttcttccaccattttagataataacttaagtgaggaagcagtgtttccttaagaacttggtggattatatctactccctaaagatataaacttgtgtcctaccataatttttcttctcatttgcagttagcattcgtgaatacagaaactatttcttattttccctgaacagcaggaaatacatgatcaacttctgatcttattctaaaacagttaaataatacactaatgttatcttagaaagtagaatttaaacaagtgccctatcatcacaaaaacattcttgcatagtaataggttaaaataatgcatttggccaatagaacctatactgttaggagttacataaattaacttgacacattaaagtaatccccaagtatctaattctaataatatttcatgatatggatacagaatactttaataattcaaaactagaattgaattactctattatttgtttagtgagataaatctgttatttctgagatccaaagaaataacacattaatacaccctcagtgaagtaaaatcaatcctacaggtcattgcttgactttgtgggttaaaattgctttcaacatcttattattagcactgttgtactggaggcttctaactccattatcatggaggcagaatttcacttcttataatggcgtgctacctttaaaaatgcaaagttttaagtacaggatgctttgagtgtacttgatttttttctaaattaaaagagattggatttattgtcaataacttgtcacacaggcaaactttcaaatttacaagtattgaaaaatgctagaatgctagaagaatagataagtaaatgaattactggcacatttaagaatgcttttgaaatagatggttgtgtgttatggtttgaatgtcctctcaaaaactcatgctgaaatttaattgccattgtatcagtgttgagaagtgggacctttaagaggtgattaggtcatcagggctctgccctaatgaatggattaaagccattatcaagagagtgggttagttatcgtaggagcaggctcctgatgaaaaagtttggctccctttctccctctgtcttacatgctctcttgcaagtctgccttccaccatgggatgttgaacacaaaggccctcactgatgtgggccccttgaccttggacttcccagccgccagaactgtaagaaatgcatttctttctaaaataaattaccctgtctgcggtattatgttagaacaacacaaaatggactgtgatgctgtgtttattgttggcgcattttaccttctttatcaccttcttaatttagatctctctcaagctgaagaagactagatgagagaatcaacttctgtcattttattttactgccaaatccacactgtgatttttttccacatgctgcttccaaatgtcataagattataagctgtttgtttttactcgagtttaagtggctttgcatatgagaaatgaataggattatgtgtgtgcatacctggtgtatatctaagggaaccaatactaaaaatatcctgccaatcaacaggtttaaaaatctaataaaaatgttttcaatgtagcgcagtcctttgctgcagacttgagcaaacatctagttacctctatttcttcattcttttttattttcatatgagaaaaatgagtttgtctttaatttgctttttatttatgtgtgcactaaaccaaaaaactacgatagagtttatacattctggaactgacaaaatagagttatcagctctaaacaatgcttatatattgtcctaactatgtatcaacagagtaataaagtttatatattattcttgaaatagaatctctcagagttgtacttgatttttatccaaaataatgccatcactccttattattctttaactaaatatgttcatttgaatagaagagctgaataaattactttgtttaaagagggcatttcattttaattaaggaaacaaattactgatccttctcagaaatttttggctgaaccttagggagtagtttatgtaaaatttacaaaggaaaaaatagaaggatatgtttggcttatatgtaactttcttatttcaatttatgttttccaatttaggaaatttgtatttaaattgcttctgccctgcacaaagttgaaaaaagtatttgaaattatctaatgggtttgtgtttagacaatcttaaaaaaagtaagatgttggccagccacagtggctcacgcctataatcccagcactccgggaggccgaggcaggtgaatcacctgaggtcggaagtttgagaccagcctgaccgacatggaaaaaccccatctctactaaaaatacaaaaaattagtcaggcgtggtggcacatgcctgtaatcccagctactcagaaggctgaggcaggaaaatcgcttgaacctgggaggcagaggttgtggtgagccaagattgcgccattgcactccagcttgggcaacaagagcgaaactccgtctcaaacaaacaaacaaacaaacaaaaagtaagatgctaatgtttcctctcaggaagagataatagctgataccaagttgtgatcccctacggacagttaagaaactgagataagggaggaagaagcagccagcaggaacactgagaaaagattgcattagaagtcttagtatccactggtcatgaagaaaattctatggtgcctaaactttataacaaatgtcaattaggaatttcaaaatcagctatttccagtgcactttgtgtatctgcatctatcagtgattttaatttaacctctttgaattccaaacttctttacactttctgtaccttatcttccatagaactggtatctatccaaggctgttgcatatggttgttaaaactgctcaccatacagttgccaaatccctataccctgatgctgggctgtatccacaaggatgcgcagagaggtgttgtgtgcaccagcagttttctgactctatctcaaggataattgcttcctctgtaacccgcctccttcaatggacagtgaacaatgtccacgcttctggtctcatggttacttatgaaagaacatttcagaaatctcaagctcccaagtctgcctccaaataaggtgaccatatagtccgttttgcctgggacagtcctggtttgcacctgttgctgttatataattactcacaatgctcctttttgctacctgtgatagcctgaaaaaaaagttatccacatattaatccttggaacttgtgaacgttaacttacatgcagggggaccaaagtctttgcagatgtgattaggtgaaccactttgagatgggaaggataatcctgattatctgagtaatccctattactgagtattcttaatctcatgtaccctcaatacagaggcagaaaaaaaatttgacagacacaaaggaggagaaagtgatgtgatcatggaggcagagattggagttatgcagccacatgacaaggaatgttggcaactatcagaaactggaaagatgcaaggattagagtctcttttagactctggagggagcatggcctagctggcaccttggtttcagcacagtgaaactgatgtaggacttctggcctccagaactgtgagagaacaaatttatgttattttaagcaaaccaagtttggtaatttgttacagcagccacagggaatgaaaacattgtgaaaagttttccattttgaaagataaataatatgctaattctacctccaaactgtgtcaattataaagatcctttctttgaggaccatgacattgggctaaaggactatcaacttcttattgtaattgatcaatctcctagttgtcctaatttattctctgaggtttcagctcccctgaccataatcttagccaggttcagtatgccattggttgatatgtcaggcaccctgcctttgtacttccctgtctttcttaaattcagccattttgtctattgaaattgatatctcattcaagatttgtcagtgctcatgactgctctgtttcttaaattcaaattccccaccatttcaatgcaatatcttaccttcttatacactcagacaagtgcaattatcttcaaccatatagaaaccccagctactgattgctctgctttcttccaagatataagcctgctcattacctttctctctcctcttagctacctctgttgattacctgcactatatgcgaataattttctcaacaactttaaactattgtctttttaccacaccaaactgacaaaatcttatctctataaacaatacaatactcttctcttaccactcctatattgtttactaaacccggttgcagaaaaatagcataaccctatggacaggataaattcatattctcgaatgcatttgcaaccagagtagaaccaggagtatttttgtttctttttggactatattatttctcattgctctcagctagtggacaatttatttgctgtccttacatctcattctaccatttctctccactctcagctgatgaatataacatctgttttatcaataaatggtcatgctcagatatgatttttctcaacgattggcttccaattacccatagcctgcattaatattaatttttacctcctttcagctactcttggaggaaaaagtgttagccctctacttgtgctcttgatgtcattttctcctgtatccttgagtttcatctctcatctttcaaaaatgttccccatttctccagcttcctatttcttcttttcagtctgtaaacacacccacataggcacagaaatatattcaaatagtctttgaccctcaaatccttcctatatacttacaccaaagagttttcacttttctttgttctaagaaaatatttttaattatattacattacattatatataatacattgcacccatatatattccaatagctcattatgacttattacaaaaacacttcactcctacccccgagtttcactcctctgaagtaatcagtttcaactctgtcaaaaatacaatcatcagatcaaattttaaaaaaaattttaaagttttttgtgcgtagaaaaggacagtttgcaaaccaggactcctcaaaccaagagcagtaagaagcccacttcacagcacagtttataaaacataaaggatgaagtattttggcctttttcatgattggctgttatatgttaacattctttttagcaaacaaagctgattaagctgatttctctatagctgattagcttcatttcactgaatcatgctgatgaggatgtaaaactgttttggatttaagattaaggatagtgttttaggaagttcaggatgatttaaattttggttaagtaactatgggccttaaagtatatttaaactgtgggtttaaagcttttagctttagctccccgttctatgccctgggaggatgacttctatggactggatcagcaggtttcccttgaactttggcttttaatttcactttggcagtgacaggtattggcaggaaatcaaagggcagaagcagagagaggtcaggtatatattcctgctccctgatgatccttccctatcagattacagtttaatggtcattgtgttcccctacctatggccccatctcttgttcagtgattctttcccacagttggaggtctttctagttccattaacacggctccaccctttgcctccttttaagggatgggaaaaacttcccactattgttagttcctgggtgcatctccatttttaatgcattcctcagccctgccctccactctaaaaatagcctcttcattaaattctcttcaactactttgaataagatgttttctgcagagaccatgattaaggactatttcactctcattgcttactcacacacttaccctctttctcccatcctctcagtgtggttatgtatcagttagactacaaccagaaaaaaaaaaaaaaaagaaactaaaaaaattcttgaaacatttaaacagatggaatttaagagaattggctcttcacttgatggtaacagtttgggcaacacagattaatatcagcagaaagcagttaccactcctaggctagaggtactagggtggttttactggcctccagagcccaaggtcacttggtaaatgttggaaccacaagaacaattgtctggaagggctactggagcaaaggagatgcaaactttgctagaaaagccagctgaagcatagaggaagaagaagaaacctggattccctctacttcatgccctccagtctcccttaggtgcctccctctggctgaacctacatggaagccagaggagaagaaaacttggaaatatatgtgcaggagtcatcactctgagatatagaaaaaaaagtccaagggaaattctggggtatttcaattcttttatgtaggcaaccattcaatccagggtaaaagccaaagctcaagtaagtgtacctatgtggataaattttacctgatgtttacccttatgttctattctccttggtccagcaaacttcaaatccattcccagaatatgttctgatttcttacctatacgattagtaagaacttgcaactacattggataaaagtgctagctccttcccagatcttgaaattctcccctgaataatactaggacctgactcttaagggcaacgtggaggcaatatgaatggtggagtttggtcttgaggagctgtctttcttttgcaagacagctgtctctgagaggtcattaaatgttcctttttatttttttcaaaagcagctttatttttaatagcccaaacctgaagacaacccaaaagtccatagaaacttacggataaacaattgtggtatatccacacagtgaaatattactcagcaataaaaagaaatatctactgatattcttaactttgattgaactctacaaaaaggatgcttactgaaagatggtagacaaaaaataagcgctcactgtatgattacatttgtataaaattctaagaaatgcaaagtaatgtgtggtgataaaaaacaaatcagtggttgtatgcagatgagagatcaaggagggacaaaacaaagagattattaaaggcataagaaaacttctgggggtgatacggtcattaccttaattgtgacaatggtatcataggtatatatatgtgtcaaaatttaacaaattttacaatttaaatatgtgcagtttattgtattccaattatacaccaataaagctgttatggctacccataaaaatctgaatcttccatttctcttggaacatcaaccaaccctatattaactcaactatttcccatttcctatataatgggagggtcatctctgcctcggtttagaaactgcagagcaatgaaggccacatccacctgaactctagatgggtcacacaatacccatccctggactgcaaaatgtctcaaactgtatcaatatgaaggttcttacttattagttttatttattttttaaaagtttttaaaaattttttttaaaaaatttatattcattttattttatactttgaatttttttaattttagatttttaaaatattttgaatttttttaattaaacaaaaaactattttatttttagagacgtgggtctcattatgaggcccagactggcctggaactcctgggctcccacctcagcctccccagtagctgagactacaggcatgtgccactgcacccagcttagttttatttttggaaagatgttttatctaaataagatgtaatcaaacatatttcaggatttctaactgaaacaatatttaccagagtcatccttactaagcattaaggcttaaaattttaaaaggtagaaaaacagactgtgtatatttaacctttataagtttgaatgtcaggaaagatgacaacattctacatagtacaagaaatgtatcaactatatttaccccgtagtccctataggtcttatcttcctgccagattttggacttcaggaactgtgacttctgggtaggtcttaggagacagctacacttcaatagtgttggaggatgttaaccatcccctggggaaaagggactaaactcatgttgtccccagatgtactgtaggttgtcataaaaactctctctttattgggggtgaacttagggctcttaagaggtagccatgtaacaagattagctccacaaagctctatagtttttcctaaaagggcttgggcagcattgccaactaggtcaaattagactgtgagctgttctctctaaagcacataaagtttggagcccccgtaaaagatgttcctcccttcatgctggcaaagcctgattcttttctcaatcagtcccacacagtgaacacaaaagaggaaagccttaatcaataaggtaaaaatcgttgtacaagtcattgcacaaatcagattagttaggttaggaagttccaaggcttagtgatttggaggctggagaaatctatctcagctatcacatagagagtcaatattttccacgaagaagggaaatctttggaaacttgcagcaaatctcagctcatgcatttttagcaggagcttggtcatgtccacactgaaaccatcagggcagagggaatgaggacctcctagtgtgttcagatcactcataattccctcaaggaataaaaaagagcagagaggtctttgctctgagcatactggggtgattgtcacacactacctgactgctagtagaagtagaatggtttctgcagcagacactggcaatgacataactcaggtaaggggcctgggaaggttagaaaatgcagcatagctcctgaatgcttcccacatacctggcacttataggtgattcccccattgtagatacccagatgtacaaagttcaacttctggtgtttagctccctcacaaaggctattctcaaagctttttctcttttttgagttatgctatgttgaacaaagagacaatacattccctgcagtcttaaggcctcttgccagcatgaagtctcttgtgtgctaaatgagcttaaaagatagagctaaatggtcaccaaaactgctatgttcatgaggcctttctccagtgtgaacttttatgtgccacaaaaagtgggagcatctgctgtaagctttcccacattcgctgaacagatagtgtcttgcgccagtgtgaacattctggtgtttgaggctggagttgccatgaaatcatttctatgcttataagtgtgattaacatacatttttactttcttgtgcttttctgtcatatttattgctaaactcataaaataattgaggaattatctatcttcttttctgtatattagaacagtttttgttcaatttaaattagcttcttttaaaaaacgtttagttggtttgatatctttgtggttgaagaaatttcactactctttcttttattttatggttttcttcttgatggtccaccttgctggtttatatttccttaggattttttcatgttatacagattttcatattaattcctaaaacgttgttcattatatgttattatttttaactttatttaatgttaagtaatatattactaaattatttgcccacttttattactgatgctgtttattaagggctttcttcgctttaaaaataaaattacaggacaggcgcggtggcttatgcctgtaatcccagcactttgggaggccgaggcaggcggatcaagaggtcaggagatggagaccatcctggctaacacagtgaaaccccatctctactaaaaatacaaaaagaaatcagctgggcatggtggcgggcgcctgtagtcccagctactagggaggctaaggtgggagaatggcgtgaaccccggaagcggaggttgcagtgagccgagatcgcgccattgcactccagcctgggcgacagagcgagactctgcctcgaaataaataaataaataataaataaaatgaaattatacttgacaaggttttgtctgttttgttattcttgtcagaaacagtttatgtatctgttgttcaaatctatagcttttttgtttcattattttactttaataattatttccttctatttagagtgttttgtaatttccgttttgagtttcacttttacccacaaattactcaaaattgtgcatttgttttttgagatatttgaattagtgtgctatgtacattacctttttgtcactgattttaaaaaattttactgtatgttttgtcacttttgtattgtggttttggggaaatctggaactttaattgtgcttttacttgtgcttgtgtacatttcttcaagtgcttgaaaataaattttatttcattcagagtgcaaatacagtagatgtattaacttaagactgctactgggttatttccctcctttacccaattccttgaactgctggtatctgagagacatgtgttaccttttccaactatcagttactctttatagctttactgaatttgcctgattaaccttagaatggaaggttttacttagagctgattcctcccacacagagtgcaggcaggttcgatttatattcctgactctaacaaccctctggcgagagctttctgcaccaaattctgtacaatcttagcacaagtatagtcactactttgttcaatcttatggagaatgttaaagaagctaattgatattccctcatctctctactggtccatgatatttcccaacttaactcagatatcctgccactgttatcagcggtgggttttccttgaaaatgcccaaaacctcaattgcttagcctagcagagattttactaatctaatgcatttttcagactttgaccttgaccatctatccacatcttcctcccccctgccttgtccatgttcacgttctgaaaaatagctcatctttcaattactgtttcacttaaaaacaagggggatattttctccatggttgtatatggatatctaatttccagctacttagatggggtttcctattccaagtagggtctcccttggctgggaatggggatgggagaggttatatcaaatacatctcacatgcctcttcagaacctcttggctttgtgtctcaagcttttgggcacctgatcttgtccagatgctgctgtgtctaccacctcagcatggactctagccagcttcacatatgcacaaactagcaacttttcttatgtaacacttctctagaggcattcctctttggcactgagacataagatgttgcaaggcatgcttagttccaatgtgaatgcaatccagcagaataatggagcaaaccttggagcagtaagaactgggaacctggagccagcagtaaagcctcccaccctccttccagatgggttgtcttgagacgcagttgttcatatgccaccttggaagttggtcccatgagatggctcagtcagtagtgcatgataccaagcacttgtccagttagaaatgcagaattgaattgcttttctcttccttttcccctcattatgtccccttctttcactcctgttccctgaggtgcaatctctaataatataatagcacctaagttagtgtaacaagtgtttctggagaaacaacaccaagctggggcgaagaaatgcattgcagagctccattttcctttctgtttgtagcttctagggtgatggtatattttacacaaaattgatgagtgagctaatattctatggatacatccagccctgaactgcacatgtccacaaggacagtctagataaaaaaatcgcttgacttcatctctcatggcttcttgtacaatgtattcacatcttgagttatgctaaaagggtgagaaggacattctcaactcttgtatataagttttctgcaatgcaaactcaggttcttaggatgtgagtgaccaaaaagagcctttccatctcactgggatgcacctgttctgaccagggaaagttattgagatgattctgtttggtcccactcaagtccatatgcaagaagctcttccttttacactcacttctctaggtgactggggtcccactctacatgtaaggtcttatgagtgtctttagatgaaaaaaaagaggcctgtcctgagaggctacactgaatgtgaattgagcgaatctagaggtagcctgactaacatcacacctgctggacattttcatgttgatttgtaggaaataaactgtctgctattaaagtgagatttaaaaaaatcttcatcaggtaccaacagtaagacaaatgaatcaccccttaggttcattccaagttggatcctgtcattctatattctaatgcctcacaaacctttttcactcttcattatttcctctatcattcctctcccctaaatcaaggaatttctttttactttggagagctgagaagggaggagggaagcttttcagatttttctgctgatcataacttcttctaaatatattgattctgaatccaaattatccctattcctctaaacctaaatgtttgaaattcaaaaaccaacatttgattatttttatgtcccccctctccatttctgctgagtcaaacataatggctatctgattaagtaagagttaaagggtaaaaagaaatatctgtaataggggaactttgttaaattcttcatgaatattgtcctgccatgttcctgatgctaattgtactttctttctttcttttttttcctataattgtctctttccttcactctttctttcacaacccgcaaaatcaggcactttaaagaataataataaaataaacctttatgacctttatcaagatgaaggagattcaccacactgatcactgagcagaagaaattgtaaaatggaacttttaatattttaaagccatttggaatgcagtttgcatgaatgactcagatctgtggagggatgatgaccctggagaatttgcactgacaaccatgggaagaagacatgagagagtagcttttaattgcatatttaattgaccttgcaagaaaatcagtctcatatttggtgaagagtacaattacataaagattcaaaaatattatcatccaaataagttactcagactattttatattattattagaatcacataatatctatactctgcattattttgacagtgctaagataaccaccatcatgctttatagcagaagggatggaaagtagttaggagataaaagaaaacagcttctatcagtattttagtaatttttaatcaataactatatcaaagactgaaaagttttcagatatagtattgaaactgtcatatttatagttagtatagatgtgcaatttttaaatatttgtataattttaaggtggcctattgcttttccagtcaattggacattaatgtaatttacaagcatgcaaaatcagttatttttgtatgttttcactttggataaagctaaataaattgttattttaaagaataaacacatgtaattttttccaagggcacttgtcccaagaacctttttcagacaggttttaggggacaaagttaacaaatatttagaaaaaggccttggctcctataaaaataaaacttagccaaagtcctgtgtataagaggaaacagaaagataattttagaagttacaagatacgaaatgatcactgttttatgtgagagaaagcaaaagtattttctcagacccaggacatagaccagacagtcacttgtcatgataagcagtaattttgggtgaaagaagcaagatctaaggtcacatgggaactgtgacctattagaactttagcttggttacttatgagtacatttccatatagaattatgtgaattgcagttatgactctcagaatataagctacaaaatgtttgacaattcctaaagctccagcctatctgccccagtcatacactgcattaaaagaagtagcatccttgctgggcacagtggctcaagcttgtaattccagctacttggaaggctgagatgggaggatagcatgaggccagaagtttgaggctgcagtgagctactatctcgccactgcccccaggccgggtgacagagcaagacctcttctaaaaaaaaaaaaataagacaaaacaaaaacaaaacaaaacaaaacaaaacaaaacaaaacaaaccaaggtactgatcagaaaccacttctcctaattcatcctagatgtggcccattgatgtaggggagagtaaagaaaaaatacctctcttcccaattcagagaaggaagaggggaagcagttgtgtaggacacagtagcaccatactgaagagcttgccagctaatttcctaggaacttcattcattcattcattcattcattcattcatttagcatcaaaaaggaggaagacattgaacatcaagcaggattttattggcctagaaactatgagaaaaaatagttgttgccctcaaactaccctactaatgagctacaaaatgtgaggctttttttttttttttgcatgtgtatacatgttcatgaacaaaccttcaggatggcttttatattctgaaaacaatatgtaatcaattaacttagttttttaaaaccaatgtttaattaattacagtcagaaattgaaacacctgatttttccacaggctttaggttccacttgacagttttattattttattattttgaagctggaaaacttaatcaactttaaaaggcatttagtaaatatttggtcccatttaaaataccttggaacaattttaaaccgcatatttaaatgtaatattaagtttcctccttacatataccacttatctgaagtgtatatctgacaaaggtctaacatccagagtctaagaagaacttacacaaatttgcaagaaaaaaaaccaaccccatcaaatagtgggtgaaggatatgaacggacacttcttaaaagaagacatttatgtagccaacaagcatatgaaaaaaagctcatcatcactggacattagataaatgcaaatcaaaaccacaatgagataccatctcatgccagttagaatggagatcattaaaaagtcaggaaacaacagatgctggagaggatgtggagaaataggaacgcttttacactgatggtgggagtgtaaattagttcaaccattgtggaagacagtgtggtgattcctcaaggatctagagctagaaataccatttgacccagcaatcccattacagggtatatacccaaagaattataaatcattctactataaagatacatgcacaagtatgtttattgcagcactatttacaatagcaaagacttagaaccaacccaaatgtccatcaatgatagactggataaagaaaatgtggtacatatactccatggaatactatgcagccataaaaaagaattagttcatgtctttgcagagacatggatgaagctggaaaccatcatccccagcaaactaacacaggaacagaaaaatcagacaccacatgttctcactcatcagtgggagatgaacaatgagaacacatggacacagggtggggagcatcacacactgggcctgtcaggggttggggggaaagtggagggagggagggagagcattagaacaaatacctaatgcatgcggggcttaaaacctagatgatgggttgataggtgcagcaaaccactatgtcacatgtatacctacataacaaatctgcacattcagcacatgtatcccagaacttaaggtaaaaaaaaaaaaaagaaaaaaagagagttttacttaaaaaaaaatggattgaactgcctaagtaatgaacttcacatcattgggaagcttcaagaagttagtgcatgaaaaccacctttcaaagttgctttatggggattccttattgatttttgaggctagactaggctaaaagtaagtgctttccagcatatactagtgattcttcattattatggaaaaaactcacatgtagagatgatcaatgaagaaaaaactttaaagatgtttgtgaggcactgatttatatttatattgtagtttgcgacagcggcctcagatgtccttttctttctttctttttcttccttccttccttccttccttccttgcttccttccttccttcctttctcttccttcctttctcttccttcctttctcttccttcctttctcttccttcctttctcttccttcctttctcttccttcctttctcttccttcctttctctttctttctttctttcctttctttctttctttctttctttccttctttctttctttctttctttctttctttctttctttctttctttcttctctttctttttttattatactttaagtcctgggatacacgtgcagaatgtgcagatttgttacacaggtatacatgtgccatggtggtttgctgcacccatcagcccatcatctacattaggtatttctcctaatgctatccctcccctaaccccccatcccccgacaggcctcactgtgtgatgttcccctccctgtgcccatgagttctcattgttcaactcccactgatgagtgagaacatgcagtgtttggttttctgttcctgtattagtttgctgaggatgatggtttccagtttcatccatgccccggcaaaggacatgaactaattttttttttacggctgattctatggtgtatatgtgccacattttctttaaccagtcttaagattgatgggcatttgagttggttccaagtctttgctattgtgaatagtgcagcaataaacatacatgtacatgtgtgtttatagtagaatgatttataatcctttgggtacatacccagttatggaattgctgggtcaaatggtatttctagttctagatccttgaggaatcgccacactgtcttccacaatggtcaaactaatttacactcccaccatcagtgtaaaagtgttcctatttctccacatcctctccagcatctgttgtttcctgactttttaatgattgccattctaactggcaagagatggtatctcatagtggttttgatttgcatttctctaatgaccagtgatgatgaactttttttcatatgtttgctggctgcataaatgtcttcttttgagatgtgtctgttcatatcctttgcccactttcttttggggttgtgtttttcttgtaaatttgtttaagttccttgttgattctggatattagcccttctgcacaacaaaaaaactatcatcagagtaaacaggtgaccaacaaaatggaagaaaatttttgcaatctacccatctgacaaagggctaatatccagatttcctatttcatatgaatgtttttctaggaaaaaaagcacttaaatgtaacatttctatgtgctttgtgggtgttttctgttgttaggaatagctctatcttttatgatagagatgtgtctaagctttgaaattttttcctaactagtaataatttttactttattcctcacttgttgtgttaaatgccactttgtgcaataactaattttatcgccaattctaacaaatatcagaaagcaaattcctgtatctgattcaggaaatacagttcttaaacattgacaggattcaacataccctcccaaataaacatacattgaaataagtagtatatatttatctttctttagagaaagaacattcaaatttcatttctagttttaattagcagttactttcttatttggggacctctttcataaaacatgcattcttaattttttgcacagcccccccaaaatttttttctggctcagttttcatgtaactcattttttaaagtggaaaatagaggatatcatgtttgctttacacattggtggttatttatcaatctagaggaagatggttgattggggagaggatgttcagagatgacagctcaggcagctatactcagaaatatggggggcttagaacttcaaggggttgagacaggtaatcaagtcctataagtcttttaaaaataaaaatctactcatggtctcttactatgtatgtatgtttcatatatttgaaacacatttaacttacaaaaggtttaagttaaaaattgctcttgggtgaaatgaatggatatataccaaagacaactaaaagagaaaattatgtaaatactgacgcttctgggatattcaaagccactgcaaacacgaatacccctcatgttgtcgtgactggatatatatttataaagatctccatgtcctccaggttgctatttttcactaactaatttaggcagattttataaaactttcctacgtggtcagatgtataatattttaaaaaacacaaagaaacaaaaattatgaccttgcagtttttaaaaacaactccagcatttcctgagagattaccttgttgtaggcagagctggtggttcaagtgaggcctggccactatgcatgagaaaaagtagaaggcatagtttgttgtcatctacacatgggtcagtgccttgtcacaaaactgccatttagtacctcatagtgctcaatattgaaaacagtaatagagatataaagaaactttttccccgacactttatttctgtcctctttctctcccaatactttacatttacttgaaatagccagtgaattttaacatcttccctttctgacatatgacattagagctctgctcacttagcacctcagtaatattcattgctttttcagcatatttcaaagctttttctttcccaaattttgacctaacaactactgagaacctattattctatcactgtagggcatagaaagtataattaaacgtgatacttctccacaaaaagctaagatgtgcataaataactagagtgatagttcaagttgacatctcagagataagggcaagtggaaattgtacaatagagagattgcctccagctggtgagtttggaggaggctgctcagccttttaactaggctttgaaaatagacaaagcactgacaaatgcatatggcaaagagttgctgttaacttgcactctttccttcccctcctctactctcttgaatgcgtgctatcactctttcatccccatctatggtctaaacccacttgtcatagctaccttcatgttatcaaatccagtggtcaactctcagtcttccccttcactgaactttcagtggcatttgatagaatttatctgccctccttcttaaaacactttcttttcttagcttatgagacaccatgctactctcctgattttccccatgctttggtgcccacttgtttccagcttcctttgttataatctgcttttacccatctttgaattttactatgtcccagagtcgagtactgagacttctatccacacatttcaataggtcagttgttcttaagtgtgattgcacatgagaatgaccagaaaatattttaaaatttagcattactctgacccctctgctcagatttagattcagatggggatgggagggcatcagtattttattttaaagctcccccagtgaattaaatgtgtgacatgattgaacaacagtgaatagggtgatctcatccagttccatgactccaaatgtcaccaaaaaaaaatccggtgactcagattattatctccagccttgagctttctgtttaactcaagcctcataactaagggattactagaaaattccattttgctgtctaatgcctatttcagttaacatgtccaaaatagaccttttgattcctcatcaaattttccatttatccaaggtttcttatacagaaaatggaacatgccgtaatccaccctgctgttcaggccccaaacttgggagttatcctggattactgtcattctctcttttcccacatccaactcattagtaaatatacttattactatcttccaaagtaatctttaatttgcttatttcataccacttcttccccaatatctgcagtttaagtcaccataatttcttagttagactagtccttagcctcctaattcatctcctgtattcactctttccatcaaccccaccatctgtatacagctgcaatgtaatccttctaaaaaaataaataaaatcataccacttttctgctctcaatcctccaaacagtttctatcacacttagaataaaacccatttatttactatagtccatatgattgggggattgacctctacttactctggcctcatttctcaccatttttagaaacccctcattcaaggtgcattggccacaatagtctccttgctattccttgtatacctcacacatgctcctatcatgggcctttgtgcttactattacatagatcccaatatgatgtggctagctctctcgtatcattcagactacaggcatctggtcacatgtcactcctttcagggaaaacttctgtgagtgttggatcatagggacctctatcccattattttgttttatttttcatacctgacattttgttatgtttgcttacctaatttctttcttctcactagaatataggctccattaggatagaatataggctccattggttacttcatcatcatatctccagcatctagaacagcatcttaaatgtataggtaggtgcttgctaaatgcatactgaatacatgaattcatgaatgaatgtacaaatgtaaagggagggatttcaggctaagggaacaatatgagtaatggtatggaaacaagaataagtagctagtttgggagaagaccatatttggatgaaggatacttagagtggagtggcaagagatggttctagaagggaaaatataacccaggatgtggagaaccctaaatgacacatggaatttatgaaatgagaagccattgaatattttatgtgggttgtttatttgattgaaataaggctaaaaatcaaacgattttatagcttaatacatgtagtgggtaagggaataggaagaatcaaatatgattctcaaatattaggcctgtataattgaaggattgttaatggcatcaataaagagaaagaagacagaatagtgggacatttttgttttgatactgcttatagtaactggtagatttgaagtttgaaaacataatcatgtatcatagatgttaaatttaatgggcttgtaaaacactcttgtggagatgctgaagaatcagctgcacatgaagacatggaatttgggagagaagtcagggctaagctttagggtttgaaaattctgccctaaggggatatgatgatattttgggagtggataagattatgaaataggacattgtgaggtaagaaatgagagcttattgctaaattttctgaaatgtaactttaaaaggtgatatggggaacaaatatgaggagaaaccaagtagtattcagagaaataggaggaaatttccatgggatgcaacattatgaaagtcaaagaagtaaagtgaaaaaagagaagttaagcatcagtttaagtactgtagaaagtttgaggagagtgaagagatgagctcattattactccattggtgtgactgtggaggtttggattgacagcttggcagaatttaggagaaagtagaaggatagtatctttatagggtagcatggttgtgaaaaggagagaaaaaactgaagaaaaaatacttaaggagagaaaaaactgattcatacctcaaattaagcaaaagaagttttagaggaacagatagaaaaatcaagaagagagtgttggttcatccatggactaaaaccctgcacatcatgtaagatggctatgttatccctggaaagaagtacaggtgtatcctcttctgactgaggaaaaaaagggagaaagagagggtgggagatatgaatggatgagtagaggtgagaaagcatatgttagtcacactctaagttggaaataaagtaatctttcaaagttaggtgctgagtggtgtgggagaggagttggataatataggttaaaagatgatgattaacacagtgttgatgccttttcatcctgacctacctctgttcgtttgtttgtttgttttgttttgtttttcccctagacagagtcgtgctttgttgcccagagctggagagcaatggcatgatctcagctcactacaacctccgcctcccgggttcaagcgattctcctgcctctgcctccagaggagctgggattacaggcacgcgccaccacgcccagctaatttttgtatttttagtggagacagggtttcaccatgttggtcaggctggtcttgaactcctgacatcgtcatcctcccaccttggcctcccaaagtgctgggattacaggcgtgagccaccacgcccagccctgacctacctcttaataagttatgtggatatagttatatttagatttttttaaatgcacaaataaaaatcacatgtaaatataaagtatatcgctgttgtaatttataaaaatgttttttctttgccatataagagaaatataatatcagttcgggtatttcttggataaaaatatttttctgaatgaaaatgaacatttatctactatgatgatatgaatgatgatgccaaggcgtctttaatcccaggtacagctagctgttaaatatcttttcacaaatagttaatggtcttcctttcttgcaaaggagcatcacattatttttttaattgtatataagttaggtagagagttctagaattatttctcataaatgagttcagttgcagaaagtacctagagcttagaacagttgctggaacgtagtagctagtcagtgtatatgaactatacttcattatcaccatcatcttcatcatcatcatcatcttcattgtcatcattgttattgttagaaaagggcatatgaatttggattactaaattatgtaaaatattgacatatcccatgtttactaatattgtcatgggtttttaataatttgaaacataatgcaaaatcttgttattaactttttgatacttgatgataaaaaattttaagtgttcatatttatggtcaaggcactgatcagtattaatatatttgatatcatgtgactatcatatttagtctcatgagaatttcactgtagttcagcattaattaaatgtactattaaattgaatagcttagccttgtgaagctaattagtattcttcaaaataatgccaatcataatggattcatttgatattaatatgaatgttatatatatttctacaaaaattttattatagttgttactaatgcattgttgtaataaaggatataaaaggcagaaagtaaatggttaatctatctaatggtttttagataataattttatcctattagaaaagaaaaatttatttttactttatatttcagacttagaatttcttttatatattaaagcagagatttgaagggtactcaaatgtgaaagggaaaataacacaataaatgacactagagttatccgtttctaaaaagagccaaaaatctattctaaaaagttcacttatatgagtctgacatttgtgctgtgatttgcttcaggcataaagtgggaattatcattctttattatattattagtaaatggtaccagcattttaatatataaatactgactcttgtagtaaaatatgaatcttattagtaggtttcaaatcagaatagctaatgtacccattttaacgtggtttattataaacttaaactataatagggctgacgtatttattccctccctcaagtatcttgccatactgaattgaaataaatggactacctgtttaatgtaattttattgtttttacttataatattttctaaagcccacatagatttttttgctggcttaattactaaaaattaccctaaaaacaatgctggactaaatacgaatatgagatgttaaaagttactatgtgcagttagtaatggagaagtgtgatcttttctcagtatggagtagtttctgttagagataagagcaggacacttgtgaatgtaccatgaaaatatttaagttcttttgtttcttttttttttttttttgccagaatcaaagcctatctccaggtttagcaatagaactggcatgcttaaataaataaacaaatatcttaaagcaagtaaaccctgagtgttaaatatagttaatttattttcacaatctgatatacatttggttatcccagaataaggacttatgcctggaaataatattgtcttacttttaatttacctttatcatggtgtatatcaatttcatgactttaaaaagcttgacacatttatctatgggtaatagagttatcatatttcattgcttagatatatcctgaataggcagcccaaaatcatttttaccaactgattcctttgttactctttggacaaccaagcacagacctaaattttaagagtggttgcaaatcattggccattttcttcaagatcaaggatacaaagtgctgaatcaaatttgcaaaataataaactgatacatatcttcattccttgaggggaatggagctataatataattcatttagatttaaaactagtgtgcctttatatagtcagaggagatttttagtaaaaaaaaattatccactaactaaatctgctttacctcataattgcaaatggtgaaggatatgacaaatgcaaagcctaggcccctggatcacaaatttaaggacagggtgcataattttgacaccaaatttgattttattagtcctcctatgctataggaagcacacgttctttcctaccataaaaaacctagggttttctgataaacatagacccacaacctaggacctaaaaacagtagtagactagaaagatagaacatcatcaaaatatttctgaaataatgctcgattctcttagctgtgccgcctaacttctagactatataaggcccttattctcatgtactaaatgataacatacaaacaaggataaagttataccaagttctcacatgttttgtccacagagtgaaaattaaaataaaaatttacctggagtaattagccaaaaacagtatgtgccttaacagctgaaacttttacttctctccttcctcgaacacaattccatataaagctggctttttgtaaaatgaatctgttggtagattaattattatcattttaaaactgttcagtggtatctagagctttacttttaaatttaaattcttatttcctttacattgatacagaacaatcaataattcaacctagtttcccttagtcctcaatatgttttctgaatagttatgtccagtgaagttattttacagtttaccatagtaaacaagagttttaaaaagatgactaacagattcctgcctcttgcctttttctctttcgaattgttctgtctgcttacctgcatgtggtccttcagctattgttcgcttttgtttctgtgacagtcaatgaaaaaaaaaatgcctggagacagagatagggaaaggaagggtctgttttaagaactaattttttatgtgtatacatgtgccatgttggtgtgctgcaccattaactcgtcatttacattaggtatatctcctaatgctatccatccccccttcccccgccacaacaggccccggtgtgtggtgtttcccaccctgtgtccaagtgttctcattgttcaattcccacctatgagtgagaacatgcggtgtttggttttctgtccttgcgatagtttgctgagaatgatggtttccagcttcgttcatgtccctacaaaggacatgaactcatcattttttatggctgtatactattccatggtgtatatgtgccacattttcttaatccagtctatcattgatgggcatttgggttggttccaagtctttgctattgtgaatactgcagcaataaacatacgtgtgcatgggtctttatagcagcatgatttataatcctttgggtatatacccagtaatgggatggctgggtcaaatggtatttctagttctagatccttgaggaatcaccagactgtcttccacaatggttgaactagtttatggtcccaccaacagtgtaaaagtgttcctatttctccacatcctctccatcacctgttgtttcctgactttttaatgattgccattctaactggtgtgagatggtatctcattgtggttttgatttgcatttcacatttaccctagaacttaaagtataattttaaaagtggtattattctttattttgcaaatctctctttttttttttttgagatggagtttcactcttgtcacccaggctggaatgcagtggcgtgatctcagctcactgcaacctctgcctcccgggttcaagcgattctcctgcctcagcctcctgagtagctggaattacaggcacctggctaatttctgtatttttttagtaaagatggggttttgccctgttggacagactggtcacaatctcctgacctcaggtgctctgcctgcctcggcctcccaaagtgttgggattacaggcttaagccaccgtgccaggaaaaaataaaaaataacgaatttttcaatttttcaattgtcttcatgtaaacttctctagtttgccatcagttactttcctaaatgcagcacagcaaagtgtctactatagttctttcaaaatatatcctggcagcaaagatatagattttgggatttttcttctagtgttatgatttaggtcattcccagagcaataaaacgcactgtatgtgagacttataatacaacacagagaacaaagtttaaactctggagatgctaaactacagcaggtcacagagcagtacaaaagggagtagaacatcagaatatgttttcaaaactggaatatgaaaggctatcattaatttgcaaacactgagtacctaacaatgtgcaatgtactttagtaaggtcagtgggccatacagaattcagaaagacgtggttcctgtgcttgaggagtttataatccacaggctggagttcatgccagaagctctcccagactggtgttgcagccgattggactggagtcttggatgaaatcctgtcccctggctccagtaagcattggcctagtgagcgctttccatggtggtcctgaccccacaattgtgctgggcattgccctagtgggggctctctttgggaaaagtttctctctgggctccaaggctgtctgatacacactttgaaatctaggtggaggcagctgtgcttccacagctcttgcactctgtgagcctgaagaattagcacaatgtgtatgatgtgaaggctcactgcttgcaccctccagagtgccagtctgagttactcctgggcctgcctaagctacaggtggtatatccaaggagcactgtgctggaatgcagggagcagagacctaacgtgacactgggtagtgacccctgaaaacaagtgtcctgggtcctccctttagactgtttttccttcatggccctattactctgagtttgtgatgtgcatggcagcctcatagatgtctgaaatgtgttcctggtcactctcccagtgtcttttttataaattttattttcagttggccctaattctaattttagttctcttgcaatccaccacatctgcaactacttcctcaattatagtcctgaacctctcaaatacatccatgagagttggaattaacatcttccaaacttcagtacaacttaatattttgacctcctcccatgaatcataacttttcttaatggtatccattaatagaatgatgagtcttctccagaaggttttcagcttactttgcccaaatccatcagaggaatcaccatcatagaaatagccttacaaaatacttttcttaagtagtaagatttgaaagtcaaaattatttcttgatccatgggctgcagaatggatgttgtgttagtaggcatgaaaacaacattaatctccctttacatccccctcagagttcttggatgaccaggtgcgttgttaataaacagaaatattttgaatgtaatcttttattctgagcagtaggtctcaacagcaggcttaaaatatccactaaaccatactgtaaatagatgtgctgttatccaatctttgtttttccatttagagagcacaggcagagtagattgagcataattcttaagaattctagaattttctgaatggtaaatgggcattggtcttaaagtcaccagctgcatttgccccttgcgagaaagtaagcctgccctttgaagctttgaaaccagtcattgacttcacctctctagctaggaaagccctagatggcatcttcttccaatagaagactgttttgtgtccatcgaaaatctgtcatttagtttagcttctaaacttcttcaattatcttttggataacttgctgcaacttctgttatacagacagcttctttccctgaacttcatgaactgatttctgctagcttcaaacatttctttagcatcttccttacctctctcagcctgcatagaattgaagagagttagagccttggtctggattatgctttggcttaaagtagcctggctggtttggtcctccatccaaatcaataaagctttcttcaattcagcaataaagctgtttgactgtcttgtcattcatgtgttcagtggaataacacttttaatttctttgaatatcttttcctttgcattcataacttggctaattggcacaagaggcttagctttagtccatctctgcttcaacatgccttccttactaagcttaatcattcctagcttatgatttgtagtgagagagatgtatacctctttttttttctttctttttttttttttttttttacggagtttcactcttgttacccaggctggagtgcaatggcacgatctcagctcactgcagcctccacctcccaggttcaagcgattctcctgcctcagcctcccaagtagctgggattacaggcatgcaccaacacactcagctaatttttttgtgttttcattagagacagggtttcaccatgttgatcaggcttgtctcaaactcctgacctcaagtgatccacctgcctcggcctcccaaagtgctgggattacaggtgtgagctactgtgcctggctgatgtgtgcctcttccttacacttgaacacttagaggccattgtagtgctattaattagcctaatttcaatatttttgtgtctcagagaacagggaggcccaaagagagagagagagatggaagaatggctagtttgtgaagcaatcagaacacatacatttattaattttgtcgtcttatattgatgcagtttgtggcaccccaaaacaattacaatagtaacatcaaagatcatagatcactataacagatttaatgataatgaaaaagcttcaaatattgtgagaatcactgaaatgtgacccagaggcaaggagtgagcacatactactgaaaaaatggtatccatagacttgctcgatactgggttgccagaaacatttaatttgtaaaatactcagtatcagtaaagcaaaataaagccaagcacaataaaatgcagtatgcttgtgtcttgttcctcctttccacttgaaaccttatcagaatactctttactgttcatatttccatgagcattctggtcatgcacacttaagtcatatctaagtggccagaggctttctttacagttattctcttcttccaagttctcaccagaatcacccttaatgcttcattaacggtaatacaagctttatctagcattcacttcaaaactctgccaacctttacctatgagccagttccaaagaagactccacatttttagttatttgctatagcaaccacctaactcctctggtactaatttcttagtcagtgacatggtttggatttggatccctgcccaaatctcatgttgaattgtaatctccaatgttagaggaagggcctggtgagagatcattggatcgtgggggaggatttcacccttactgtacttatgacagtaagttttcacaagatctggttgtttaaaagtttgtagcatctccccctgctctctcttcccccttctccagccatgtaggatgtgcctgcttccccttcaccttctgtcatgattgtaagtttcctgaggcctccccagccatgcttccagcacagcctgtagaactgtaagtcagttaaacttctttcatttataaattaaccagtctcagatagttctttatagcaatgtgagaatggactaatacagtcagggttctccagagagagagaataaataggtaatagatagatgagattgggggaattggctgacaaaattttggaagctaagaagtgccactttaggctgtctgtaacctggagatccagggaaggtcatagcgaggttcatcccaagtccaaaagcctcagaatcagtgaagtcaatgctgtaactctcagtcagaagctgaagggttgagggcctggagcttcctctggtgtaagttccggagtccaaaagccaaaggacctggagttctggtgtttgagggcaggagaagaagagtgcccagctccagaagagagagtaagaatttgccctctctttgtctttttgtttcatctgggaccccagccaattggattatccccatctacattgagggtagatattccccatttagtccactgactcacatgtcaatgtcctccagaaatatcctcagagatgttttaccagctatctaggtagtcattaatccagttgtgttgacatctaaaattatctatcacagagcataaaagtgcaatttagaatttttaaaaaacagtcagtacagagctccctaaaaagaatgttactaataaggtctcatatgagcaaaaatggaaaagacataaaggacttagtaatgtgtttatctgagggcagagagtttcagagagtgaggtttgccagtttaagtgccctaaggtcgaagctttcctgcaaattttcctaaaatagcaaggaatccattgaagttggagtagactgagtgaggagaagattgaaaaggtcagggaactaaaatatcagcgaactaatgatagggatcatgaggatgggtggggatgcctatggtttagggaggtacaccataactttcagtactttcacagaccattgaagtcccattgttttctagcagatgttacttaaataatgtgcatttttttgcacattatttgctaaggctttactaaggacttggcatcttactctgagagaaatgtgaagccaattgaaggattttgattggaggagagagataacctaatttatggtgaagaggttttatatatgtatgtatgtgtacatatttttcatatgtccccaagctagtgaaatcactgagaaatggatctgtgtttgatttaattttttgcattgtcttcatcacctagccctctgccttttatagcattgtgactgaatagttaccaattgcttattaattgattttgaaacttaaaaataggatttatatattttataagaaatgtatcttgacatataaaacttggccgtgctcaaaaagtaagaattttagttttaagtatcatagctacctattcacttttacagaggtaatgactttcaatactttcatagacctttaaagtgtcattgttttatagaaggtgttacttaaataatatgcattttttcactttaaaaacaaagatgtataatctgaactgctgtgcagacaaagtcagtcaggctgctgggtgcctaaatgtcccaatagcaatttacttcccttccatgtgatgacaattggagcttaatattctccaactaatggagaaaaataaaatgattcttgttcctgtgtagtgattagacccccttaaagcctgtacctgaaaaggaactagctggtgatgatcttccttacctctagtgtactcatttcactgatgtccactcagtagcatgtattcactgaaatacaaatttatgctattacatcatgtaaattatttaatattatgacagaacatattagtgatcaatgcacatgacttctttgcaattctagctttgcttgggctttgacctaatgagagagagataccatgataaggaagactagatgttacctagggcactcgaaccatgtggctactccctgaatacatctaaatgcttttggtctaaaaatggtaatctagagttcacaaattcagaattccccagaaaattaaacttccccctataaactagctccacgttcactttcacttgtttctctctctattttgcatccttgctagattgaatttctatttattttgaactttaggccttcaatgcagcccagtaaattgggaaggactttggaaatcagggcttcctgcgttctatattcagccctgagactgaggagttaaaatatttctgaaaagtttttgacccctttgaacctcagattggttgcccgtaaaatgaagatgaagaaacagttgtcagaaacataaaataatatagctgtatgtaaattatatacataatatgtacatatgtaatattgaaagtacatacatgaacatatcatgtgatataaattatatatatatgtttttgttgtgtcagttccatactttaccttcatatctactatttttaaaatctctcccatataataggtttttgttaaatgatagtcccatacattgtctttaaatcatgcaaatacgtaaccttgaaattgtagttaccatatggtatatgctgggaatctagtgcattgcttacaaatttctgaagattttgacagatgaataggtaaaaattattagggtagagagcatttgtaaattaacatagtgttttaggacgtggacaatattttcaaaattatcttatctgatactatgttttcctttttttaacttttaggttcagtggtccatgtgcaggtttgttatataggtaaattgtgtgccatgggagcttggtttatagattatttcaccactcagttaataagcatagtgcccaagaggtagtttttcaatcctcctcttccttttcctccctcaagtaggccccagtatctgttgttcccttccattgtactcaatgtttagctcccactaagaaatgagaccacggagtatttggtttcctgttcctgcattagttcacttaggacaatggcctccagctccatccgtgttgctgcaaaggacaagatctcactctttttttttttgactctgtactattccatggtatatatgtactatattttatttatccagtctaccaacatttaggttgattccatgtttttgctattgtgaatagtgctgtgatgaacatatgtgtgcatgtgtctttatgatagaatgatttatactccattgggtatatacccaatggtgataaagtggtgttgtttttttttttaatttacccttttcctccatatgttttctgggagaaagaagatattacaaaattagctgcttagtcatagaagtcttggctataaactgcttgtttataaagtctgagttcgaaacttctctagttagaacagtagatatctttgggtatacacccagtaatgggattgctgggtcgaatggtaattctacttttagttctttgagaaattgtcaaactgctttccatgatggctgaaccaatttacattacaccattagtatataagtattctttttttctctgcccatgtttaccttttacttggcatttttgtcaagttttggagaaaggattaaagaggttaattttcattttaatatatattgttgcaatgtaggccatatttgtattctcatatttaaaattagaggttagatttccactttcaaggttaaatgagaactatgtgaagctttcagggaagcatgctctgtgcagtttataaatcaaggtgtctatatttcatccatattagaccatgacgagaggcaccactgtatgcagaatggaaaatttacataaataattttaatcctataagactaaagtctgcaggaaaagtagcaagtcatttcatgggatcaaagtttaggctctggatttagaaaaattggtcttgaattctaggttttctgcttatcatctgcatttcaggttaagcaaattacttaaccttctgggaccttagttaactcatgtgaaaatgagataatgactgcaattagccctcaggtttgctgtactgagttattatgttcacagtacatggcactgagactggtccttggcaacccacagcaaatgataactactcttctaactagaaaagttgataaatcagactttatatccaagcagtttatagccaagagttttatgaacaagcagctaattttgtaataccttctttcttccagaaatcgtatggaggagaagcaggtaaagttattaaaaaaaaaaaaagcacaacttcgaactatattttcattaaaactaggagacagaggccaggcatggtggctcacacctgtaatcctagcacacaggagttcaagaccagcctggctaacatggtgaaacctcgtctctactaaaaatacaaaaattagctgagcgtagtggtgcgtgcctgtaatcccagctgcctaggagctgaggcaggaatcactggaacccgggaggcggaggctgcagtgagcagagatcatgccattgcaatccagcctgagcgacagagcaagactccatctcaaaaaacaaacaaacaaaactaggagacagaaaaaatcagcagactcccagttgcatatacatttcatcaaaggtgaagccacacaggaagcacagtgttgtgagggtgacaatggggaagaagagggtggtcagaggagttctaaggctggtgagtctcgtacatctccagtcaatagttgccttccacatgacaacatcctacctgagagggaaccactgtgagtataaccgaaatggaacacctcaaggttgctggagaaggaataatgaagcaaggctcacaaagagctcaggagcccataggtggcagatagcaaaatgtgccagtagaaaacagtttctaagaatgcatgatagtgtaagaaagggatgtggagggaactcagagattcaggctggcagagaaagttcacctgaactaggctgagctctaagagccagagcagggctgtcaacagaaaggacaatatcttaagatattcactgtagtgacaaaggagggagctggaagttgtgaagcttagaattctacactagcatactctgtaccctccatcccatcctcctattagaagtctaggaaaatctatcccatttaaatacaagcaacaggaaatgagaaagttctgcctacacacatggatactataggataaacaatgaaaaagagcagcatatattcctatagaatacgactaaaacctatctggaaatggcttcctcaaagcagatgaaagttataacttaacattgtaaaaagaattaaaaaaacaaacataaaactaacagaatcaaatccttgaaagatcaattatagttatgcaggaatactataaagctcaaatctaagaactcaagaaaaggtgaccagaaaacaggaagtgatggcctgaaaataggaggatatacaacgtgaatcaacctaactcactgaataaatagaaaaacaaaattctacaatgaagactaaattacaaggggcacattgaaggatagtcaccacagaaaacacaagaagagataagaaataaatgaaaagcacactcttggaaacagaagcaaaaaaagagattaaaatattgaaactagggcttcttgtagaaagggttattacacatctgagtatgggaatgtagaatgtgagcctagaacatctggtcatatggggaaaattggacattattacataatattagaagcatgcagcaatgtgctcaggtaacagttccttcttcaggctcccttgcaagaaaaggtggcgtttggccacagttcttgtcaataagatatgaattctgctttactgggaaagtttttgcttttctgatataattgtcaaccattttttcttcagttccccttctttctgtttatgtaatggacatgagactagtatctaaacagccatctcatacttgtgaggcaagttgtatgggcttagaagccaacaagctaggggagaggacagaaaaacaatacaaaggattgagctttctgtgtttgtttttcagtttattgaatgttttactgataggcaatattgaagtactgtcagatttaaaggatacaacttatattaaacacttcaggaagtcactggcgcttactaattgcaccattaatattagttcctctttatacctcttctcatctttaaatgtatagctgaatattaacagctacttttctccttatgtttcactgtttgtaaacaagtttttttttttaaatatgttgccggaagtcagggaccctgaatggagggaccagctgaagccatgtcagaagaacataaattgtgaagatttcatggacatttattagttccccaaattaatacttttatagtttcttatgcctgtctttactgcaatctctaaatataaattgtgaagatttcatggacacttatcacttccccaatcaatactcttgtgatttcctatgcctgtctttaatctcttaatctcatcatcttcataagctgaggatgaatgtcacctcaggaccctgtgatgattgtgttaactgcacaaattgtttaaacaatatgaaatctggggatcttgaaaaaagaacaggataacagcgatgttcagggaacaagggagataaccttaaagtctggctgcctgtgggccgggtggaacagagccgtatttctcttctttcaaaagcaaataggaaaaatattgctgaattctttttctcagcaaggaacatccctgagaagagaatgctttcccaagggggaggtctctgaaatggctgctttgggaacgtctgtcttttacggctgttgataagggatgaaataagccctggtctcccgtaacactcccaggcttattaggacaaggaaattcctgcctaataaattttggtcagaccggttgtctgctctcaaaccctgtctcctgataagatgttattattgaaaatgcctgcccgaaacttcattagcaattttaattccaccctggtcctgtgatctcaccctgcctccatttgccttgtgatattttattaccttgtgaagcatgtaatctctgtgacccacacactattcatacactccctcaccttttgaaaatcactaataaaaacttgctggttttgcggctcagggggcatcacggaacctgccgacatgtgatgtctcccccgggcacccagctttaaaatttctctcttttgtactccttccctttatttctcagaccggccaacacttagggaaaatagaaaagaacccacgaagaattatcaggggcgggttcccccgatatctggtgtgccaatgtggttttttctttttctcaagtgcatgtggcaacctgattccctttggtaggtgcagagaaacgtcatcggtttggtccacagatacgcatgtttgactccctgatgactgatgagtagtctgtgtatggtcggggttaactatgggtcacatggagtataaacattatacttatctcttctatattaaactctggttaaaacagaaaacggtccgagtgcccaagggaaatatgatcactctgttcagggcagtggtaaaattctgtccttggtttcctgaaaaaggaatcttagatgtagacctgttaaaacagggaagggtccgagtaaccatggaaaataaggtcactctattcagggcggtggaaaaatactgtccttggtatcctgaaaaaggaaccgtatatgtaaaagtatgggatcgtgtcggtgccacattctgggaactggtcttgacagggaattatgttcccgtcactgtttggggtgattgggccttggtatgtgccatcctaatacctcctcaactttcctctcccgcattgccttcatcatctgatcagcctctccctttgcctactcctcccccatttaacgatgctgagacttcaatatctaactccgatgactttggcttaatattacccctacttatcttacttcttttcatgaagggccagtacttgaagctcccgcagccccgactcacacagcccaggaccacagatattctaattcttctctcttcaaacctctggcatcagctaatggctgcaggaccaaactacaatttacctataattctccaggccctcccccatccactacagcccctcaccctcctgtcatttcggttcctcaaccagtctgcgtcgatatgcaccactcaatcttaccttttaaaaagaatttaaggatacttgtactcagtatggtgctacttctccttatgttaaaatggtattacaaactttttgtactgaggtcgtcttgcttcctttagactgggaccttttgacaaaagctgttctaaccccatctcagcctggtgggcagagaaggccagttttcaggctcagctaaatcgtactaacagcattctaattactcaggctcagctcacaggctccaatagtttctctgatgcttatggccaattaaactttgatgttcttaccacataacaagtaacaaaggtgtgtatgagagcttgggataaattacacaccccaggccaagctcttgtttcctgtactgctgttaaaaaagctcaattgcttttactacctaatatcgttttaaacaaaggagataagacacgtggccctgggatgggctctgtcagtgaaaaggctgcttattggattaatgtaatttctaaacaatggcccgcctccaccatccacattcaaggaaaaaagttttgagggcctagtacatactgaggctgaaaataatattccacataactcttatagtgctcccagtcaacatatgatggaaaacatgaggtttgttcctgggctgggtctcactccaaagcatgaagggattgttaaacccctcccagttactgtaaaagaaaacagggcgggtttaggttatcctttttaatggcggccgctgccatgccttctgatcctatccctttacaatggaaatctgacacacctatttggattcagcagtggccgctttctaaagaaaaactggaggatttaactcaattggtttctgaacagttacaacttggaaatgtgaaaccttctctttccccctggaattctcctgtgtttctagtaaaaaagaaatcaggcaagtggcggatggtaaccaatttaatggccattaatgctgtaattaaacctgtgggggcagtccaacctggcatgcctgcccctgcttcaatacctaaaaattggcctctcatagttattgattttaaagatttttttcatatacctttacataaatcagattgtgaaaaatttgcttttactgtaccgtctatcaataatcaggatcctgcagctcattatcaatggaaagtacttcctcagggaacactgaatagccctacaatctgccagctttatgttgaacaagtgctttcaccagttcgagcccaatttccccaggcctatgttcttcattatattgatgatattttaattgctgcccccactgataaagaattaattgaccattatcaaattttgagctgccttataacagagactggattacacatcactcagtataaaattcaacagaccgctcctgttcaatatttaggaatggtggtcgataaacaatgtattcaacctcaaaaagttcaatttaggagagattccttgaaaactttaaatggcttccaaaaacttttgggtgacattaattatttaagacctactttaggtattctgacctatgcgctgtctaacttgttttctatgctgcagggagattccaatctccacagtcccaggactttgacccctgaggcttcactagaactggaattagtaggggaaagaatacagaccacccagttatctagagtacagccgtttcagccttttcagcttctggttttcgcttcattacactcccctactggactaatagttcaacataatgattcagtggagtggtgttttcttcctcattctgtgtcaaaaactttgtctgtttatctggaccaaatagccatcttaattggacaggcagagtgtagaatacttaaaatttctagatttgatcctaatttaattgtagttcctttaaatcggcttgaaattcaagctgcctttcaacattccatactgtggcaaattcacgtggctgattttattggtgttattgataatcattatccaaagaagaaattgtttgattttataaaaaggacttcttgtgtggtccctcgattaatcaaagatcagcctattcctgaggccattacagtgttcactgatggctccagtaatggcaatgctggttatgcaggtcctacaaacaagcttatttctaccccttatacctctgctcaaaaggcagagttaattgctgtaattactgcctgacaggatttccccaaacctttaaatattgtctctgattctacttaacatgggaaagaggatatgcttgtgtttcaccaggagatcatcaaaagaaaagcaaagggaaaagatgtccatgtcagagactgccctcagaagtggtgagatctgtgccaactcctcagaagcaggcacaccaaatcacagtggatctgattcaatcctccctgatggcaatggagactcatctaactaatcccacttctcctgattacctttccttttcttcttacaaacctaaaaatctcaccatttctattagcctgaaaataacacccctctgttcttctcttcctccttcagcactcagtctcacttacaatgggttttatttaatgattctcctccttatactttctgtctcaccagtttcctctcacactgatttgcctgctacgcaaagttattcttattgggcttatgtgctttttcctctgcttattcgacctctcacctggatagatgctcctgcagaaatctacactaatgatagtgtgtggatgcctggaactacagatgaccgttgccctgctcaaccaggagaagaaggcactgcattgaatgttaccatgggttataaataccctctctgtgcctcagacatgcacctggttgtatccatctagatactcaagtctgggctgcttatcttctggagagatcagctacagaggaactgggacatttggtctctggcctctctctttcacctttaaaacaaatgaaagggggagtaatgggagataccccatactttcaatataaacctgcaggaaaaccatgccctaaaaattttgaggtcccatctaaaattttaatttgggaagattgtgttaactcacatgcagtaatattaaaaaatgactcacattgtttagtagtagactgggcaccaaagggctatttgaaaaacaattgctcctctggcagaggggaatgcgtggaggctacttattttacttcttattgggagaacgagaatcatcattctactttgcataggaggttcacctcattctttcccttaaaatgggaagataaaggcattacccccacaatgcctcatatgatactccccattctgagcccagaacacccaaaactttggaaattggctattgccatgtctggactgcaagtatgggaaggggtaactattctgtctgttgttcccactacaatccccctcactcagtatcaatgtagatccagacattctacttaacttacctccaacctgactgttcccatacagagttgtgttaagcctccttacatgctgttactgggaaatatcaaaatttggaagaacaatcaaactgtccaatgcattaattgtcatttgtacacttgtattaactcccattttgactccagaaaaagtgtaatattggttcgagctcgagaaagaatctggattctggtaactttgcccagaccttgggaatcctccccctcaatacatttaattaacgaagtgttacagcaaattctaaaaagatctaagagatttgttttcactttaatcgctgtgatcatgggcttaattacagtcactgcaatggccaccaaggccggaatggcgttacatcaatctattcaaatggctcattttattaatgattgacaagccaattccacccaaatgtgaagttctcaacaaggcattgatcaaaaattggctaatcaaattaatgatttaagacagtctgttatttggcttgcagatcgggtagtgagtctcaaacattgcatgtaaatgcagtgtgattggaatacttcagatttctgtatcaccccatattcctataacaagactgatcattcatgggaaatggtcaaaggacaccttctgggtaaggaagataatttatcattggacataattaattaaaaaaacaaatttttgaagcctctcaagctcacttatccatcgtgcctggagctgaggcattagatcaggtggcagaaaatctttatggactaaaccccacaacttggattaagtctgttggggcctccactctagtaaattttggaattacgtttctctgtttaatcggcttgtttttagtgtgccggaccagtcaaagaatcctgcatcaaaatcaagagaatgacaagccttcatcgccatggcacatttatataaaaagaaagggagagacgttgtgggaaatcagggaccctgaatggagggaccggctgaagccatggcagaagaacataaattgtgaagatttcatggacatttattagtttcccaaattaatagttttataatttcttacacctgtctttactgcaatctctgaacataaattgtgaagatttcatggacacttatcacttccccaatcaatactcttgtgatttcctatgcctgtcttaatttaatctcttaatcccatcacctttataagctgaggatgaatgtcgcctcaggaccctgtgattgcgttaactgcacaaattgtttaaacaatatgaaatctgggcatcttgaaaaaagaacaggataacagtgatgttcaaggaacaagggagataaccttaaagtctggctgcctgtgggccgggtggaacagagccgtatttctcttctttcaaaagcaaataggaaaaatattgctgaattctttttttcagcaaggaacatccctgagaaagagaatgctttcccaaggggaggtctctgaaatgtccgctttgggaacgtctgtcttttacggctgttgataagggatgaaataagccccggtctcccgtaacactcccaggcttattaggacaaggaaattcctgcctaataaattttggtcagaccggttgtctgctctcaaaccctgtctcctgataagatgttattattgaaaatgcctgcccgaaacttcattagcaattttaattccaccctggtcctgtgatctcaccgtgtctccatttgccttgtgatattttattaccttgtgaagcatgtgatctctgtgacccacaccatattcgtacactccctccccttttgaaaatcactaataaaaacttgctggttttgcggctcggggggcatcacggaacctgccgacatgtgatgtctcccctggacatccagctttaaaatttctctcttttgtactccttccctttatttctcagaccagctgacacttagggaaaatagaaaaggacccacgttgaatattggggactggtttcccccaatataaataaaatggtcagtcacacatagggcctcctagaaggagctgcgaacagaggcagtatggcacagtaaatggagcacagaatccttcataaaaaaccctgtctttgaattcaaatttaacaggaaagactgtgtattcttggaataacttatttaacttaacccctgttagcatcaatattctcaagatgattcatataacacccctcatggtattgtctggcaatgtgtgatgctcaattattgacaacagtaacgaagagtttggtgttctcttgtagtcttgaaaaatattacctcaataacacaggtactttggaggaaaagtatttaaactctttgtgccccagttccttatttgttaaagggaaagactaatgatacgatgttacaggctgtatgatggattaaataatacaatccatataaacataaaacaaatgtgtaatgaatgctaactcttatacactcaatatggtatcaatattatttctccaaagaactgacctagcctggattctgatttctttcagtttttttttttttttttttagaacaaacagaacctattctctaaagaaaacagactatacatcatgagagcaggcccctaccttcctgacatatgtgtgtgccaattagagtagagcatcccagccttgcctcaacttcactactgggaatttggaggccttccaatggactcctgtgctgtggctagtacagatcatacactgctccatacagagagatgcaatgagatcactatctccctttctactcactgataaccatcactcaccatatagagtcattttctgctttccagggtattctaaaggtctcgatgctcaaaacacagtaatgttagggccatgctttgaagagaagcatcttgtgctaacattaaagatgtacacacatgcaaaggttctgaaaaatttagaaaatcataaggaaaatacccagcatctgggttttttggaccagcaggatgatttagtattccaagtttttatgactaatatcagcattaattttttagcactttttttatatatgcttgttctctctatctctttctctctctctctccaactgaggttataagagggatagaaagtcttaaacagaaatcggtttccaagagctgaaagcttttggatttaaagccatgcttttaagctggatttttttttgttcattagcactctagtgcctgaggacttactgggttggtaatgtcaagttcaacaaagaggcaacagtaaaatatgcattgattgtagtgacacattttctttcctggtttccttttgaatgagttcagagatttttcactgtggacatcactccatccttctatagtccctggagcctgatccccaatttcagctaattcctgggaatataagtgtggatctcatagggccaaaattctgttttcacctgataaggaagcaatgagttttcaagcccaagttaatctcaatcctgaatttttttttgaaaagcaagtagaatctgaagtcactaaaggatctagagcttctttcagaccaaacccagtctcaactccccccttaaactgcttaacttctaggaagatgtacacatgtttatttttgttggagggggcatgccaaggtccttcatatacttggatcatttccagaccaaaaaaaatttcctcttcaacctaactggtaggaacagtggttcaggaaagatttaattatccagtgagacacaattaatagatgtttcaatggagtttgcaatcttagtgcctattcgaaaagtttaatcttaatgatggggaggtgagagatgctttggaaaatggtctggaaagcaggatgatttttattttaagatttggatatggctgagcctgagggcgtgaaaagccactttttaatttgaatagcactaactttgggggaatgcatattatccaagggtacttgattctgtcacagatgctgcaacagtttgggaaaactatttggaagccttaataagcacagtccccaaacaacaaagctttagccacagcccatacatcaagaaaaaagacaatagatgatgctttaaaataatttatcattttgtatgaaagtaagaaaatgagggagaattttattatataacagtaatggacactctattttttcttatgcattctgtgaggtctcccccaactgagctgtttgctatttccccaagagggcacacatttccattctgatttatgggagcagagactgtcttattcatctgtgctggatattctccatttgtccctcaagatctgttctcctcccttctccaccatgtgctgctgggggctaaccacaattaactacatcaattgggctctatcgctctttggtaaagtgagacaccaacaggcaactaaggtatttaatctagcctcttccctcctaggtcaagatttggcaatggctactttcctctcccaaggacttttgttcctattgaatgactctctcctataactataggccttcttgggagtccagtggctgactcctccggaatcttcatgactagcagctatatatgctctctttttactaccactgcactcctttaccgtcccttactgtttttccttaactctgcccatatattatgttttttaaaatatctcttcaattaaaactctctgggtggctgctgcttcctgccaggaaactgataccattctctacctggcacagtgcctagtccattatcagcacttaataaatgcttccagctattatttttttaatatatgtatatataaacaacatggttaatacctttaaatcagatttttttcgatttcaagcaaggggcattttcatgttaaggtattttcagtactggagaatttctagtctttgcctttataaactaaagtttaaggactgtgattctgaagacttgaggactgatacatgggtgcatttcaaaagttcaaagcttaaaacagaaaaatcataaaaatttcatttaaactaactcgaataagcattaacttttttttcactgtggcagaatttatcaaaataaggatctataaccagttggttgaggtctgaaactctttgcatttttattttattagttttggggatatattcactgttacaagatatgactttgagcttttaagacccacatctatatgagccaaaaaagagagtcagtattaatatgtccaattctatgatgttattaaggactgtgatgaaagatgtcttattctcagatggaggtttcacaaaccaggaaaattacctgactttaccactatatttagggaggaaaactagcatatcaagaattgttgctatgtcattagatatttgtcctgaagggaatgttctccagagataactggcatagtaccatctgaagagctgtttaaaatgcagattttcaggctctaatgaggacctagtgaatgcaaacacctggggagatgaccttggtaaatagaatattaattttattaactgccccaggttataacactgcatatcaagtttgagaacctttgcaataataagtcacactgaaagaccctttctatgggaggaatagatcttaaaaattgatctatttaaaaatcaaagaaaggctaatgtacaaaataaagcttttaaaaaacaaatttggaatgacaattttgatgtagcttgccatgaaattaggatcaattgtcaaatttaaagttggctgttatttaaattaggggatgcctagaattccataacaaatataattattatgatgacattttaagaaatttaaggaatgacccttgcctctccacttattcattgtaacatagcactttctacctcctgttagttatttttccatgtgcctaatctttgctgatagtttgtgatttctttgaaagcagggatcatgcctcctatgttttatattatctatagttcctagtttctagcacagtatctgacttatggtaggattataatagatattaattgaaagaatgaatgagtgaagaacatcatattttgagaataatattaagtgtgtatgtctgtgtgtgtataagatgtttaaggagtaaaagtttcaataacaaaatgctaaatactacaacatagtgttctcagggagaatgcctcatggtagctagaatagtaatatagttattaaactatctaagtaagtaaaaaagttaaccttaagctgtaccttaaagtttgtaagatatttgactaagggaagaagttccaacagggaacgacatgcaaatggctgaagatgatggttccagatgagtcaaatgttacaataaaaatgtggagaacaataatgatggcaaataaaaagctgaatacttgacaggatgtaggattgaagaggagaaagagagctgagcaagtgaaggttgtttgggtttggagagttcaaagaacctaggaagtcctggcttgatcctgtaagtaactagcaaccactcaaagcatgtgatgaagagggaagggttgagatgtagttgtctttcttctcattgtctgtgccatagggaatggatggtagagaggacataatgagttttaaattatctaggcctcatggtctctttcagatgagtacaaatgaataggaaagaagtaacatttctttgtgtttcccttctcatcatgagcccagggcataagcaaggctgtggaaaagcttgatgtctagaaaaatgtaggtaagtagaagcaatgggcaccggccctcagtctctacttctttggatacctttaccttgtaagttcccacaatctacaactctctatgggcatagacttcttcagagaatgatttgaaaaccaaaaccaaaaccaaaactcttattatttggaaagaagcatggggagattgtctttggcccaaataaatacctcaattttatttttgtctgatgaatgaaatgtgttaaggtagttgcacagagtaaagtgacagtgttaaaatcatgacattttcccctccataagtccagtcttatgagtaatgggagactcactaaatggcaaacacatccctttgctggagaaaagaaagagtgtcacatattctgaacaggagaacaagttatagagcaaaatatgccacagtgagggtgggtgacattgtgaacctagaaaataagttacccaaatgggttttctaccctagagagatgtgactgcatttctttctatcatgcttactctcagattttcactcgtgtttccaatgcacttggcaaactgaggtcctaagtcagacctaagatggtctattaataaactgctttcaggatagatagcataacccacctgcatactacactgtttgcatatacatctgactgatgggagccaatcaaaacacaggacatctgtgcttttgctgtagtgcaagagaaaaatatcactgtttcctacgggaagacattaaagattaacgtgtcaccaagtcaagctctgagtaaagttaactccagggaaagagctttctagggctgtgcagacactactttctaaatatctctgaggtcacagaggtcgtctaattccaattccaatgatgtctagtgacagaagtttctcagcactcaggcaatttagggaacaatcagccagacaatatgggggtgctcatgacgagacgcctgcagctgaggtaacacccagctgtgattgtatttccctctgtttggataacacaattcgttcctattgcattcactgaaatagactgccaaagaaatggccagtttgaaggaacacacactaaaataaataaataagcattccagaattaatattgagaacagtgcaacagcaagaacatatttccaaataggcagaataaaacagcagtaagtcgagaagagatttgatcttgctaggttgtggcatcatctcacatgaacacacagaactgtgggtacaagggtggggacgaaacttccattgcaaaattataaatttctgagtaatgtcaaatgttaagcaccatacactccccaaggcagccaccaatctttcagtagcttccattatttctgattttccccctcttttaagtttctacttgcacaagataaaaataagccagactggtttaatgtttaaatcttaatattattacatataatatatattcccctcaggaaatgggtttggttgataaatgaagagctttgctcatttttcctcttaatgtggatgtgattacagaaaatgcaggatgaacttattgtcatatttttgacagtgatattaatgataattatacagctgatttttgtaacagggtttccttttttttaacatgccatttctggcacgtcagaggttatggtaaggtggatgctgtgtggaatttaggcagataaagggatgaaaaattcaggttttgaaatgatgttttaactcaagaatttcatttacttataaagcataaccaatggcattaatgtaggagagtcctttaccaaaacctggctacctatatcttatctttaatattaggaaaatgatggaggagcctgaacttaggacacccatctttccttctttgtgtgattcccttaaaatactcccattattcatgtttcagccatgagacataactttcaagtgttccacatatggcaacaatgtcacgcttttccaacatggaaagccttcttccttgatttttcataggaaaaaaatctggtagagaaaatataaaacgtgaaaaacatgtagaaatattgacagcctttctgctgccactcatattttttcacacatcctcagctaaccccgcatttcaatttatctgtcagaaagttatcacgtttttatgtaaactgatagatagaaaataagcttagaattttaccgagctgaatttgaaaatctagaatttacatttatgaattgatataatctacccacaaaggagctggttaacaggttcatcaaaaacaaagtaataacatgaaaagggaactgtagtgtggtttatttcttactcttttgaagtatgactaaaatatgactcacagcctcctaccctacattctgtagagctgttaactcttggagttaagattcaataagaatctgagggagaagggaagccggtagaaatgtgacaggtacagggtcatttattctcttatggcatactttattctttacaggacagttacagatcacagctgtttcatttgcacccttgttattaaggtgataggggcagacagtaggccttcagaaggaaagcttctatcaaagggatctcagacaagtttcagtttatttgattctaacctagattcattcttttctatgaataacacctaaacaattttgcccaatgacattttaaaaacaataaaaccatgttttaaaagcaacactgatgtgaatttggtcactgaatatagcagcttcctacttcaaaaaaaaaagattcctcttattattttccttatttaatgcttgagttggtgctttcagtctccgtctagtactccagtgagggtgcactagggctgaagactctggttggtaatccaagacttcatgcttcagctgctgaggttaccaaaaggagcatatagggatcaaagaaacgtattcatgcttattagatggaaaggaacagctgattcccagagccatagctgggccacctcaagctggagtaattcatctaaaaaaagacatggtttgtcagccaggataagggtaattgtaaagataaaagggatgctcatgagcaagcagggagggtatctacaaagaactagggggaacccaaaagatagatgggaaacagaaggggctatatagctccacgatgaacaagtgagctattccccactgtgtcggggggaaataatgctggagtgaaaaattccccacaacaaaatacagtgctgaaaagaggatttcagtcatttattctgctcctgcgtctcttcttctttttttttaaatttaaaaacaatcatgaaactatagtttctctgtctttttttctgccctttgttggggggtgggtgaggggttattggctttattttccccaataagaaagcaaaaactagtgaataggaatttgaaaagcatttgcccagatagcttggaatactttacccacacacatatatttttacattttattcacttttaaaatttataggcagtagaaatcatacttgttgtgcattcccaataatttgataaatgtatatgcttgagtaacaatgacaagaaacaaaatccaagagttctgtcaagcccacaatttcccttatgctgtccatttaaattcaatctctgtccattcaccagcaaactctgatttttaaaaaaatttaaaaatgtttctatacatttacatttaccaaaatgtcataaaaataaaatgatatagtatgtacatttttttttagtctggcatctttcatttagcacaatacatttgagatttatcatgttgttgtatatatcaaaagttctttctttttatagctgaatagtattccattgtatggatgtatcagtttatccattcattagttgaaggaatttgagctatttctaatttttggtgattgtgaagcaagccattataaacatgaatatgcaggtttgtatgtgaacataaatttgtatttatcttggataagtacctgggagtgagattgctgtattgtatggtaagtgtatgggtacttttataagaaactaacaaactattatcccatgtgaatgtacctctttaaaaattcctaccagtaatgtctgagatttacagttgctctgcacctgctccagaacttgttgttatatttgttgctcttcttaaacattttaatgggattatttgccatctatatgttttccttgttgaatgatttattaaattttttttagttttattattactgagtttgagagttctttgaatattctagatatgagtactttgtgaaatatgttttttgcaaatgttttctcctagtctgtggcttaaaattctattcttttatttattttatttattttttatttttttgagacagagtttatctcttattgcccaggctggaatgcaatggcataatcttggctcattgctacctccgcctcctgggttcaagcagttctcctgcctcagcctcccgaggagctgggattacaggcgctcgccaccacatctggctaatttttttttttttttgtatttttaatagagacggggtttcaccgtcttggccaagctagtttggaactcctggcctcaggtggtacgcccgtctcggcttcccaaagtgctgggattacaggcatgagccaccgcgcctggccaaaaattttattcttttaacagtgtctttcagaagcagagattcttactttcagtgagatagactttactaatatttttcttaatggattttgctttgtgtcatatctaagaaatctgcctagcccaaggtagcaaaaattttctaccttgtttttccctagaagttttatagttttaaggtttatatttagtcgtatgatccattttgtgttcacttgtgcaaggtatacattgaggcttatttattcatttacttttgtatacggatatccaaaacatataaaagtctagcacatgcattatttatagtatataatacttgctaatgataataaatgactatgttgttagttaacatatttactgcactatatattgtatctttattttacaatatactccttctacttataaaaataggttaactataaaatagcctcaggcaggtcatttaggagctattttagaaaaaggcatcgttatcacaggagataacagctccatgtgtgtcattgcccctgaagacctctcggtgagacaagatgtggaggtgaaagacagtgacactgatgatcctgaccctgtgtacacctaggctaatgtgtgtgttcttgtcttactttttagtaatacagtttaagaagtaaaaaaaaaaaattaaatagaagaaagcttataaagtacagagaaagtatttctgtacaacagctgtaaaatgtttttgcgttttaatctaattgttattataaaaagtcaaatagttaaaaaataaaaaagtttataaacttttatttaaaaaatttaatttagaaaattacagtaagctagtgttattatcaaagaaaaatattttctataaatttagtgtagcctaagtgtacaactatttataaagtctacagtagagcacagtaatgtcttaggccttcatatccactcactactcactcactgactcacccagagcaacatccagtcctgcaacctccattcatagtaagtatactacacatgcctaccgttttttatctgttatatcatatttttactgtacctttctatgtttagatacacaaatccttgccattgtgttgcagttgtctgtaatattcagtacagtaatatcctggacaggtttgtagcctaggagcaataagctatatcatatagcctaggtctgtagtaggctaaaccatctaggtttgtgtaagtacaatctatgacatttgcacaacaaaaatgtctaataaaacatttctcacatatgcaaaagattattataaatttgctaaggatacattagaaaaatatcctgttatttaggtatttacatgggctttcctgtatctctttttatattctgataagtaagggttgaaatgaggcagcaaaaccacatctttgcaatagaggtaaagctagttaggtttatctgaaccaaatatcactattttctgatttaggttcatcaacttactttttcccacctaaaaattgtatgacagtagtcatttcgtgtatttttgaagttaatactcacagtaagaattcatctttgcagagctgcttttttcagccagctgactgaccacaacgcaagtgaagacattgcatggtatctatctactaggccattggtcagcttccataattactaattgatcagtaaccagcaaattgaaactataggcatttggttcaacatttttatttcacagtgtcaaatttttataaaaggaattatgaatttaaaactctgcagtggaaaaacttattttctttgcatctaatatgtgcatattaattttaaaagacaaaatattgtcagatttatgaaattaccatataacccaactttctgcggagcagacagatgatagacaatgacaagccagaaggtaactctaggatgaccctttcaaagtggtagctataattgaattttcactgatgaacacctccaacctccaacagtctattgctatcgctgaggaaacacgttcattcatctccttactttccagccttctgaatctagtcctttccctttcctgtaaatatacataaactgtgtttaggtggtctagacagatcccaggaaagggcagagtaaatgttcatgagaatgtaaattgtggttgtttattaagaaataaaattctgttgaaaaaatttaagaaaagaatgtggatgttgtctagatagggtgaatatatacctcattgtccaaactcagacaattttgcaagtaaaagggggtatgattaattacaattagataacaggtataaattgaaagtgttccatgcaaaatgaaacatctgtcaccatttttaggacacctgataaaatagaaaacagtggctattgagtagagatcctgagagggagaaacaaaacagtcaagaaaaaagacaaaaaaaaccttttcaactttctgtaagctaattaaccttatctagaaattcataatgtggtatacagagtctcttagataaaaaatttgcattcaacaagttattttattactttattgagaagaggggaaaaagattctcgttgtgtgtattcatgatatccctgccttatttgttattccactcattcatttgatcatttcagaagtatttattgaagttcttaactatgtgccaggactgagtaaggtgctggcaatggcaaattgattaattcaaatacagactctgtcttagtagagattattctctttaagggttcaaataagggttgaaaacaattaatcagtcaaataatttttggtaaagtttaaaactaagggagcatatagtaatggcacctactaagacttcaatatctctggcaaggtttctctgacaaaatgacatttaatctgagacctggaagatgaataaaatttagccatataatatcctggagggggcagagtatacaggcaggagaatgagtatgtgctaagaccccaaagagacacagcatggcaattcaagtaactgcaaaaaattcagtataactagagcttgtttttttttgaaaaatagtgaaagatcaagctggtaagcaaagccagaccataaaaagctaggcaagccatgttcaataaatttgacttaatcctaaaggactgggaagacactgaagaattttaagcaatgaagtgacatcagataattatgttacaaaaaggagtgctgtttcggtttgacagctgaatggtggggtacaaacaggagaataattaggtgatttttgaagtaatcatagaagtgattgtagtaggatgcaaaatttgattcaggagtatttaggtaatcccactgaattgcacacttacaaatagttataattgcaaagcttatgttatatatattttacaaaaataaaaagaaatatttagtaaatcagatctagaggacttgttgagattttagttgtaggaactgtggggcttattgagaaggacacacaaatctaaggtagtgagttgttgatggggctatactttgaaatacggaaaatcagagaagaagcaaagttcaagatttgaaaacagttgaagacagctctagtttgttgtatgacacttcttactttaattttatttatttcagtttagttcataattgaggaactacttgaataattctctaaaaacatttaaaaagtcaaagttgtattattcacttcaacttagctttcatcatgtcgatcacagtaataggctgcaaattttttgccattacaaagactatcaataaggtcaaatgtattcatgaataatgaccttgaatgtgaggtaagcaatgaaggtgagtgagacttccaaaataattcaattttcatggtagcatagagaatgcaacctcaataaattataaaatatgccaacgttggaaattagattattgtggcaagctgataatactcatacactcccccatccatgtaatattttaaaaaataacagaaaatggcagatatccatggaatgttggtaaacaagaactggtaggataagtggctcataaatttagaaaaatttctagaagctgggaaaaaaggaagaagttgattaataaaagaggaaacatcaaatatgaactgaaaataattccagagaaataaaaacaaatactgaaaccaaaatcaaattagaaataaaataatggagaagattcttcaagacagttatcagagtaattaaagaaatgcactctgaacagacgaagtgtaaaaccttcttgttccatcctacacagcagttcagttcatattctgaaccttgcttctcattataaatactcagtttttaaaaacactgatgctcgggcctctctcctggaaattctgagttaggtgttttgaattgaagtatgagtattgaaatttcctaaaagtttcctggttggttcctatgtgcagtcaatgttcacaccactgcactaaaaagaataaattacttttctcttttcttgcttttaattttttacacactcatttgtttttgtttcttatctcttttttcagttattttttcattaaccataaaatgcatgtgtgtgtgcacgcacgtgtgtgcacctgtgtatggatatgtatgtgtcccctaacattattgcccagaggtgcaatggtgtcaagtaaacacttctttttcaaaacacaaacatctcactgaaactggaatttttggagggctacagaatgattggaacacgcaaagcataagactcttaatttatgattaagagtcttgcccaggctaccaaaaatggacttagttcctaaaataactagccagttcatcaacagaatttggaaaaacttctagaagaaataaatgggtaatgactcaccacttgtgcctatctatcccctaaatctttccgtttagtactgtctgattaaacatttgcaaattattaagtcctcaattttagacacttaatcgggtaaaagtgcaggtgttgattctgagacaaaacttgacatttatttcctataagtgatattgaaagtgaaaataaagcaaagtctaatttcaaataggaccaacaataagaatgcagttgtttattctctgagaattttttttcttcaacttttaagtttggggtgcacgcacaggatgtgtaggtttgttacatacgtaaacgtgtgccaaggttgtttgctgcacagatcatcccatcacctgggtattaagcccagcatccactagctattcttccttatggtctccctcccccaacccctgacaggccccagtgtgtgttgtttccccttacccacgtgttcatgtgttctcatcatccagaattaacccaaatgcccatcagttatagactggataaagaaactgtggtacatatacaccatggaatactatgcagccataaaaaggaacacagtcatgtcctttgcagagacatggatggagtgggaagccattatcctcagcaaactaatgcaggaacagaaaaccaaataaatcgtttttctagagaagactcttattcatgtagaattagagaagagtagaacaagaggtaactcagaatccccccaaataaacatacagaggaggaataaatagatagacaggactttaaggaggtaaattcacttaataccttatacatcagaggaaaaggctccttattttagcgaatgaaggtcttcattatgtcccctacttagaaccttggcctgattgttgctacttcttgcctttacacaccaggcctgcagttacccctacaggaggggaagcagacacatgcagctgcaaagaaaatccacattggttgtttcttatcggcaacataaccttcttttcctctaatgtatttttttaaaactttggtgctcatgttgtacattagatctctaaacttgttcaacctacatatgtgctattttgtcctttgacctacatcttcctatttcctcccaccaacaccggcccatagtaaccactgtttcattttttatctctatgtatttaagctcatttaaaaaatatcccacatataagtgagatcatacaatatatttttgctggatctggcttatttcccttagcataatctcctccaggtccacccatgttgtggaaaatggtagaatctccttttgtaattaaagctgaatagtattccattgtgtatatatatatgtgtgtgtgtgtgcgtgtgtgtgtgattcatatatgtgtgtatgtgtgtgagacaatattccattataatattccattgtgtatatatacatagtctacataaacaatggaatattataatgaaatatgattatatatatttacaccacactttctttatccatttgtccatcaattgacatttaggtagttttcatatcttggttattgtgaataatgctgcaatgaacatgggagtgcacatatctttatgaggtggtgatttcatctcttttgggtatatacacagaagagagattgttggttgtatggtagttctttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtacatgtgccacattttcttaatccagtctatcattgttggacatttgggttggttccaagtctttgctattgtgaatagtgccgcaataaacatacgtgtgcatgtatctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggttgtatggtagttctatttttaatttctttagaaccctccataatgtttttcattgtctttaatttataaaaattaattgaaaatcatgactcacttggcaaggaggaaaactgacagcattaaaaagaaatatcttgaaagcaaaaaggggaaaaaagaaaactccctctgaaacagtaaatttagaattagaatggaaattctaagtggctaattagtaccctaagagagattctaagatattaaattgatacaggagcaagttgcaataaaaaatgaacaaaaattaagaaggctcccataaaataattatgtgcatgtatatgatgataagaatgaagatctgatcaatagaatggacacagctgaaaattcgttaggaatatgatggtaagaagaaaaccctcattacatgactaaaatggaagaagcatgttttagtccattttctgttgcttataacaaaataaccgaaactgggtaatttataaagaaaatgaatttatttattacagttttggaggttgagaagtccagagttgaggggccacatctgatgacagccatctcgctggggggtaatctttgcagactctctagacagctcagggcatcacatggtgaggagactgagcattcttgctcaggtctttcttccctttcttataaagccactagtttcacaccttcatgatgcattaattcattaatccatgaatagatgatttcatttatgagggcagatccctcacaacctaattatctgttaaagaccccacctttcaatactaccattttggggattaaattttaatatgagctttggaggggactaatattcaaccatagcaaggcataaaaacatgaaaaaagtaaaacaacaaaagtctacagacatagagaattagcgtttgtcttctagaatacatctaaagggaattccagaatattaaaactacaccaagtttaaacaaaagaaaagaaataagaagtgctctaataataaataagagaaacacatttacaagagttggataaagacaaatatctccagggtttaaatgtcaaaagatgaatgtaaaaagatccagcactagtgacctaatctagcaaaatttcagaattaaaagaaacaaagagaaattctataagcatgggtctgggtcggggtaggaaagaacctatctataaaattgcaaatatatgtttgggacctgatttttcatcattgacagcagaagttagaaggcaatgatctgacatcttcaaagtttgtgataagatgatttggcatctgaattctacatcaaatcaactaagcaaaattatgacatttttcatgagataaatatttaaaaatgttaatacatatacggcttagctgtatgaattagccaaagcttatacacattcaccaaatgaataaaaatataggaacattgtatatttccaggaatttatccatctcctctaggttttctaatttgtgcacatacagttgttcatagtatccttgaatgaccttttatatttctgtggtatcagttgtgatatctcacatttcatttctaattgagcttatctgaatcttctctctccttttcttggttaatttcactaatggtctattggttttgttttttcaaagaactatttgtttcatttatcttttgtatttctttgtttcaatttcatttagttctgctcgatctttgttatttctttcttctgcctggtttgggtttggtttgttcttgtttctctagttccttgtttgaggttagatggcctatttgtgctctttcagagtttttgatgtaggcatttaatgctatagactttcctcctagcaccgtttttgctgtatcccagaggttttgataggttgtgtcattattatcattcagttcaaagaattttttaaatttccatcttaatttcattgttgacccaaagatcattcaggagcagattgtttaatttccatgtatatgtatagttttgagggttccttttttagttaatttccaattttattccactgtggtctgagagagtacttgaccaaaagaaatagaaactctgaacagacaaataacaagtagtgatattgaaacagtaataaaaaatttgcgaacaacaaaaagtccaggaccagatggattcacagaagaattctatcagacattcaaagaagaattggtaccaatactactgaaactattccacaagatagagaaagaaggaatcctccctaaatcattctatgaagccagtattaccctaataccaaacccaggaaaagacataacaaaaaaagaaaaccacagaacaatattcctgatgaacacaggtacaaatatcctcaaaaaatactagctaatagaatccaacagcacgtcaaaaagataatcctccataatcaagcgtgtttcataccagggatgcagtcatggtttaacatacacaagtcaataaatgtacacaagtcaataaatgtgatacaccacataaacagaattaaaaactatcacatgatcacctcaatagatgtagaaaaaacatttgacaaaatccagtatccctttatgattaaaaccttcagcaaaatcagcacagaaagaacataccttaagataataaaagccatctatgacaagcccacagccaacattatactaaatggagaaaagatgaaagcattccccctgagaactgaaacaagtaaaggaggcccactttcagcacttctattcaacatagtactggaattcctagtcagagaaattggacaagagaaagaaataaaggacatcaaaattggtaaagaggaagtcaaactgtcgctgttcaccaatgctatgattgtagactgaaaacctcatccaaaaagctgctggacctgataaataaattcagtagagtttcaggatgcaaaatcaatgtacacaaatcagtagcacttctatacacaaacagtaaccaagctgagaatcaaatcaagaactcaaccccttttaccacagctgcaaaataaataaaatacttaggactacacctacccaagaaggtgaaagatctctacaagaaaaactacaaaacactgctgaaagaaatcatagatgacacaaacaaatggaaacacatcccatgctcatggatgggtagaatcaatattgtgaaaatgaccatactgccaaaagcaatctatacatttgatgcaattcccatcaaaatatcatcattattcttcctagaactagaaaaaaacattcctaacattcatatgttaccaaaaaagagactgcatagccaaagtaagactaagcaagaagaacaaatctggaggcttcacattacctgacttcaaactacattagaaggctatagttaccaaaacagcatggtacttgtataaaagcagggacatagaccaatggaatattatagagaaataaagccaagtacttaacagccaactgatcttcgacaaagcaaacaaaaatatgaagtggggaaaggactccctattcaacaaatggtgctgggataattggcaagccacatgcagaagaatgaaactagatcctcacctctcaccttgtacaaaaatcaactcaggatggatgaaagacttaaatctaagacctgaaaccataaattctagaagataacagtggaaaaagcgttctagacattgccttaggcaaagaattcatgaccaataacccagaagcaaatgcaacaaaaataaaagtaaatagatgagacctaatgaaacttaaaagcttctgcacagcaaaagaaataattagcaaagtaaacagataacccacaaagtgggagaaaatattctcaaataatcatcgcaaatatgcatctgacaaaggactaatagtcagaatttataaggaaatcaaaaaatcagcaagaaaaaaacaatctcagcaaaaagtgggctaaggacatgaacagacaattctcaaaagaagatatgcaaaccaccaacaaagatatgaaaaaaggctcaacatcattaattatcaggaaaatgcaaatcaaaaccacaatgtgatacaaccttactgctataagaatggccataactaaaaactcaaaaaataatagttgttagggtggatgtggtgaaaagggaacacttttacactgctggtgggaatgtaaactagtacaactactatggaagacagtatggagactccttaaagacctaaaggtagaactaccatttgatccagcaatcccactactgggtatctcttagatattaagagatattaacagatattactatgtcatagaactgttaatcttgcatagtaaactttttgttgttgtttgaaacagagtctcactctgtcgccaggttggagtgcagtggcgcgatcttggctcacctcaacctccacctcccgggttcaagcgattctcctggctcagccccccgagtagctgggactacagctgcctgccaccaagcccagctactttttgtatttttagtagagacagagtttcaccatattggccagactggtctcaaactcctgaccttgtaatccacccgccttggcctctcaaagtgctgagattacaggcgtgagccactgtgcccggcccagtaacattaattactgatatatagtaattatagtataactaatagtataaattatagtgacatagtaatccattaagtaattgtctatattttttcataatttataatgaaaatgtgttaatttagatgaaacagagtacaatggaataatataagtaattactagaagaagaaaataggacacaagaatttcaacacagagcttaaaagggaataaattaatattgataaatataaaagaatcacaacatgtttactattgcttacagaaagaaagtggatagtgcaatacggatctcatacaagatagagttgatgataaatgcagtaagtggacataatggcttatttcatattgtcaaaaattgtagtccaagagaacacagtagtcctgaatattattgtccttaataatctggctttaacaaaactttaggtaaaatatgaataattattgtaagaaaaaattaaccaacttgccatcttagtaggatattcattaaaattgatggaccaagtagaccaaaaataaataatgatatggaagatgtaaataacataagtcaaaagggtgagtacacagaataaatagttttcaaacatgcttggaaaaattatgtacaataactcaaaacaatatttaaaaattattttaaaaagggaagaaaggaaaaacctctataagttacattcacccaatctaatgcaatgaaaatgaaaaatgcaacaagatagattttaattccaaactactttttatgaagtttaataataataaagcattgataatataaatacgattaagtctataatagaaattaatacagaaatgagtaaaagtgtacctcatttcaaaattttggaaggaggtcaaataggaattcatgaaaaaaatttacagcctcaagcacaagtattttttatgtataacttctaacgttaaaatatttttcaaatatataaaaatatataaattagaattaaaaagaagaaaagtaagatagtagaaatataaataaacgaattattaaaaatggatgaagaaaccaaatgttgctttttgaaaagatcaataaaatagttttattatgtttattttgagatcaggaatgaacagagaaaaatgtgtgtgataaagacataaaaagagtgagcacatgcgtagaatgataaatgacagccaaatgtatggaagatactataaaaattttttaaaaatatttacctttatcatatcaaagcatgtgaaaatttagggaaaaatattttattctgaaataatataaatcactcaaatataggtcaaaattatagaaaacatgaatatataagaaaccaggcttaaaaactttaagacttaaagatggcaagacctgaagccataaaattccttgaagaaaacacacacacaaaaatttcttgacattggtctgggcaattctgttttggatatagcaccaaaagcacagacaacaaaaggtaaaataaacaaatgagactacatcaaactaaaaagtttgattcaaagtaaacaacaaaacaaaaggcaagttatggaataggagaaaatatctgcaaactgtatatctgctaaggggttaatattcaaaatctgtaatagactcatgcaattcaatagcaaaaatcaaacaacatgtaacccagttaaaaatgtgcaaacttctaatatatactaaaatattttagtgttttggatatattttagatatttaatgtttttagtgcaaaggacctcaatagacctttttccaaagaagacattcaacacgtgggcaataggaatgtgaaaaggcatgtgacgtcactatttatcagagaaattcaagtcaacacgacaatgagatacctcacaccttttagaatggctattatcaaaaagacaagagatagcaagtgttggtcagggtgtggagaaaagggaaccctttgtacactgttggtgagaatgtaaattggtacacacattaaggaaaacagtatggagggttctaaaaaaaaaattaaaagtaaccaccacacaacccagcaatcccaattctgaatatatatctaaaggatatgaattcaatatttcaaagagatatttgcatctctgtgttcactggagcattattcacaataactaatatatgaaaaactccaagtgtcaattgatagatgaatgggtaaagaaaatgtaacacatacacacactcacacatacacaatggaaagaagacaaggaagaaaatcctgccatttgtgaccatgtgaatgaacctggaggacattatgttatgtgaaataagcaagatacagaaagacaaatactatatgatatcacttatgtggaatctaaaagagtaaccctcatagaagcagaaactgtagtggtggttgccatgggctggaagataggagaaatgggaagatgttggtcaaaggatccctacaaactttcagttataagatgaataagttctggggatctaatgtacaacatggtaactatagttaataataaagaattgaattaacttgaattaaatttcaagttaataaaactggacatttgcttagacagtagatcttatgaatccacagcacatcttatgtaccctcagcgcacacacacacacacacacacacacagaaaatgataatcatgtgaagtgatggatgtagtaagcataatcattgtggtaatcatttcaaaatgtatgtgtatatcaaatcattatgttgtatgccttgaatatataacatttttattatctattttacctcaataaagctggggaaaagaagcagcaactaggcaataaataaaaagctgataaaatctctaccctaggccgggcgcagtggctcacgcctgtaatcccagcactttgggaggccgagacgggcggatcatctgaggtcaggagttccagaccagcctgaccaacatggagaaacctcgtgtccactaaaaatacaaaattagcaaggcatgctggtgcatgcctgtaatcccatctactcgggaggctgaggcaggagaattgcttgaacccaggagacagaggttgcggtgagccgagatgtgccattgcactccagcctgtgcaacaagagtgaaactctgtctccagtatatatatatatgtatatgtatatatgtgtgtatatatatatgtgtgtatatatatgtgtgtgtgtgtatatatatatatatatatatatataccctaaatgggcatcaaacccagacagtgtttataggtaagtcttactaattctttaatgaaggtgacatataaattatttccagagcatagcaaaagagactgacattttatgcattcattctttgactgaaaaaacaaattgataaagacagagtacacacacaaaacacacataaatacaaatacactcaaacctatacatgagttagacaataagaataaaggcaaatattccatataaaatatgaacacactgaatcttctctctattaaaataaaaattattcttagaatacagattggctaaatattgagaaatccatcaatgtacattattacattttgaaactaaaagaggggaaaataaattctgaaaaaacactgaaaaatttcctatttctagatttcaaaaaagttaggataaattgagaataaaagaaactattaatttgatcaattaaatctaccagaaaactacattaagtaatacaatcatatttttcaacattagcaaatgcttcacaataaaaattaggaagaaaagaaagcttctattactaaatattacatagacaatccatgaaaataaaataaaataaggaaaataaaggagcatacatgttagaacggaagagaaaaaactatcacatttttcagattacatgattttgtatttaaaagaattttaaaaagcagtttcaatgcttatgaaaatgtattagatgcctgtactacaagctaaatatacagatcatctttctgtacataccagtcacaataattatattaaaatgtaactttggattaagtaataactatgatatatagtaagaataaattgaccaaatgctgtgaaagatctctatagtcatatggagaaaacgtcaatgttgagtggaaaggaagaatataaagttctatctgggagacctgttgaaagtgggcttatcccactattaggagcatagcaaaattcaagccccttggcttaaacgtctgcaaacataatgattcttaatcaaaaggtatggaaatgaaggaaaaatgagaagactcaatatgatataatttgtcaaatctccttatatcagtttatatcaactctaattttagtaaaacagtatttcatacaacctggaaggtttttaaaaatatcttgaagaaagattgtatgattttaaccccacaaaaatttttaaatgaaaaagaatgaaggttttcatatgacgtataaaacaatattaaaaagaactatcattaaaacagtgtaattgtactaaatgtacaaaataaaccaatgaaacacagtaaaaaattcagatacaaatattatatatattatatatacattatatatactttatatatacattatatatacatgttatatatgcattatatatatacacatatatatacattttaatacatggttaaagtgctattttctattagtgggcaaagaaagagctattcaatggtggtgtgacaatttggccatccacttataaaacaaatgctaattatctacctcactttatatacaagagtatatttaggtagattttaggcttaaataaatttttattatgattagatgaaaatacaggagaatgttttcaccatctgtagattcaatttaagtgatactccaaatctcaaagacgtaaagaaaacaaaaaaataaatttgacaatataaaaaggaactatttttgtctgatgaaaacaaacaccaagttaataattacttctaaagtggaagaaaataactgcaacacatttggcaaaggatagtcataatatattgagaaattatttagttacactagggaaaacaaagcaattaaatttaattccaaaggaaagacaatagaaaattggttgaaatatatgatcattcatgatgaaaaccattaacaaactgggcatagaaggaacatatctcaaaataataaaggccaaatatgaccaactcagggccaacatcatactaaatgagaaaaagtttaaagtgtttcctctaagaactagaacaagataaagatgtctactttcaccactcctattcgatatagtactggtagtcatagccagagcaatcagggaagagaaagaaagaaaaggcatccaaattgagaaggaggaagtcaaatgtccctgtttgagatgacataatcttatatgtagaaaaaccaatagcctccagcagaaactcttagatttgataaatgaatttagtaaagttgcagactacaaaatcaatgtacaaaaatcagtagtgttttatacacaaataatcatctagctgaggatgaaatcaagaaggcaatttcatgtgcattagcagaaataaaataaaataaaataaaatacctaggaataaatttaacaaaggagatgaatgaggaaaactacaaaacacagatgaaagaaattgtatatgacttaaacaatgtatatgaaaacatgatgttttcatcatgggatgaaaaacatcccatgatcatggatcagaagaacaaatatcattagaatgaccataccacccaaagcaatctacagattcaatgcaatctctatcagaatatcaaagtcatttttcagagaaatggaaaaaataacctgaaaattatgaaaccaaaaaagagcccaaatagcaaaagtaatcctaagcaaaaagaacaaagttggaggcagcacattacctgacttcaaagtatattacaagactatagtaaccaaagcagcatggtagtggtataaaagtagacacatagatcaatggaacagaataaaaaacccagaaataaagccatatatttatagctaactgatctttaacatagctgacaagaacatacattgagaaaaggactttttttttcaataaattgtgctgggaaaatcagattaccatatgcagaagaatgaaactggacccctatcttacaccatatagaaaaatcagctcaagatggtttaaagacttaaatgtaagactcaaaactataaaaatcctgtaagaagactcttccggacattgatctaggcaaataacttattacaaagacctcaaatacacaagcaacataaacaaaaatagacaaatgggtcttaattaaactaaaaagcttctccatagcaaaaataaacatcaacagacagaacagacaacctgcagaggggaaaaatatgtgcaaatcaaactatttacccaacagaggacaatatccagaatataaaaggaactctaacacctcaacaacaacaacaacaacaacctcattaaaaactgggcaaaggacatgaatagacatttttcaaaagaagacatacaaatggccaacagatatatgaaaaagtgctcaatattactaatcatcagagaaatgcaaattaaaaccacagtgagatagcatcttacctcagtcagaatgggtattattaaaaaggcagaaaataacagatgttggcaagtattcagagaaaagggaacacttttgcaatgtcggtgggaatgtaagttagtaaaacctctgtggaaatagtgtggagatttctcaaagaattaaagtagaactaccattcaatccagcaatcccactactgaatatcatattcaaaggaacagaaaccaatttaactattaatttaaaaaacccctgcatttgtgtgtttatcacagcactattcataatagaaaagatcaatctaagtatccatcaatggatgattgggtaagtaaaaggtggtatatatacaaaatggaaaactattcagccataaaaagaatgaaatcatgtcttctgtagcaacacgaattgaactggaggtcattatcttaagtgaaaaaagtcagacacagaagtcaaatatcatattctcattcataagcgagtgctaaaaaaagtgtacacgtggacgtagagggtgagatcatagacaatggagactaggaagggtgaggagatgagaggaaggttgatgatgataaattacttcatagttacaatgtacattatttggttgatgaagactctgaagccctgatatgagcactatacaaactatgcaagtaataaaagttacttacacctcatgaatatatgcgaaaacgaatattatcagtaagagattagcagaagttctcaaagggccaatacttctctggaaagatgttgaggaatagaggtaaaaccagaaatgaagattcatattcgcctgtcacacagtaatgagtttttaaagttgactgtgtggccaaggtaacaaggacatactgactctcatagattgttgatttgagtaaatgttggtatagcttctgttgggacgttggtaaaatttcctgacgttttatttttattttttatatattaatttttttgagatggagtttcactgtcacccaggctagagtgcagtgcagcaatctagactcaccacaacctccgcctcctgggttcaagcaattctcatgcctcagcctcccgagtagctgagattacgggcgagcaccaccatgcctggctaatttttatatttttagcagagacgaggtttctccatgttggcctggctggtctcgaactcctgacctcaggtgatccacccacctcaacctcccaaagtgctaggattacaggcatgagccagtgcgccccgccagcatttcttgaagttttaaatgtgtgtacattgatccagtaattccagttctgaataaataccttaaaaatcactagcagtgtgcttggtgatgtgtaggtttttaaaatgatgttcaacacaagattgtttgctacagaaaacattttgactgaaatgctaagatttgttactatgaagagcaaacggtgattttatgtttttactccatcttcctctgttctgtttgaactttttaaaagtcttgcaaaaccgtttggcatttcaaaatacatctgaaaatcttttattgtcttgagaatttgttcaagctggataagtgaattcagtggatttttattggttttattgcctttctgtaatttgttgctgggactagggaaataacagtagttgaaaatattatctagagtgccagatattgacatttattaaaaagatatttaaatgatgctatttatggaagtcttgcagttttgggaaatgctttctgtgccagcaaaacttcttgctatgtcaagtttaaaatcatatacctctgtggatgtttgaggctgtacactagcagtcttgccatggtatcacgcacagagaatgacttttaggatagaaatgagaaaagagctggaaatcggaagtggtatcttttgacaagtgaatatatccaatttatgcactgtactctggaactaaaggaaaagtaatggaaatttctttcatattcagattcaaccaggcttataaaattactaccatcatatcagtgttgagaggcagaataatttcataaacagaaagcaggcttaagaacttatcttgcaggacctgcgcagtggctcacgcctgtaattctagcactttaggaggccaaggtgggtggatcgcttgagctcgggagttcaagaccagcctgggcaacatggtgaaaccccattcctccaaaaaatacaaaaattagccaggcacggtggtgcatgcctgtagtcccagctactcgagaggctgaggcaggaagatcgcttgaaccccagaggtcgaggctgcagtgagccgagatcacacccctgcactccaacctgggtgacaaagtaagatcttgtttcaaaaaaaaaaaaaaaaagaaaaaaaaaacttaccttgttttttgacctaatgatgttctcttctgatttgtgtattatcactttaaattatatgtgtccacaacattgaaaggtattttaattttgtcacagtaaatatatgaatcaggtaatatgttttttaaaaagaagtctaaacaactccactacttacaagtacacagtgactaaagggtaaggacctcatcaagagaaggctgaaatgccagtgcagattagaccagaataaatatatatatatatatatatatatatatatatatataaaagaccagaataaatacattgtgtgtgtgtctgtatatatatgtgtgtatatacacatatatacacacgtaacatatatatatttatatttatacacacaccacattttaatctattcatctgttgatggatagaagttgattcaatgtaaggcctactgtgaatactgctgcaataaatgtggaagtgcagttatctcttcaatatactgactttatttcctttggatatatacccagtagtgggattgttggatcatatgatagttctgtttctaacattttaaggaaactttatagtgttggccatggaggttgtacaaatttacattatcactaacagtgtataagtgttccccttttctccacatccccagcatctcctttttttttttttttttttttggtttttgataatagccgttctgactagggtgagatcatatctcattatagttttgaatagcatttccctcacgattagtgatgttagcatttttttcatagacttgttggccatttgcatgtcttcttttgagaaatgtctactcagacctttctttttgctattgagtttgagtttcttatatattctggatattacccccttgtcagatgtatagtttttaaatatttttctcccactctgtgggttgtctcttcactctgttaattgtttactttgctgtgcagaagccttctactttgacatagttccacttgtctattcttgcttttggtgtttgtgcttttttggtagtatccaaaaaattccttgcccagaccaatatcatgaagcgtttcttctatgtgttttttttgtatagtaagtcctcacttaacatcattgataggttcttggaaactgtgactttaagtgaaatgacatttaatgaaaccaattttaccatatgctaatgtatataagcaagagttaaattcctatggcatatttttgtttctataagcattatcaaacttctaaatagtcaccaaaatacttattataatattaaatatcaaaataaatgtgagctatacataacacttaagaaagactaatgaaaacaagtaggataattattttaccaagtattccagttcagagttgcaggtagcccagggcctatccttcaattcaggttgcaagacgagaaccaaacctggacagaacacctttccattgctgtgtgctctcatgcacacacccacactaactcatactggggcaatttagatacactagttaaacaaatgtgcacatatttgggatgtaagaggaaactgaagtatctgggaaaaaactcacagacactggccccagcgaggaatggattttttttttctcatctatgctatgagtaaacaatgttgaaagaaatgacattattaaacgacctgctgtagtttcattgtttgggtcttaaatgtaagtctcctatccattttgagttgatttttgtaagtggtgaaaaataaggatctaatttcattcttctgcatatggatatccaattttcctaaaatcatgatttgactagactatcctcttcccaatgtgggttcttggcacctttgttgaaaattaattggttgtaaaggtgttaatttataattataattgttaatacaataagttttctattcttttccattggactatgtgttttctgtttcttcatgaaaatcttggtaggctttatgtaactatgaatttatcaatttcttgtagattttccaatttgttgacatatagttattcttaaggataattatttgttaataatacctttaatgatcctttgtatttctgtggtatcagttgtgatgtctccttttcatctctgattttacttatttgagcagtctcttattcttagctgagctataggtttgtcggtttcgtttactttttcaaaaaacaactcttcatttcgttgatcttttgtattaaacttttagtctctattttgtttatttctgctctgatatatattattgcttactactaatttgaggtttggtttgttcttgtttcttttatttacatgaggtgcaattatagattgtttatttgagatctttctatttttattatgtaggtgtttactgccataaacttccctcttagaacagcttttgctgtttatcatacattttagtatgttgtgtttccagttttcgtttttcattgacacactggtagttcaggggcatgtggtttaatttccatgtttttgcatatttttcaaagttcctcctcttatagatttctagttttatttcattgtctttagaaagcataattgatatgattttatttttttaaattcttagcacttattatttgattcaacatattatctattctggagaatgttccatgtgctgttgagaagaatgtgtattctgtggctgttggatggaatgttttgtaaatatctgttaagtttatttggtctatagtgtgattgactctgatgtttccttgttgattttctgtatggatgatctcccttactgctgaaagagcaatatagaattttgctattaatgtattgcaatctattcttcctttaattctattaatattggcatattggtatataaatatttattgttccagtgttgggtgcacatataattggtaaattctcttgctatgttgataactatatcactatataataactttctttgcctatttttacagcttttggctttaaaagtctattttatctgatactagtattgctattcctgctctttttttgtttccgtttgcatgaaatgtttttctgtttgtttgtttgttcttatttttgttttttggagatggagtcttgctctgtcccctagctggagtgctgtggcacaatcttggctcaaagtgacctccgccacccaggttcaagcgattctcccaccctagcctcccgagtaactggaattacaggcacctgccatcacacccggctaagttttgcatttttagtagagacaaggtttcatcatgttggccaggctggtcttgaactcctgatctcaggtgatctgcccgcctcggcctcccaaagtgctgggattacaggtgtgagccaccacactaggcctgaaatactctttttcatctttcagtgtatgcatgtccttacagatgaaggaatttttcttgtaagcagtatatagttaggtcaatgtagccatgctatggctttttttttttttttttttttttggagatggaatctcgctctgtcacccaggctggagtgccccaggctggagtgcagttgcgtgatctcactgccagatctgcctcccgggttcacaccattctcctgcctcagcctcccgagtagctgggactacaggggcccgccaccatgcccagctaatttttgtatttttagtagagacggggtttcactgtgttagccagtatggtcttgatctcctgaccttgtgatccacccgccttggcctcccagagttcctggattataggcgtgagccaccacacccagccgctatggcttttaataggagaatttaatccatttatattcaaggtaattattgataggtaagggcttactactaccattttgttacttgatttttagttgtctttttgatactttctttcttcctctcttaaagcaatcctttgtagtgaaatgactttttccagtagtgtgtttaggtgccttacattttattttaagtgtatctactatagatttttgctctgtggttactgtggggcttacaaaattatccttttgttataataagttattgtaaaatgataacaatttaactttgatcacaaaaagaaacagaaaaagtacatttaactcaatttttctcaccatattttgaattattttcattttatagtgttttaatgttgcttatctcttaacaaattatcatagttattacttgtaatagttttatcttttaatctttttactgaagatataagtgctttacaaatcacaattatgacattaacaataattttagcatccttttctttcagtttgaagaaccccttttagcatttctctccttcacttctgaaggagaattgtactgggtacggtattcttggttggaagctattttttttctttagcactctgattacatcatgccacaccctaccggcctgtaaggtttctctattgagaagtctgctctcagacatattggatctcctacatgagttatttacttattttctctcaatttgcattcaggatcctttctttgtatttgacccttgaaaatttgattttaatatgtcttggagtattcttatttatgttgaaactgattggtggcctttaacctccttgtatctgaatatttatccaggtttgggaaattttctattactatttatttacaaacttatatttttggttcagaggtacatgttcaggcttgttttatatgtaaattgcatgccacggaggtttggtgtacagattatttcattacccacctaataagcatagaacccaataggtagttttccaatcctcaccataattccatcctctaccctcaagtagtccatggtgtctgttgttcccttctttgtgtctatatatactcaacatttagctcccacatataagtgagaacatgtggtatttggttttctcttcctgtgttagtttgcttaggataatggccttcagctgcatccatattgttacaaatgacatgatatcattctatcatatggctgggtagtatttcatggtatatatgtgtcacattttctttatcctgtctaccattgatgggcatctaggttgactccatgtctttgctgttgtgaatagtgctgcaatgaatatatgcatgcatgtgtccttatggtagaatgatttatattcctttgcgtgtgtatgcaataatgggatagctgagtcaaacagtaattcctttttaagttctttgagaaattgccaaacgattttcctcaatgtctgaactaatttacattcctaccagcagtgcataagtgttctatttccttcacaaccgcaccagcatctgttactttttgacattttagtaaaagccattctgtggctgtgatttaaaagtcaaaaaataacatggtggtaaggttgcataaaaaaaggaacacttacacactgttgttggaagtgtaaattggttcaaccatagtggaaagccatatgacgattcctcatagagttaaaagcagaaataccatttttcccagcaatcccatcactggatatatacccagaggaatatacatcattctaccataaagaaagatacatacaaatgttcattgcagcagtattcataatagcaaagacatggaatctatctaaatgcccttcaatgacaaactaggtaaagaaaatgcggtacgtatacaccatgaaatacaatgcagctataaaaaagaatgagatcatttcttttgtgggaacatagatggagctggaggctattatccttagcaaactaatgcaggagcagaaaaaataactaatgagtactgggattaatacctgggtggtgaaataatctgtacaacaaactgctgtgacattagtcttcctgtctaacaaacctcgccctgtacccctgaacctaaaataaaagtttaaaaaatagacagtctgtctggtgtgagatggtgtcgcattgaggttttcatttgcaatcctattttgtgtgcatgttaaactgcatttttaaaaactaatttatatgtggtttttttttttttttcagagtttcactcttgttgcccaggctggagtgcaatggcgtgatctcggctcaccgcaacctccaccgcccgggttcaagcaattctcctgcctcagcctcccaagtagctgggattacaggcgtgctccaccacgcccagctaattttgtatttttagtagagacggggtttcaccctgttggccaggctggtttcaaacccctgacctcaggtgatccgtctgcctcggcctcccaaagtgctgggattataggcatgagcgatcatgccctgcctaaattatatgttttaatttttaaaaattgcaagtacatagtaagtggatatatttatgggatacatgagatattttcatacaggcatgccatgtgaaataagcacatcatgaggaatgaggtatccattacctcaaacatttgttcattgaggtgcaaacaatccaatgacacttttttttttttgcgacagagtttcactcttgttgcccaggctaaattgcaatggcatgatctcagctcactgaaacctctacctcccaggttcaagcaattatcttgcttcagcctcccgagtcgctgggattataggcctgcaccaccaggcctggctaattttgtatttttagcagagacggggtttctccatgttggtcaggctggtcttgaactcccgacctcaggttttctgttcctgtgttagtttgctggggatgatggtctccagcttcatccatgtccctgcaaaggacatgaactcattctttttgttgctgcatagtattctatggtgtatatgtgccacattttctttatccagtctatcattgatgggcatttgggttggttccaagtctttgctattaaaaatagtgctgcaataaacatacatatgcatgtatctttatagtagaatgatttacattcctttgggtatatacccagtaatgggattgctgagtcatgaataaaccaccaaaagcaatttcaacaatagccaaaattgacaaatgggatctaattaaactaaagggcttctgctcagcaaaagaaactatcatcagattgaacaggtaacctacagaatgggagaaaatttttgcaatctatcatctgacaaaggtctaatatccagaatctacaacaaacataaacaaatttacaaaaaacaaacaaccccatcaaaaagtgggtgaaggatatgaacagacagttctcaaaagaagatatttatgcggccaacaaacatgaaaaaaagctcaacatcactggtcattagagaaatgcaaatcaaaaccacaataagatactatctcacaccagtcagaatggccattattaaaaagtctggaaacaacagatgctggagaggatgtggagaaataggaatgcttttacactgttggggggagtgtaaattagtttaaccattgtggaagacagtgtgccaattccataaggatatagaaccagaaataccatttgacccagcaatcccattactgggtatatacccaaaggattataaatcatcctactataaagacacatgcacatgtatgtttattgcagtactattcacaatagcaaagacttggaaccaacccaaatgcccatcaatcttagactggataaagaaaatgtggcacatatacaccatggaatactatgcagccataaataagaatgagttcatgtcctttgcagggacatgcatcaggctgaaaaccatcattctcagcaaactaacacaggaacagaataccaaacaccacatgttgtcactcataagtgggagctgaaaaatgagaacacatggacacagttaggggaacattacacaccggggcctgttcgggggttggggggcaaggggagggagggcattgggacaaatacctaatgcacgcagagcgtaaaacctagatgacatgttgataagtgtagcaaaccaccatggcacatgtatacccatgtagcaaaccttcatgtttagcacatgtatcccagaacttaaagtaaaataaaataaaataaatccatggggaaatttttctttctctacaagcacacgttcaggaaaggcccttcaatttacttgtttctattttttaaaggaataggaatgtattctctcataattctggtggtcggatgtacaaaatcaaggtatcagcagggccctgcttagtacagccaatttgaaaaatagtagggaggctaaaaaaattaaaataaaagtcccatatgatccggccatcccacttctgggtatatattcaaaggaactgaaatcagtatcagacacaaggctaaatcctctttccgttttgtgagcattataaccaaaacctcatactatcaaggcctattttcaggcctgataccagcctgaagcaacatggctttaggcttcacagttaacgctgtggttttgacctgtgtatctgcttctgaaaactagggatatccttttctctatagaaagctaatttgtgaaataacactttatgtctaggattttcctgttcctagggttagaggggcatccatgctattcattattttctgctacctgtaacagtctaccttatattttctactagttgaagcgaggttattgaaatgctgcctaaaacttttcatcaatgatataaaggaaaatactgttatttgactttgtggcatcatacggaagactagcctaaatcactaaaaaaaattatacttttctatgaatagtgttctaaatggatgtcaaaggcattgacaccttaattttctcttttatgtttttttccgtaatgtctactttttaaaccctggcttaatgcctgtgaatgtaatgtttttcacttgtcatttcctaattgttgcatttctttattctcagtccagtggaaattttaacacaaggctttattccaataataaccacataaacctgtttgaaaagtaatgtgacttctattctaattgttttgtcactatagtttacagtcccaaggcagttttcaggtttgtttttcacctataaagtaaatcaattttatgaatatatgtaaatttatatatctgtgaatacatatacctacatatatagatatttaccattttctaaatgttaaaatggaaatctcacaatcatgataaaattatgctaatagacttatctatattataatgacagcattatctcagcctgtgcttactactttcctaaggacacttttgatttcattgttgctgatccgggctctgacttcccacaaataaaaatcatgtggaaagatttccatattcattgacttttaaaatatgttgctacatttaaaaaaaaaacactatttactcaaagtaaattcagtgagattgttgcacaagaataaacactgatacaagaaatctttacttggttcattagatctttgccagtataacttatgaactaattatgggcactattcgattgttttaataaccattccacaacctgttgtatatgggtgtttatgggcataaaatataaccccaagagatgtgcagctcatagatttaaaattttaataatgattcatgatagtttgactatttgagtgaccttagcaaggtgaattggaagcaggtagatatttaaatattaagtcagtctccattcttagttaaaaggaaaaaaaagttacgtagtacattttgagtgtcaatgacaaatactttttcatatggactacatctgttgagagaaagcattagtgatggaatactaataaatcagcgattcttcagcatgcattttattctttattgcatttatagaagaataatgtccacattaaaggaactgataattccagagtatttgataattgtcaggccttatgtagcatgctggtgtcagttctgggtgccatattttaagaggctctttgaaagactggaatatgttcaaaggaagctgagtgggagcttgaaatggtgatgtaagaggaattagtgaaaattttgaaaatgtttagcttgaagatcagaacacatagtaagcacataacagttatctttaaaaattgaaattgtctccagtcattcagtacagtttttcaggaactatcccacaacaggtattgagtatggggccctgaagtgagcaaaaatgaatatggaggggatgctctttataaaataatacacagaataattataattcatggtataattgtgaaaattcaaccaaaaatgtagccccgaaaagtgacagggaattatatgaggaacgaagtactaaaatatactttaggttgattcaaatttcagaactagggacaatgggttcaaggaacaagacatacattttttaaaacagtataatgaagatgtttctgataattatattatttttacagaaatttcacactaagctaagccctgtattaactcatggaattatcacaataatctttttaatgattggttttttaaaattttattctaaaaaaaaatacatgtgcagaacctgcaagtttgttacataggtatacgtgtgccatggtggtttgctgcacctaatgacccatcctctaaattccctcccctcacctcccaccccctaaaaggccctagtgtgtgatgttcccctctctgtgtccatgtgttctcattgctcaactcccacttatgagtgacaacatgtggtatttggttgtctgttcctgtgttagtttgctgaggatgatggcttccagcttcatccacatccctgcaaaggacatgatcttattcctttttatggctgcatagtattccatggtgtatatgtgccacattttctttatccagtatatcactgatgggcatttaggttggtcccatgtctttgctattgtaaacagtgttgcaataaacatacatgtgcatgtgtctttatgatagaatgatttacattcctacaatcccagtaatgggattgctgggccaaatggtatttctggttctagatccttgaggaatcaccatactgtcttccataatggttgaattaatttacaatcccaccaacagtataaaagcgttcctatttctccacagactcaccagcatctattgtttcctgactttttaataatggccattctgagtggcgtgagatggtatctcattgtggttttgatttgcatgtctcttatgatcagtgatgttgagctttttttcatatgtttattggccacataaatgtcttcttttgagaaatgtctgttcatatcctttgcccactttttaatgggattgtttgtttttatcttgtaaatttgtttaactttgttttagattctggatattagacctttgtcagatgggtagattgcaaacattttctcccactctgtaggttgcctgttcactctgataatagtttcttttgctgtgcagagctctttagtttaattagattcaatttgtcaattttggcttttgttgcaattgcttttggcatttttgtcatgaagtctttgtccgtgataggtcctgaatggtattgcctaggttttcttctagggtttttattggtttgggttttacatttgagtctttaattcatcttgagttaatttttgcataaggtgtaaggaaggggcccagtttcagggttttctgcatttggttaggcagttttcccagcaacatttactgaataggagatcctttccctattgcttacttttggcaggtttgtcaaagctcaggaggctgtagatgtgtggtgtttttctgagatatctgttctgctccattggtctatatgtctgtttcagtacccataccattctgttttgcttactatagtcttgtagtataatttgaagtcaagtagcgtgatgcctccagctttgtcctttttgcttaggattgtcttgactatacagggtccctgattagaccaataacaagttctgaaattgaggcagtaattaatagcctaccaatcaaagaaagcccaggaccagatggattcacagctgaattctaccagaaataaaaagcccaaagctccttaagctgataagcaacttcagcaaagtctcaggacacgaaatcaatgtgcagaaatcacaagtattcctttacaccaacaatagacaagcagagagccaaatcgtgaatcaaatccctttcacaatcgctacaaagagaataaaatacctaggaatacagctaataagggatgtgaaggacctcttcaagcagaactacaaaccactgctcaaggaaataagagaggatgcaaacaaatggaaaaacattccatcctcatggataggaagaatcaacattgtgaaaatggccatactgcctaaagtaatttatagattcaaggctattcccagcaaactaccattgacattcttcacagaattagaaaaaactattttaaatttcatatggcattattatcatttttacagatgaggagcatgggtcacagagattttaagcaacttgcccaaggtcacacagctagcaagtaagagaatacagcttgaatctagactatatagctcaaaaaatcatgcttttcaacctccaaacaacactgtctcttcagttagattgtcagtccccatcacaggaaattttactgcacaatctccatggctatttgtcaaaggtggcactgcccaagttgagatgatattctaaatgacctttgagaattttctgtctgattattatgagtctatggcaatactgagataagctcgtgagcaatcagtaatcattagttcacaagctaagagtaatacactggacacttatgttaagccggatcaagaacccctatcttttggttatagtcaggatagatatttgtatacctctactgcccggcaattgtgttttattttctagagagcacagctctttccttgctaaatgaaaatattattcatcttaatattctactcccttggcatctgttccttatgccattcaacaatattgcactcctcattgtttgccagtgtgcagttttcctttgtcccccatgctttaactgaggtttacaacagcagctgtttagctatatttctaacattcatctcccgaaaaagagtatgtttgaacttcattgcaacaaaactttttcttgtatactgatggattaacactcttctaaaggcaaaccatttaaagtttttagttttaaaagagtgctgtattttacttcttttttgaggtttacaaaatattccacattacgggtaacagtggtcgatctatgtctcttctcagaaaagatatgggatcactacattgaagttcactggtttgatttggagctcagtgtgattttggtgccatgctcaactcttccttcatactcactctcaactgaagattttgcttcccattttagtaaatgaggaagaagataatttccacaaactctcactaccagtgtcttcatctgtactcacgtgccctgctttctttctggtcactatgaactgactgttctaatgatgaagatgaacacttccacttgtgtactttgtaatctctttctgcctactaaaggactttgatgaagtaatatatctccttttctgaatagtaaatttatttattaagatttaaaagtattaggaagaagcaggtatgatagagggcaaaatcaagaactcctttttggagtgtcctgcgaaatacctgcctaatgcaatatccaagtggagatatcaaattggtggatttataaattagtctggtgtaccaagcaggtctcaagcacaggcaggtaattttggaattaaaaagtatctacatggtattcaaagccatgagaagtcactgggtagacaaaaaaaaaaaaaaaaaaaccagaaggtcactgattgagtcttggagacctcattaaaaagccagcaaaatactgtgagtgggaatgttccacaggacaggaagaagtgcaatgtaatgaagaacagacgaagacagtgtttcaaggagggagtggtcaaccatgctgattcctgctaagaaatacattaaaaaaataagtgaatgttggatttcgcaacaaagaagtcattttccttaggcaattgagttactgatgagtaacggaggcagaaattccaaaattttttctaaaaatattttctgtgaagaggaaaagagaaattggcttgtacatggtgtgggatgtgtattttcaaaggtatgtcaagaaatttgtgtgttcagaaaaatgctatagaatccccaaaccagttaagttatatgatactaagatggcaaacatagaggacatcgttaaagtactgaaagggctaaaatatagtgaagaaagataaatattatatctagattaaggttaatgaataagtcaataattataaaaattgacaaaatgtttttacaactatggacagagaagacctctcagtagtgttctctgggataggtagagacagactggttttctacaaagacaatcaatattattgataccactaaaatctgtccttagtgcacctattacttagaaatattatgttatttaactttgggaaagcatttatatctttttagatcagacatttgtttccaaaattccaaaaaaatgtattgagagtttattatgaaaaattcatagattcctccatcactattttccttaatagaattccagatactgataatttaataaaactctcactggttcatgtgtaaggctacaaagtttgctatgatcaacccaaactatgtgttcttttttcactataacttgcaattattcactaacaagaaataagaatttttcctgttttggagccacaaattaaagccatatcaaacttcgcaggaaaaattaagattcggtagatttcaaggttagatgataaatcttaactttattccagcttagctaattataaactttgatttagtaatcaggaatgtacactgtttctattgttaacattgctgaaaacccacaatgattataattattattgtgcaaagggcaattctttgtacataatagatgagcaacaaggatctgtcatttcatttcaaaagaaatgtttggaactcattgcaagactttttatgttctcttactagaaaactctgttattttttgcaagttaggcctctgtaactaaatagtgagtcattcaggctaatctaaatactgtaacaagaagcatttgtcctagattatataagaggtagagtgaaacctattttctactcgaacctggagacaggactaggttaaatagttaaagataaaagttgattagtgaggtagttatagaatgtaattaaaagactctccattatactaatcctgatcctcctcttatcatcatctattatctatttggcatatagtcaccctacctggaaaattaggacagtttgagagccacacccttccttctcatctcccatcctcacttccagagcattgatgagagtaattcaccctttatcatacatagattacacctgaatttttagctatatcaatctttgagcatctgctgggcctttgtcagcatttaagatgaatatctaggaaatgaatacctattgaaatatttgcccatttttaatcagattattagatattttcctatggagctgtttgatctccttacatattctggttattaatcccttgtaaaatggatagtttgcagatattttatcccatcctgtggatttcttctaaacacattaatttggggagacagctgtccatctttgtgagttctatgtatttatccttccttttaacagtgatgtgaaagcaagtgaatttatttgcaaataatttctaacatatacataggaagatatattattacaaaattaccttaagttttgttcaaatttcctcctggaaaggataaaacaggttgatagaatttacttcttacatttttttatttgtgtttcttgtgggtacatattaggtgtatatattcatggagtacatggagatattttggtccaggcatgtaatgcacagtaatcacatcatggaaaattgggtatctatcccaccaagcatttatcctttgtgttacaaacaatcaaattatacccttttagttagattaaatttaatagttttaaatgtacccttaaattattattgacaatagtccccttgttgttctatcaaatactaggacttattcattctttctatattttttatacacattaagtatccccaactcccccttcccctttactaccattcctatcctctggtaacgatccttctattctctatgtccatgagttcaattgttttgatttttaggttccgcaaataagtgagaacattaaatgtttttctttctgtgcctggcttgtttcacgtaacataaagatctccagttccatccatgttgttgcaaatgagagaatcccattcttcttatgactgaatagtactccaatgtgtataattttctttatccattcatctatgacattttctttatccattcttctactgatggacacttaggttgctttcaaatcatagctattgtgaacactgctgcaacaaacatagagtgtagatatatatttaatatactgatttcctttattttaggtatacacccagcagtggaattaaaggattgtatggtagctcgatttttagctttttttgaggaacctccaaactgttcttcatagtgcttgtactaatttacattcctaacaacagcgtatgagggtatccttttctccacatccccaccagaacttgttattgtctgacttttggatgaaaaccattttaactggggtgagataatatctcactctagttttgatttgaatttcgctgatgatcagtgatgttgagcacctttttatatgcctgtttgccatttccatgtcttcttttaggaagtgttcattgaaatatttgcccatttttaaattagattattagatttttttcctgtagagttgtttgagttccttatatattctggttattaatcccttgtaaaattggtagtttgggtaaatttgaaaggcagtttaggacacaaggactgtaatccctaggcaacttctagtcctaggcttggcttagagccagtgaatagggtgccacatgacctacggagaaaccaactggcaaaactaagggagtgtttgtaccatccctttccaaaccccaggctgtgcagatcacagcaagaaaagtgactccgtccttctatttggggagaggagagcaaagagcaaagatgactttctcttgcatcctggagaccagctaagccacagtatgatagggcaccaggaagagtcataaggcacgcattccaggccctatctcccagatgacatttctagacacatcctggaccaaaaggggacgaggcacgtcttacaaggtggaagccaagagagggggagagtgtgcaagagtgcaggaaaatctaccatttataaaaccatcatatctccagataattcactcactatcacaagaacagcatagaggaaacagcccccagaatccgttcacttccctccctcgacaggtggggattacaattcaagatgagacttgggtgggaacacaaagccaaaccatatcatcacttaaatgtcacttggaataggcttagattacagataaattgcaaagatagttaaagagagctctcagataccccatacccagtcttttctattgttaacatcttacatctgttacaactaagaattcaacattggtacattacaattatgtaaactccacatgctatttgtatttcattatttttcctcctaatgtcctttgcctattccaggatcttatctaggacaccaaattacattttgtcatgtctctttagcctcctctgctttgtggcattttctcagactttctttgttttgtatgatctcgacagttttgaaaaatgctctttaggtatttcatagaatgtctctcagtttggatttgtctgatatttttctcgtggatagataggggttatgggtttggagaagaaaaaccacagaggtaaagtatcattttcactgcatcatatcaagagaagatactactgatgtgacttattgttgttgatgtacaccttaatcactgaggtgaatatgtttgtcaggtttttccactgtaaagttaatttttttctcccttcttatactgtactttttgggaggaagtcactacgtatggctcaaacttaaaaagcagggagttaagctccacctctttaagagtggaatatctacataaattatttggaagtcttctgcataggagatttgtgtattttccccatttatgtatctagtcaatcatttatttatgtcagtatgttcttttggatatttatttaatactttgggtatagtccagcatcacttcttttctttttttgctccagtgtttccagctttagtcgtgatggactctttcacttagctcctttgtctctttggcatgcctcataattttgatttacaagtacatccttacttgctggcatgacaaaatgctccagtctcatcttatatgttctctgcctctgcctacaatcagcaatttctttttaaaaaaccctcaaggtctgggttctggttaaattcgttgctacttggttgtcatttacttgtaggccctgtcagtgaacagagctaagaatatatgtatgtatactagcctatgtctatacacataactaaaagtaattctctatctatgcctctgtatctacatcaagcctaaacatgagttagtactgatttctccatatctactccagtacaacatggtccattctggctttccccctttgcttatctgtaaccctcccactccaacgttgggaagcttggcttctactatctacctccatttacttgtgtgttcaatcccagtaaacatgtacagcagcttcagaatcgttaatccatatctccatgagactttaacaacagaatacagtctttatgtacctttctttttgttcaaagtaactcaggtgagtaccattattctcttcactttcaatgagattatggcatacatttgtaatagagttagatgttttgttttgtttcgtttttgagagagagtcttgctctgtcatccaggctggaatacatggtgtaatctcgattcactgcaacctccgcctcccgggttcaagcgattctcttgcctcagcctcccaagtagctggaattacaggtgcccgccaccatgcctggctaattttttgtgtttttggtggagacagggtttcttcatgttggccagcctggtctcgaactcctgacctcaggtgatcttcctgcctcagcctcccaaagtgctgggattacagagttagataatttcattgcagtctgaattctgttctgatatcccccagtctcctggttgattttttaaaattgcacatatggaagttcattgtgttatgtatttaaacaaatgcatagcacagtgtccattaatacagtatgatgcagattagttccaccaccctaaaatatcctctgtgtttccattactcaaacagtaccacttctgcaagcccttggaatccactggatcagtttttgttcttatagttttgcattttttcagtatgtcatataaatgaaatcatgtagtatgtggccttgttaatctggtttcttttacttagcaaaatgcatttaagaatcattgatattgctgtgtgtagattaatagcctattatctttatctcagaagagtatagagataccacagtttgtttatccattcacctattgtttccttcgatttcttggtgataatgaataaagctgttataaatgttcttgtgcaggtttttgtgtgaacaaaaattttcaagtcagttgggtaaatacctagggatatgattgctgaattgtatagtaactgcatatttaatgttataagacaccgcaaaactgtcttccaaagtgactacgtttccaccatttatgtttgctaaagcaaagaatgagtttctcaagtctattccattgatctatgtattcatgctttcaccaatgctacacttttattattattgtagctttgtagtaagttttcaaattgggtagtgcaagccttctaactttattcttttttttcagtatcatgttggctactttaggttttttgcctttccatataaaggttagaatcagtttgccaatatcaaaatgaatggtttgctggaatattgactgggattttgttgaatgaatagatgaagttagaatattgaaatcttaacaattttgagttctgctatccatgagcatggacattccatttacttaaatctttgatttttaaaaaaatcagtattttatattgttcacatatatatgctatacggatcctgctgattttatatctatggattgctgaattgtatagtaagtatattaaaaattttaaaagtatgctatagtatactttacttcaaaaaaattgctaaagttagtttgctaaagtatgctaaaatcttaatatatatcatttgtaataacatagaaaaataaagtatatatttttttaattttaaattttatttattcattgctggtataagaggaagttattgttttgcacattcctttgtaacctgtgcccttgattgataagtttatatattagctccaagagatattttgttagcttgcccaccccaactcctgtcataggttctttggggtttctctatagacatttatgtcatcagcaagtaataatagttttgtttcatcctttccaatttgtgtaacttttagttaattatcttaacttatgacactaactagtacttccagcgcaatgtttcctaggagtggtaagagaggataagggaggaagcattttgtctcttaccattaagtatgacattagctgtaattttctttcttgttgtttgttttttaacaggggtctcactctgtcttccaggctggagtgcagtggtgtgattacagctccttgaagcctcgaacttctgggatcaatcaatcctcctggctctgcctcccaaataggtgggactataggcacatgccaccacaaccagctaatttttaaaaaattctgcagggacgagatcttgctttgttgctcaagctgatgtcgcaccccaaggctcaagtgatacacctcagcctcccaaagggctggggttacaggcatgaaccatcatacttggcagttgaaagcttttcacacttatcctttattaggttaagatagttcccttctactgctaggtttttgagaatttttatcatgagcgagtattgcatgttattgatcaattcctgcacctattgatatgattatactatttttcttcttaggcctgttaacatggtgaaataaattgattaacttaggaaggttaaaccagttttgtattcttgaatagaccccatgggccacagtgtataattatttttatacattgttggatttaatttgctaatattttttgaagatttttatggctatgtacatgaacaataattgtctgttgttgtttcttttccatatcacctttttttttggttttagttctttcccgtatattttctggagaaaaactgtaggattagaattatttatttcttaaatgcttggctgatttctgtcttagtccattttgtactaccataacaaaatacctgggactaagtaaattataaaaaataaaaaaattattttatcacagttctggaggctgggaagtccaagatcaagtcatccgcaggtttatttgtctgctgagtgtttggtctctgcttgcaggatggtgccttaaatgctgcatactctggatggggaaatgttgtgtcctcacatggcagaaggtgaaagggcaaaagggacaaactgcctctatcaagccctttgtaagggcagctaatcccattctgaagggtttcaccctcatgacttaatcaccttttgaagatgatatcttttaatactgctactttggtcgttacagttatacatgaattttagaagggggacaagcactaaaatcacattaagttcaccagttaaatagtctaagcctggtacttctttttggaatatttttagttactaattcaatttgtttgataggtataggtttgttcaggttgtctatttctgttagtaaattttggtggtatgtgtccttcaaggaattcatctgttttatctaagttgctgaatttatgagcatagggttgttcatggtattcttttattatacttaatgttctaggatctgtagtgatgacccgcctcttttatttctgatagtggcacttcatatctttgctctctctcttttattggttggctttgattgctagagttttatcaattttattcatcttttgtctggctgcttcgtatattttctcgtatttagtgttctgcagtttgaatatgatatggctaggggtgtgtttgtgtgtgtgtgtgtgtgcaggcatttgtgtgtgtatttatcttgcttggtgttctctgagcttctttgatctatggtttggtgtttgtaactatttttagaaaattttaagctattatttcttcaaatatatcttttgacacatctgctctttcttcttctagtattccaattttttatatgttacatggtttcatattgtcccgcaattcttggatgtctctttttgccatttacttctctttgcattttagtttgggaaatttatataaacctgtcttcaaggtcaccgatttcttccccagccttgtcaagtctactcaaggaattcctaaaaggagtttttgttttctgtgtttttgcttgtttgttttggttctagaatatttctttgatattttccaatggttaccatctttgttctgatactaaccacttggtttttcattctgccctccttttccattagaaccttaacatattaaccatagttttttaaattgtctgataatttcaacattgtgtcatatctgagtttgtatcttccaattactttctctatttacactgtattatttttgccttttgaaatgcctttacattttttcctggaagccagacatgttgcacagggtagtaaatattgagttaaacagacctttagtgtgtggatttattgtaatgtggccaagagttggattgtattttgtatttgttgtggctatgggcacaggaggttcaaattcctcttttttggactgtttttgtttgtttgttttttgtcttcccttttggctttaggtttccctttgtactatttcttagagaaagtctgtctcttgctgctctcccaattggaattcactgtttctgttcctggaggcttattattatggcagtgatgtcatgtgggggaggaaaagctttctataatcctcagattagatcctagtctttggagtgccttgtgaacctttgcctaggagatgtggccttcacaagtgtttctcttctttctctagtggtagagctttttctgctttcgtacttctaatcattcactcactgcagtgatcctctagtaactctggtctgtgtccttaagttcttctcctctgtacatttattcttttacatttttctttaagtggcaaatggaggctgtggcagagaaattttcccttcatcaagcttgaatgggatttctttggtgccagctggtgacatcagacctcagagattaggccttttgtttcctaagggagaaaggatttggcaatggctactctttccctccccaagtgagggtcttgagtgtatggaaggtgtggaactgaggggctttcttaggattcttaatcctctgaatcaagcctccagtaatccatcagaatttctaatttaatgtttcttatggcttatatggcatcttcctagtgacttctgttccaggtaagtaagtgcctggtttttgttcctggagaagtctgtttctccacttttgggatagtggtttgccctgcaatctcagttatctgaggtgtccaaaaaaggtgttaatactcagctcgtccagctttttcttgatgtaaggctagtaatgatggaattcaaggtctttatatctctgagatgaaactaaagtccctgcaatgcagttttaataaattatggcatcttatttttaaattatgagtcagtggcaacttgtctcttcattcagattctactctcctccaaggttcaaatattcattatcctcaactacagtatataacatccatcaaatatttacccaagtcattgtattagttatttattattgtttaggttgagaattaaaatgggtttagagattacttctccatttcctttcatgttagagactaggatattgatattgattgtatgacccactaaagttcattcagaatttatgatataattgaggattctggctcctttcttggtctacaaaatgtaggaattagcaataaacacattacctgacatttctatttatccccagcagctgtagttttaatcaaatttatgttttactcctttatcagctttttgttgaaaatagtagttattttaataatgatgtcttacattcagatcaaaacactttatatcttgtatttttgaaacctattataacctaaataattattattttcaattagcttctattcttatttcaatgaattttgaattcctactgtagttcaaaaaagtacatgatttgtccaagcacatgaggcttaaatggaggaaaaaaataaggacaaaagtgcagttcttatagttttaaacctcgaatagactgctctccacttgagaagccagctgctttcagtatgatgttgaccacttcatgtaactgcctacagtatttttagtacaaaagaatgcacacctgctttgcagctttgtaaagcatgcttctcagggtaaccttcttcacaaagtgagtgctcaaaaatgttacccatcaatcaagaattcccttcatttgcagctacttttgttaaaggctaccactgctaaaggcaaagcattagaagtgaacaagaacatattttgtaatactgaaagttattggaccgtctttgagtagtaggtgaatatttattggaatcatacatgtgtattacactttttattaccaagtttgtacataattacacatcttttttgctctccttatgtaccatttgctcctctattataagttttctatctctattgtgaattatggttaatagtgaacataagcaatgactttccttgactggaaacactttaaggaaagatactatgttatatgcttcattgtatccacagagtttaacaaagtggctcactcagcatagatacttaatagtgctatgactttgagaaaattttctggtttgtattatgtttagcagattctgcggatgggttttaatcctcagaaaggttattccagcagtccaagaccctttcaaccttaaatgttacatttattttctgctcaagtaaatcctggtgagtaggggaaaaaaataagaaaaattaaacattccattttcttacatacctagtgcaaagaattaagggagttaggataaacttaccagagcacatattcaaagaactctgattaggtttgctttattctgcatcagctttttccccctccaactcaaactatccctttctttatttgctgtcgtctgataaaatagtgcaaataagtaatattattaatctaatttccccgtttgctcttcaaattatatatgtgaccactttagctgcacactccacctattggcctggcatggaatgggatattgtagaactgaggttttcatagcaattcagagggtaagaacacccggaagtcacagtatcatctgcagaatgccgtggaatattcctctgctaaattctattataggaattaaaataatttcacttgcttcaaatattatttgcatacacatgtaaaaagagttactacacataatttttaaagaaattatgtttccaaagttttgccattaacatgtaattattacttgtttattcagggttttttggccacttttgtaatatgttgtacatattgaccaaactatataatagtcatctaagtctactcattttggggatctttatgtgagaatacccgcaactggccgggtgctgtggctcacgcaagcctgtaatcccaccactttgggaggctgaggcaggtggatagcttgagcccagtttgagaccagcctggacaacgtggctaaaccttgtctctaccaaacgggtattcttgccttatttcctgatttgtaatggtgattgtttcagtgaccgttatttagtacatatttgttgttgttagtttttaataagaagcctactgtaagtagtttcgttttattcttgttttacatagcacttttattaatacggctctggtttttatcaactgctttttcagcacttattgatacgactatgaggctttcctactctcctttttgatagaattgataatgttgatttttttaataataatcaatccatccttgtattcccagaataaatgctacttaaacataatgtgctattcttctgactctagtttctgagattttattttgaatgcttcatctctatcactaagtgagattgggctatacttttacctgtcgttgtcagggttgatattaatgtcttggtagcttcataaaatacagtggagagtttttcatctttttctattcacctgaaatacttgagattactttgaaattaactatttttcaccttaaaataatatcacctgtaaatccctctggttcttgtgacctttaaaaatgttaatttggaaaaatttaatcttttattaaggtataaagtattatataatgtacctcttcatactcaccacccagctttaactcaagtaggagttttagttcacagggaacttcaaacaccaatgatggtttttgagtttttaacatatatgttatgatagcaatgagtttcaattgcttttgaaaagctagacattttgctcaaatataaagttgaattaatctgtgactttcttaaggaagttcatcaaatattaatcgataatagtacaacaccacacctcccctttggagggtggggacaaaagtctcgaactggactcaaatcctggcttcctagattaccagtccttcagtctcagtttccttgcctgtaaagttgagataatgttactggttgcttcctaggatggctgttaaaaataaattagatattacatatgagacatttatggtagatattgaggggcaccatccagatacttcaggactgagggactcattcttacagctgctgagagttagctggtggtagctcacaactgagtcccttcatgggatctccctcagctgaagggaactgctttgaacaaggttatgccccgtcttaaggacagtacaaagccaaaaattgtgattctgtctagtcttcttggctcagtttaggataactctgaagggccatccaacttccaagctcctcatggcatcagacgaagcctctgttgcagctactgtacccaacttctcttgctgcctagtcctgtttgtttcccttcctctctctcaggagttggtaacaagagaatgactgataagactactgcattccatctaacccaagagtatgtttccaagagagcatagcctaagacaatgcttaaaatactgtctagtaaatattcagtaaatgctaactgttattacaaactactattattattatcatagatctcagtgctaattttttgcagctaacctcataaagtcagccccatggtgcaggggtggggttcacttactttctttccactggaatcacatttgtttcacactggtgtttatattctgactctgcgaagattgatggtataagaagctttacagctcctaacacagaggatttttccacctaagaaaaatggcatctactatgcaacatcattgaataccaccaagaagcagtaaaactcagtatttgtgttttgtaatctaaagctcagtatgctgtaggctacgttgttgcaagctggcagacaaaacatgttaaagccaaaagttaaaggataaaaagaaaatgggcttaaaatgtgagaaaatattgattaacattttctctaattctggattttagtcaggaaccttcttaatccagcttgtaggaacctacattgaaatctgtgtgtgtgtcggaggtgtaatgtagatctatgtggttaagtgcagactacttgaaatacataagcagatatatttcattcaacatatgtacatcaaggaagggaaacaatcaattatgtggctattgtggttaactgaagatgagtgttggcgcctaaatttggtatgagggggatggagtatttttatttgcttgatattttttccctaagaaaatagatttaacatccatcccaaatattctgactagtaattcacagaagtatcagaaaaacctgatagactaacaaattgacatctacatgatttttattttactattcttattgtatttaagttttgaatttaatctcatcaaattaaggtatatgattcacttattctttggtcagtgatcagtgtattttgtctacaattatttgtactgaaagaaaatttacaatacacatgagaacattttattacatccttctgaaagatcgttattaaagtttggatctccatttcttacacttgtgctggaattaaatggtttagtcatgtcaccaatcaattaactcttttaatattcctttcaagaatctctggaatcctgggcaatgctgaaggaaaaaggagactgatacagcaatgggttatatactgacccaagaaaacaccaaattttcttttcgtattgagcatttcaaggggaaaaaataaagtcaatgcttaattatataaactaaatgtgtatacacaatgagcccaatggagaacaagatctctaatctctacaaaaaaattggatgatatcagaaatgaagggccaaggttaagcatactgctgaaatagcacaagtttattatctttttgcagccaatttcataaaattactctgattagaaaaacactaaaggttctagtaataatgcagtacagaaatgttgttcttaggcttcacaggaaatgcaaattccaatgtaagacagattgataagcatcatgtctggcttttgaggcaaatttaaatttctaagaggaaagaagttgaataagttattccaaaacattaggcttatttccaaggcagctgttttatttcatgaattgtgtagttgggctctgaagacacaacagaggtatctccattgatagattggcttgaaatttgattggcaacagtcatgttccaatttgggcaccttcaaataaacagaaagcagtccagagaaaggaattaaaataaagttggcaataaaatacagtggtattagagactactagactggtaagtaggattaatctcaaggctggagagttatttaaaaatacactgtgacatatgccaaactagaaattggagaatcaactctggtgccctctacggctctgtctgattttgaaaccagaactataaaactattgaactgctacaccaagatacagcatgattcacatttctcccaagagcagtccaaaattggccttcaattttgtctccagatacatatcttcccgcatgattgtcaccccttcttttgttttgttttgtttattttgtttctttctttctctttcttctttccttttattcttctgctctttctctcattctttcttctttttcatttagttttattcaacaggatctgaaatggccataagaataattctgttccatgttgtttgctttttttaaaaaatctggatggactctagtcagaatggtaaaaggcatattataatttcaagtcagcaaatattcagtaatcacttgttataaattaggggaaagtgaaagtctgatatttataaggtagctagttcatgtgtagcctatccaaggaaattccacgtagaccatatcaattactcctcacaacaaccctgggagatctgtatatgagtcctcattttgacagttaagaaaaatgaagttcagagagtcacaacctaggaaacaggaaccacttttagtgtggcataatagaggcagccaaaccaaatccccctcaaagaatttgtatatttactggggagaagagataaaaacatatgaaaatttaaaaatatggcagagtagacactttattgacagagtgtttagcatattatctgacatatagtcattctaccatatttggaagaaacaggatttgacaaataactgtcctagtattcaggaaagatataatggacaaattgggatttaaattctacaaagggcacttgaaaacttagtggagcatatcgaagcagagaggatgtgaaaggcatcggcaatggtagaactccatttgcaggtgtgcaaagacccatccataagtggatcatcaaaggtgggttaggaagaaaacagtctattagtatgattgtaagagtttagtgggagaaaaattaacattaagattaaagttaggctgggtgccgtggctcacgcctgtaatcccaacattttgggaggctgaggtgggtggattgcctgaggacaggagttcgagaccagtctggccaacatagtgaaactccatctttactaaaaatacaaaaaaaaaaaagaccaaaaaattagccaggcatggtggcacgcgcctgtaatcccagctactcgggaggcagaggcaggggaatcgcttgaaccagggaggtagaggttgcagtgagctgagattgcgccactgcactccagcctgggtgacagaatgagactccgtctcaaaaaaaaaaaaagattaaagttagtccatatatgttatatttcagcttatgttatcaatttcattagcatttaaaatatttattgaagaattaacagaggtcttctattaatctgacatggtaaaacagaagaggaggaacaatcatagacatgagaaaggagacactgtaggtgacgtaaattaaaattttataaacaaggtattttttctgtggatttaatattgggagatttttgaaactggttattatacatctatcttacctcctatattagtttcattttgttattgttacaagtttccataaacttggtatcttccaacagcacaaatgtataatcatacatttttggaggccagaatttcaaagtcgttctcaggaagccaaactcaaggtattcactgggctgtgtttttttctggggactccagggggatttcatgtccttgaattttctagcttctagaggctacctgcattccttggcttatggcccccttctggaatctcatcactctgacctctgcttccctcatcacatcttttctgactctgattctctttcctccctctttcatttataaggacccctgtgattacattggtagcccatctagatagtttagtataaatcttcttagctcaagatctttaattcatttacctctgcaaagtcccttttgcccatgtaaagaaacatattcataggtttctgagattaggacgtggacatctttaggtgatgattattttgttgataacaccaatacatgacaaaaacaccactttagatccatccatccgtccattataaatggggaaatgcagcataaatatagatgtatattgaccatccatatctctttgccactttgagcatctgttaaaccctctgagcttcaacaccatcatttagaaaactgaaatatttactcacttctaagttctgttgtggacattaataagatagtatagatgaaaatgtctggagcaacacatgttacaaaatattaactaaaatagcaacaacaacaataatggcattctgtggttagtgccaacagatttaataagcaatagttatactgaagtgcataatataggccaagtggtaaactgaaaaatttttattaattcaaagagaactactttgcgatagtaaaagcattactaagaataatgagtctatttattcaagtatcttatcaattctgactccacttcactgatgaacattctcaacttcctttttagtattttcaatacagagagtgagtttggtgtgccaaaatatttccagagttaaatcatcagaaatttcaggctaatcctggaatttgtaaactcaatgccaatctttgaaggatgcttttgggtaagtacagtttgcttttagttcaggcagatcctcttaaaattacaccatatcaatgtgaaagatgtttggtaacttagatatatcctgaggtttatattcaaagacagacacagatacttgcaacataattcatacttataaatccttgaatatcttcaaaaatgctaacataattcccaccaaatacttctaagattcttcagaatgtgttatttatttgagctcaaggcaaatctgtaatgagaaataaatggagtctccagatgtcatctgttccatccacatgcccaatttacatctgcatatctgcatacctgcactctgtgaataaataagcactgctctccattattcttgagtattcttttaagcttaaagcttcaagtttattatgtccagccatcttgacatgtcagcaagaaagtaaaatcttgtgtcactgggggttcaataaattggatctttcagaaactttgtggtccccaaagacctctttaaagaaagtaccatagaattcagaatgtggataggaaaaaagattgttgagattcaggagaagagcaaaacctaatccaagaaaaataagaatcacaccaaaatgatacagaagctgacagacaaaatagctagtatataaaaaagaatttaactgatctgatagagctgaaaaacacactacaagaatttcacaatacaatcacaagtattaacagcagaatacagcaagctgaggaaagaatcttggaacttgaagactggctctctgaaataagacagacaaaaaataaagaaaaataatgaaaaggaatgaacaaaacctccaagaaatatgggattatgtaaagaggccaaatctatgaattggtggcatccctgaaagaaacagggagaaagaaaacaacttggaaaacatgtttcaggatatcatccatgaaaacttccttaacttcactagagaggccagcaaccaaattcaggaaatacagagaaccaccacaagattcaacacaaaaggattatcctcgagacacataatcatcagattttccaaagacaaaatgaaaggatgttacaggcagctagagagaaagggtgggtcacttacaaagggaacttcatcaggcccaaattggaactctcagcagaaaccctataagccagaagagattgaaggcctatattcaacattcttaaagaaaaaaatattcaaccaagtatttcatatccagctaaactaagtttcttcagtgaaggagaaataagattattttcagagaagcaaatgatgagggagttcaataccaccagatctgccttacaagacatcttgaaaggagcactaaatatgtaaaagaaagaccattaccaggatgtattagtccatttttcacacagctataaagaaatattggagactgggtaatttataaaggaaagagttttaattaactcacagttctgcatggctgcggaggcctcaggaaacataaaattggagtggaaggcaaggggaagaaagcaccttccttgcaaggtggcaggaggagagagaagagggtagggaaaacaggaatttataaaaccatcagatcttgtgagaactcactcaccatcatgagaacagcatggaggaaaccactccgatgatccaatcacttccctcccttgaaacgtggggattacacatccctccctggacatgtgaggattaaaatttcatatgatatttgggtggggacacagagccaaaccatatcacaggcactacaaagacacgcttaaatacaaagatcagtgacactacaaagcaaccacacaaacaagctggcataataagcagctaacaacacaatatcaggatcaaatccacacatgtcaatactaacgttgaatgtgaacactctaaatgctcaaattaataggcacagagtagcaaggtgaataataaaagcaatacccaatggtatgctgtcttcaagcatgcattcacatgcaatgacgcttaggctcaaaataaagggatggtgaaaaatctaccaaacaaatggaaatgagaaaaatagcaggtattgaaatcctaatttcagagcaaacaaacttcaaacaacaacaacaaaaagccaaagaagggcatgacataatggtaaagggttcaattcaacagtaaaacctgactaccctaaatatatatgcagccaacacgggagcacccagattcataaaacaagttcttaaagacctacaaagagacctagactcccacacaaaaatagtgaatgaattcaacactcccctgacactattagataaatcatcaaggcagaaaacaaacaaagatattcaggacctgaactcagcattgaccaaaaagatatgatagacctttttagaactctccacctcagaacaatacaatatatactcttctcatcaccacatgacaaatactctaaaatcgaccacagaaacgggcataaaacaatcttcagcaaatgcaaaggaaccaaaatcattccaaacacactcttagaccacagcacaatagaaacagaaagcaggactaaaaataaaaatactcaaaaccattcaattacacggaaattaaacaacctgctcctgaataacttttgggtaaataatgaaattaagtaagacagcaataagttatttgaaactaatgagaacagagatacagcacagcagaatctctgggtcaaagctaagatagtgttaagaggggaatgtatagccctaaacactcacatcaaaaagttagaaaatcaaattaaaaacctaatatcagaactaaaagaagtagagaagcaagaataaaccaaccccaaagctagcagaagataagaaataatcaaaatcagagctgaactgaaagaaattgagacacacacacacacacacacacacacacattcaaaagatcaataaatccagaaattgttttctttgaaaaaaattaatgagatacgttattagctagactaataaagaagaaaagagagaagatccaaataaacactattagaaatgagaaatggaattttgccactgaatccacagaaacacaaacaataatcagagattactatgaacatctttatgcacacaaactagaaaacctagaagaggtggattaattcctggacagatacacactcccaagactgaaccaggaagaaattgaatccctgaatagaccaataatgatctctgaaattgaagcaataataaatagtctatgaaccaaaaaaagcagaggaccagatgaattcacagctgattcctgccaggtgtacaaagagctggtaccattcctatagacactattccacaatattgagtaggagaaactcctccccaactcattctaagaggccagcatcatcctgataccaaaacctggcagagacacacacatgcagaagaaaacttcaggccaatatccttgatgaacattgatgcaaaaatcctcaacaaaatacttacaatccaaatgcagtagcacatcaaaaagtccattcaccatgatcaagcaggctttattcctgggatgcaaggttggttcaacataagcaaatcaataaatgtgattcatcacataaagagaactaaagacaaaaaccacatgattatctcaatagatgcagaaatgactttcagtgaaattcaacacctctttatgttaaaaactctcaataaattaggtagtgaaggaacatacttcaaaatagtaagagccttctatgacaaacccatagccaatatcatgctgactgggcaaaagctggaacaattccccttgaaaactggcacaagacaaggatgccctctctcgccatgcctattcaacataatattggaagtactggctagagcaataaggcaagagaaagaaataaagggcatccaaataggaagagaggaagtcaaactttccctgcttagagaccacatgattctatatctagaaaaccccatagtctcagcccaaaagctccttcagctgataaacaacttcagcaaagtttcaggatacaaaatcaatatacagaaatcactagcattcctataaacccacaacagccaggacgagagccaaagtaggaaaacaattccaatcacaattgccacaaaaacaataaaatacctaggaatacagctaatgagccagaagaaagatctctacaataagaagtgcaaaactctggtccaagaaatcagagatgacacaaacaaatggaaaaacattctattctcatgggtaggaagaatcaatatcattaaaatggtcatactgcctaaagcaatttacagatccaatgcaattcctaccaaactaccaagcgacattctccacagaactaaacaaacctactttaaatttgatatggagccaaaaaagcccaaatagccaaggcaatcctaagcaaaaagaccaaactggaggcatcacactatgcaacttcaaactatactacaaggctacagtaaccaaaacagcatggcactggtacaaaaacaggcatatagaccaatggaatggaatagacagcccagaaataatgtgacacatctacacccatctgatctttgacaaagctgacaaaaacaaacaatgtggaaaggacactttattcaataaattgtgctgggataactggctggccataggcacaagattgaaactggactccttccttacactatatacaaaaataaactcaagatgaattaaagacttaaatgtaaaaacctggaggacaatgtaggcagtaacattctggacataggaactggcaaaaatttcatgataaagatgttaaaaacaattacaaccaaagcaaaaattgacaaatgggatctaattaaacttaaaagcttctgcacaccaaaagaaactatcaactgagtgaataaataacctacagaatgggagaagatatttgcaaactgtttacccaacaaggttaatatccagaatttataaggaactttaacaaatttacaagaaaaaaaccaaacaacttcattaaaaagtgggcaaagaacatgaagagacacttttcaaaagaagacacacatgcagccaaacataatgtgaaaaaaaagatccatatcactgatcattagagaaatgcaaatcaaaaccacaatgagatatcttctcacatgagtctgaaaggctactattaaaaatcagaaaaataacagacactggtgaggttgtggagaaagggaaacacttatgcactgttggtgggagtgtacgtttgttcacccatatggaaagtactttggcaatttctcaaagaacttggaagagaactaccactcaacccagtaattccattattgggtatataaccaaaagaatatacatttattctaccacaaagatgcatgcatgtgtatgttagttgcagcactattcacaataacaaagacattgaatcaacctaaatgcccatcaatggtagactgaataaagaaaatgtggttcatataatccatggaatactacacagccataaaaaagaatgagatcatgtccttttcagcaacatggatgaagctgtatgtcattatcctatgtcaaataatacagaaacagaactccaaatacgtcaagttctcacttataagagggagccaaacattgaatatacatgagcacaaagaagcgaacaacagacaccagggcctacttgagggtagagtgtgggaggagggggaggatcgaaaactgcctatcagatatagtgtgcttattgcctgggtgatgaaattatctgtacaccaaagcctgtgacatgcaatttacctatataacaaacctgcacttgtacctctgaacctaaaataaaagttgacaaaataaagcacctcgggaaagttttttaaccttgacacttgaccgcattaaaataaggaaagtatccatactctgtctcaaaataaccaataactggaaaataaatgacaccaccaacatcacactttcagtatcccaacctaaaaattttgccacataaagttctgtggcaaatggctttgtgagaggtgacagctgggtacaccgaccctttcctttggcgtgaaactttattttaaacgtctatttaaaatggttcctttcaatatatgcgctaaatctgtagccaatggaacctgtttcttctacatttcatctaagtatctacaacttcttaccagctgtgattatgttctgctaattatatgcaatatagttagtaaagtaatgtttccctaataccccagatgggtcgtatgtggactcagggcatatgcttgagggtaaaacccaaaaatacagttttatcaggtcaggttgtatataggtataggtgaatgtatcatttgactgtatataagtaaaaacaattgagctgaagatacaatatggaagaaagttacctatgtaactttatgtcttttttttttttaaccttaacctggcaggcttttattcaagttcctctttaggacaacggttctttcaaaagtgtggcaatttcaaataactttatgtcttatatgccaaatcctcttctaagaacttcacatactcaattacataatttcttcttaacaataaatgttaatatatactagatggaggtaagtgccatagagtacaatgaggcagggaagtgggataaagagtgtggaaagagatgtgatacaattttaaagatgtggttaaggaaaaaaaggtcactgttgaacagagtcttaaagtaggttattgagtaagccacaaggatacatatctgaggcaagagcattaaatatagaggaaagcctgtgtaaaggccgccaggagggagtgtgtctgatgtgtactacaagaactgcaaaggactgatttggcaggaggacaagtaggaaagtaaggcaaagattaaagggagagtggaggataaagtatgtgtgtataaggctttgtatgttatagaaagggctgtggcttttgcccttatgaagaaggcatgccctgtttgcccccgcagataatctgttcacctttcccctttcttctctctttgggctttgggaggcagaatctgtgaactgtaccattctggataccttgccctgtggcttccattcaggtctggccaattggaaggatgtaatagcaggagaatggagaaataagaacctctatcctggtcatgtgtagccacagcttctttcaggcaaacttctcccatggctctcactgtgtcttggcaaaattgttccttgcctttgtctattcagacctgggcgaggaaagccttcctattgttcctagtttctgcttgttttactgttccttattgttttctctaatcccacaatctccaaatataacctcaccattaaatgctttccagttaaattttttgaatgcacaatctcttctactctcataaaattcttacagaatcaaacagaaaggcattgcagggtttggagcagaggagtaacatgttctgatttatgttttaaaagagtcatgttggctgttgttttgaaaattgactctagggacacaagtacacatgcagggagactatcaacaatgacaaacgctagttaggtacaaaataaactaacagtgatataaaatattaccagaacattcatattgtacagctgtattaaagatctcattattctgaaaatttgtcaaccctgagtattataactgcttgtgttttgtttattcattgttattttcaactgccagattgaaagacgaagttttaaaaaattctcctcaaatatggatactttcacatttgtaaacgtcagtcttggtaatctaaaatttactcctgagctctaactttttaaacctgattaaatgcaaaacaatgcatagaatcttataaatattgcagcaactatgcacgatcaaagaacaaacactgatgctattcttgagaccataaaataaacatattaaaaatatatgagtaaacatgagagaggcatagaaatgcggtgacatgtaaaataaatactaaaatacatactcaacttgtagtgaaaagtcaggattctctggtcaccatccaaccatgtacccgcaaatctatacagtcgcctcagatcttcataaactaccactgtgctgtatgtgttgttaataagcagagggaatttcttacagtgtagataaggatatgaaaatttcaaaggagaaggcagtcagatctaactgtcttctcatggggtatatgatttcactgagataataaccatatcccaaagaatgaaagcctcttgttttctaattcttctaaaaatgcaggccttaactaaactatcaaccccaaaattgcactgtacttataaagcaatttttatacaaagtattttatgattcttaaaattacttaaacaactttccatttgctatgagaggaatgtcagttggctgaacacatcctccttgtcagacgtgaaacttaaactcagctgtgactcagggaaaccctggctgcccttgtgaactcctgttcttttagctcagtttcacagggtgaattcacaggtgggaatggacttgggtgaagttgaaagtcacttgaaccagatggttacaaataggccaagtgtcctgtgcctgtatagctctttgtttgggtatgggataagaggctttctgactcagcacaaataaaactgttttttaatgaaagggaggtcaaacactcagccatgccacctggcatcatttaaagaaccagtttgagctgatcatgttcgagtaaaatagatacttttcatgtaaaatcaacagaaagaaaggagagagagaagaaaaaaaatacccatgtcataaaagagacagttaaaatgacctcagtggaggttacagtgttgtccacctgtggttgtaaacatcgaaagagtgactgcttctctttacatttttttgtagcaagcgcagataggacagagtcagatagacccttagtaaatgcattaaaacatttaagagtgaggaggaaaatgagttttctgggagtgtgcaaatcctttaagtcctggtgacagccagtgttctggacccaagttggagtattagctggtagggaaaatgcaacaacaccaagtaattgggattttctttttatacctttcacagtatcaaaagatcatcatttgtttccaaaaactatacatatccccaagtacctagttgaaataatctgacttctccatgtatcttcttaagtaagcatcaaatatcaagtggattgctttcttctagggcagaaggaagtatgtgttgtgactaattatgaaaaagtaaaactagcatttatattaatttaaacattttctgggatgaaagtttgagaatatggagaagaatccaggaagctagattcactagatgtttggggacagaataaatggggtcaactcagtgaatacagatgaacacaaaaggataacactcagttataacatgaaagccggattgaaatctgaattctattatgtttgactaaggacagggcagtttctagtaagagttgggggaaagctttgtctttagtttgtcaacagaggtgtcagcttccttcttcaacccttcagcgactcagtacataatactctcccccacaacaatgggtatctcaggtacatcgatttactgtgtgaatttaattccatgtgtgaaatttctcataggttctttctatttggggtttttgggaccatcctagaaaatgaaaggctttatctttggtaaataaataaatagatttggccaggcgcggtggctcacgcctgtaatccctgcactttgggaggccaaggtgggcagatcacctgaggtcaggagttggagaccagcctgaccaacatggagaaaccccatttctactaaaaatacaaaattagccgggcatagtggtgcatgcctataatcccagctatttggaaggctgaggcaggagaatcacttgaacccgggaggcagaggttgcggtgagctggagaccgaaccattgcactccagcctgagcaacaagagcgaaactctgtctcaaaaaaaaataataataaataaaaaatagatttataggatccattgaagaaagtttgttttaaagctcagagcaatcttgctgaattggaagggattagaagagacagaaaatggcctgagttttttgagcttggtgaggaggcagaacctgccatgtatctcaaattctacatccttatttctctactatttattctctcattctgttttccttagcagtagaccatatttagtacagaaagcagatctcacattcatctaatcttttgttctgtgggaaattgaggaggtgaagaattattttcatgcatagagaaaactaaattgaaacagagaaaatgaagaaaccaaagtttaaagcagagaagaattaaagaaggaagatttccagaaccttatcaagtacttgcaaattcagagacttagttgttgtccaatagctgccttcatctgtcagagtaagcgatgaaatgtgtaaaatatcatttgtgtcttttatcatcaagaagcaggactactgtcatcttcatgtttcttataactgctatttctggtaattctaaagctattaaatgctatgaaatgtaaactagctctaatgtactcaaggagcagccaatttacacaacagctgggggaaaaaaatcaaagccattccattggaccagctgaattgtgagagaggtatttcataccctccagctgacacagcatgtagatcaaactggcagctgtattttagggaaaatatgtcacaacagacaaatgtaagaaaaggacaaatccacaaaaaggatcttttgcaaatgaatcactacagtaggaagactgcagaatgagtaataaagaggcatcttcccctcaatatttagaaagcccctcatactcactgcaaccgctacaagataaagtaaatttttaagtttctgtcttacagaaacagaaattatgagccagaatttcctcagtacattcaccattggtctctttgtgctgttcttagctataaaattgtcaataatgaaatccatctaaaagccacaaagataaaagacaagagaaacaggaacccaggtatatagttttggcacataaccagtcagggcatactacaacttcacatttagaactgtgctaaatataaacctgttgtcaaaatgaccttggcatatttaccgagtgatgtgttatattgagcttatcatgtggcaacattgttatatgtgaaccaggtaccattattggttccgtttggactgatgaggaaatggtgacagagtgcttaagtagctttcccaaggtcaaacagtaagctgcaaagctgggacttgaacccagatcattgagattctaaagataggatactttgcctcattttactcttcctggtggtcacctggttttacctgaaccatcctgtgatgaagagattgctgcagttcccagtccctgaggcagagtgttcaagttttgagcaactcagaatgtcatcctgtctcctccactcatttctgttggcaaaaaatcttggaaccatatatatatagccatatatattcaaataattatttatttggatgacagttattcacatgtttggaggtggctatcaacctgatttcattcttaattttctcttttctttactgaaacctccagttgtttcttatatggcaggtactgagtccctttgactttctttattttttttattttttttgagacagagttttgctcttgttgccaaggctggagtgaaatggcgtgatctcggttcactgcaacctccgccccttgggttcaagcgattctcctacctcagcctccagagtagctgggattacaggcgcgccaacacgtctggctaatttttgtatttttagtagagatggggtttcgccacattggccaggctggtctcaaacgcctgacctcaggtgttccacccgcctcggcctcccaaagtgctgggtttacaggcatgagccactgcgcccagcctgactttctagttatggggaatgttacatattctccatgtgtcagtctctccaactctaaaatggagactataatatctcctatcacttagctttgttgagaaaatgtaatactgaattaatacatgtaaaattcgtactacctgacacatagaaagtgctcaataaatgtttgtttttagtaatattattgctgttattattacctgtagggctattgtgattaaaatgtgatcacagtggtaaaatctgtatcagaaagtgtggtgcaatttaattacttagtatatgtaaatttccttaccttttggatcacaaagcatctaatgtatgggtagacttcacaactcctttcagccctgtaggagtttattttcttggttttcacattttatagtttgcagctacaatagactagttcgatttcttagctctgtattagtaatagattcttgttatgtatatttctttcttagacaaacatgacctctgactttagaatgaatgacgtctcattctattgtacatcaactgcagaaaaaaatcaacaatctgctgtagtgtcttgataaatgtgtctttccatggggccagtcttcctgattctggaatgtttgaagaatgttcttgaagacagtggtggacattctccacacccatcagtgggccagcagcaaggccttagaaatgaatgtctgtcacagtacagatgctctggtttttcattagactccacagctgtagcatttcatggagtgttttctcaggaaaaacataatggtgtgaacttccacactgaagagcaaacacatttccctgagaatttttatgatataattttctaggctactttttcttttgctttttctctatcagtttggctaaccgaatgataactgaaactatgtgtatatatatgtatatatatacgcagacatatatatatatatatatatatatatatatatataaatgcgttttttaacatatatagcactctgagagcacacacacacacacacgtacagatacaattagtgggaaaaagccacaacaaaaaaagaaaacacagggcatctgctttgtctactcaataactcctgtggcatatgtacatggtaagaagacgagaaatccaagtgttgagccagtgatgtgttagtaccaggtgcaagaaggccttacatcgtggggaaccactaagcatgtaattgcattataaatggtcttcatacaaatgggtcatggaaaatattagcatttttgtatgccaggagaggggagacttatatcattcttcacattctgagaataaaaataatctctatttcactcctttctgtaccaaaatgaaacatttactctaatcactatttcatgatcataaagctatttataaagaataagaaaaatgtgttttaaaatgttgattacattgagagcattttaccaatgttaattaatattgattttaagttcccaaagtacatatgactaaaatcctttaatatcttaacataatcaattatttttcacaactatgtaaaaattattcaatcctggaattcaatctaatcctccaaagtacaagtactttcaactaccaccttcaatgtttttggaccacatatatttttcccactctgtaaaacctagctacatgattgcaaaataatggattaaataaaaatggttaatagaatttgacccttgtagataggttgtctcattccttggatgtttgggatgttagcactcagttttacctctaatataaagtgctttaaatgtactgtctttcatacactgaacataacatgggaactgttctgtgaaatttatttcatggccttttttctccttttcctattaagcattcataactcatttactggtacattgtagattcctgctggcttggtcatcaacacaccaattccccctccagcaatcacagatgatctcagaggcctcagttgaaaacaaagtgtggtttgatggtgctatattcctcttcttttttttttttttttttttttgaggtggagtcttgccctgtcacccaggctggagtgcaatggagtgatcttggctcactgcaacctcttcctcccgggttcagccgattctcctgcctaacctcccgagtagctgggatgacaggcacgtgccaccaaacacggctaattttttgtatttttagtagagacggggtttcaccatgttggccaggctggtcttgaactcctgacctcgtgatccacctgcctcggcctcccaaagtgctgggattaagggcgtgagccactgtacccagtctcaatggtgctatattctaagggtatccaggactgttttaaaaaatatgataagatacacagacatggaattgactgttttgaagatctctagaaacaagaggcacagcaccaccattcagggccacatgtggaagcaccagggtcatttaggaggcagagagagcaaggggaaaatgtgaacaagagcttctattgggtttcttcaggaaggaatggatgggacagcataagcagagttaggatttaatagtttgaataatttcagcaggctctgtggtacagaggccgtccatagttgtctggcacttggccctggggtgttcaggggaagtggatagtggcctggcatgtaagagcctataaaggaggtggttgggactatgggctttggattgattggtttgtgtatgaaaggtacgctcctagcgtagttgtttgctatgtctagaagttttctaatcctgggtggggggagatccctctgtggtcaacaaggccctacgatgtgaaagcataagcatatagaaaataaaagtcattgcaaatacatctcatgcccatggtgagagagatactgcaacggtaggactggttcgtgagctcctcaagggagaaattgccttacctgtcattacatgtccagccagagcacagaacctgctccatgggaagtgattacaaagatttgatgtgttctggggcctagaatttactaccggtaagtttggcttgcctcttgaaatgtattaaatatacttagaaggaaaacaaaagaccaaattagaacccttgtttgttcatctaataataacactaatctgtaacactttttctttctttctttctttttttttttttttttttttgagacacagtttcgctcttgttgcccaggctggagtgcaatggcacgatttcggctcaccacagcctccgtctcccaagttcaagcaattctcttgcctcagccttcccgagtagctgggattacaggcatgtgccaccatgcctggctaatttttgtatatttagtagagatggggtttctccatgttggtcaggtctgtcttgaactcccaacctcaggtgatctgctcatctcggcctcccgaagtgctgggattacaggtgtgagccaccgcactcggccaacactttttctttagtgtacctcagattcactaattccctacatatacttccaaataattgacagatgtgaatttcaaatggcacatagtactccgtgtctgagctctttgatgagccctatctacctcccctgtcctgcgtcacttaataaatccacgggcttttcctttctaacatttgtatgtgtctgtttgtgctcactgccatggtgcttaggagatcaaacatatctgttagtacaatagcaaccgaatattgaaaaactgggggtatatagcccacagagtatatcagagtgaataactaaaaccaagctaaattgttactgccaaaataagtggaagcaacagacttctctttaaggatgagaaaattcaagttgttctcattatttaaagatattttgggagtcgtaaaatcaaaagattttattaagcatttttcttaagtttacagaaattatatatccttaaaggaaacggaatacatgcaatttgagtttatttcatattactttatcaagttatgcatttataaatgctggctcacattttgtaaagcccttagcaatttttttagtaatatgttttatattttttaaaaaggaaaactattttagtggaagggaatgccaatattaggaccttaataattattaaatatacctcctttatgtgttaaggttcaagcaacccttgtctttttcaagaaggtaactaaagtttgaggtttgctttagtagggttttttgggttttgttttctgattacagtgtcttaagttcagctagctggcatgaaagtatatattctatatcaaatttattgacaaagtaactattgaaatgagtgctgccctcccccgtttgtaacctccattagcttgaggaagatttgtgaatctacattttagaattggtaaaatctacgtggcatggtcaaaaaccttgaaacgaaatcagtagaccagtccatatagcccctctctgtcctaacgtactgtgtggtctgtgactgatcattgaatctctgaatggaagtggtctggactcaattatttctaaatctccttctttttcaaaaaaaaagattatatgcagaaacattaacataggtataagatgagatgagggcatacatggactgaggatttaaattgacatctactgagattagaatccattgattccaggagttctcaccccatgagtcaatatcaccttagggttaaatgatccatcagattattccttaactcagagcattattcttaattgctacacaaacacctgggaaacatggttactgtataaacatatactaagcggggaatgaagctagtattttgaataatagatttaacacatgaacaattttaggcagttgcaaaaatggttttgaaaatgaactctacatacatggtaatgcagtgggaagaaaatattccaccaatttgaatttgaaaatggtgaagtaaaagtagaatgaaagcagttaacattactcttccatattaaacctttcaaagagtcaccaaaggctttaaatcttgcttaacttttcaatatatggcccctgctacttacctaatttcttgccacactttccctgtgcttcctctgttcccaccaatatgctaagcacatcatcatgggggtcttctctagaatattggattagtttatgtctccctattacactcttctttagtggtattctgtatttcataacagtcatcttaatttcagagaaatgtttaatgtcaatcttctttgctaaaatataagctcaaatactcatgattgttgcctggctttttgaagggatatggtcccatggcttagcacagcatctgctacatgattgctcaagttatgtgctgaaataagtatattaatgtttatttttcaattttatctaggtacgcagagcatgcaaacagtacttgatgatttgtgacttaaagcttaagaaggaaaaaacttaaatccttatcaactccttagtcccccgaaatgggggattgtaaacctagagaaaaacaggattggggtgtgtttgtgtgtgcgtgtgtgtgtgtgtgtgtgtgtgtgtgtgtgtgtgttgcaggatggggagggaggagaaataagtagagaacacccaagatccctatgacattgacaaatgactgacacagagaaagtataatcatatgttatttttgaaggcatgtaaactaaacttggtgaattatacaaacaaacgcataaaaggtcaatttactaatagatgaagaaaacaatctcctcatttaatttatgttttatttgctatttgccttatatattctgtctcttgaaatattgatgtgcttcatgtacaggcactatttctgatgtgatgtcaaataaagagtttttttcttcaactttgtgcaaaatggttttatctctggaatgtttcttctaccagaatcctgattggtcacagttacttaatggcagctgctgtctgcaggaaatgtcaaggagaatagaaaatgggggccagtgatgttggagaatagggagcatgatagtgtgagaaggagagaaagaattgactctttccaatttactcaaacccctagcaagcgttctcagtacaggctgaattgaagatatggtcaaagccagctgtctgtggatgttcactgcacattaccctctccatgcttaatcattatgagtcacctatttgtattgctcaagctcagtactcagactcagagtgtgtctgcttggtgccgaatcactctgcacaaagagaaaaatccatttcatcatatcagtttctttttctatctcagtgattccccagagcttctccagaaccaggtatatcagaaacacagtagataattattaaaaacatagaatttgaactttgttacaaactttatgaatcagaataaccatgtatgtggtctaggaaaatgcattttattaatctccctaggcaattctggtaagcaatggggcaaagaactcttgtaaacataaaactaaattagcaatatgattttctaataattttagaccatttattgttttcaagccatgcctgaaagttagaaacccaattttctagaagtttataagctcagagattgtcatcctagaaaagcaatgaagttaaatggaaagaaaacaggaccaggttttggagaacctgggttcaagtcaggttttgcttcgttactaacttttggtcagaattgactatggaagtatcaatatttgcattatcacccacaaatatggtgatttcatacggttcagccaaatgccttaactctctgagcattgttttctgtattttaaatgagataagaatattatcagaaggctatttttaggattaagtgagcttttacagttgattccactctaaagttataatgtgagctgatctatcatctccattggagaccacactactattaaaggctgatctttgtgttttggcattgtacaccactgaaatatggcctgcagtaattttcattgtacatacacataaaatctactccacaatttaggaaactgaatgatgactgtaagtccatgccatcctatgagacttctccaaaagactcatgaaaaactatgggttcttgtctgcttctgctagaacagtctcttggatttgttccctttccatgcatcctcatgctattccttcaaccctggttacctccattttcttgattcatcaggacatagagcagctgctttattatgttgctctccctaattgtctgaggcatccagggaagaattgctcaattccgaaaaacctttccaatattagcatgctggccctactccaggaccttgggatggagattccaactagctacttaaactatcaaaattaatacccagaaatccttagtaaatgattctggtgagatgatttgtgggtaggtactgtgaatgggaattggtgatttgggagagcaaaaattagttcaccaagaacaaaccgaagtaagtacctatcaattggattttctttttctgggtaactttgacttgtgattgaagacatttaataatgtctctcatatgtccttctgaaaaagttgggaaaatatgtgtttgtgattgaacaattaggtggaatcatagccacctgaaaactgtgctgagttttgttcagagagatcctatgtggtgtcttcacagtgatgtgctggagctctactagctcttgagagcttattgtgtacacctcttcccaatgcctcctttagtaatatcacattggtagcttgaaattgactgcagtgagattacgtacatcaagaaaattggccaacactacaaatctgggcttgtcctctagcaaatcaatggttaaacatttttctgtacaccattgggtctatgttttttccttcaattttgaattcagttactaaaaacatactgtatttattagtcaatatcatagagttggagcagaaaaggatgccacatactctacggtgaggaaattcctagtccaatatgagagacagacatacaacctgaaaaaccctagatattctactccctttatttcttctgtgctctcatttatcaccagtttctctactcatacattgtggtcttagccacaggctttttgctattccttaaaaatcacaggctcattcctgcctcaagcttttgcatttgctattccttctaccaggaatgcccctcttccagatctttgtatccctggctctgcctcagttcaagtaccataccttcagaaaaactttcccctacttacctccaatctaaagtaaccatctcactctgatcctcactctatgatcacaaagcctggttttttaaatttaaataaacttttaattttagaattgctttagatttacagtaaagttgcaaagacatttcaaagagctcctatatatcacatcaagttacctctattttaacatcttacattactatatttcatatgatagaaaaccaaatattagtatattactattaactaaactccacattgtatttggatttcactagtttatatctaattttaaaaaatgttccaagatcacaatcaggataccacattatgtttaatcaccatgtttctttagcctcctctggactctgacagtttcttatatatttcttattttcgatggacttgccagttctaagaatgactggtgaagtagtttgtcaaatgtccctcaatttaggtttgtctgaagtttttctcatggttaaactgaggttatggagttttgggaggaagactagagatgggaagcgccatacttattacatcgtatcaacggtacatgttatccacatgatagcatcaccgatgaagctaacctgggtcactgggatggagctagtgcttgttaggattttccactgtaaagttactcccctgcctcccgttatagttccctccggaagaaagtcattaagtgcagtccacactcaaggggtggagtgttaagctccaattccatgagatgtgagtatataaattgtttttctgtaccacagatttctcccctctctctcatatatttacttatttgatcttttatttattttcatatggattcatatatatatatgtataatattttgtattatgatccattacaatgtttttcttgttgttgctgttgtttttgttgctcaatttgctctagctttgcccactgggaacattttcaggttggctcctgtgtttctttgacatgacttcatcttttttgttggaacactgcattactttctggtactattagatgttccaggctcatcttgtatattctctgccccagccatttctccaggaagccctgattcctgtgattggaggatggtatcacaaattaagacctgagtgcttgattattgcaacagaggtatacttgcttataagccctctcagtgaacagagctaagaaagatatgtatgcttaataaaccatgcatacacacctgtctaaaattatttctgtatgtatccaactatgttaaattaagataaaaatgagtttatactggtctccaatcctaattcagtatcaaagggtttatttaccccctcgtttatctgtaacattctactcaacagttagaaacctgattaacacctgctatccatttacttttttgttcaatccaagtatatctgtgtgccaaattcagaatcgataacctatattctaatgagaaatgactttatcaaaactaggttaccgtgtttatattcatttcctcttgtctttagtcttacagctacaagtccaaagattattttccacagacacaacccaatcgtaatgctcatcatctgaaatatcacacttatttgtatattgtttttatttccaaatagaaaaaaaatccagaagaccagaaaaacccgatatgtctctcttgctaaatattttaaccccagcctcaaagacagtgtcagcacatcaatacaatgccagttaaatattaaataaaatattaaacagttaatatttgttgtatgaagggatgaatggactcagacaacgtattttgaatcacttgattctcttcacttggtcaggcataattaggtactaagtcatgaacacattccttcaaatcatggatgaaaatgttgataaataaaatgttgatgaaataatttgaactgaaaaataaaattgtcaacagatacagatactcataaaaaatgatgtgtttcttccttttctgtaggaaagtaatcaaatgaaggtaatgctaacatttaaatgactggaaccatggggcaagaccctggggccttggtcacccaatcctttacgaattgccttctatttaaataagttatggaaggaaactttgctcttcaggtaggtttgtcctgatcccactcaactctcctcagagaagatgattatccctctattccagatgaattcatactacagtttcaccaaaatatgttaaatctatacccctaaattgctactcctaagacctatgactctaaactaatattgaatgcttaatagctatattttagacaattactagaaaaaatcatctcatgctctccatcattcagtatttttaccagtgcaattgatttaaaaaaataatatttcagaagagttgtttgaatgagatgtgttgcatatacttttccagacattaaaaaatgaatccttagattgtcataacagaagatctggtacttagatcatattatattgcctccttccctgatattcatacatacagaaatgcttttactgtcagccttattgaagaatagtctgagaaacaatcttgataaactgtgtggtgccatggcaagaataaacaaatctaagaaattaaatagagtctaaaatggtttgtttgatgaaagtgtcatttcaaatttggtgatcagggtaagggcaaaaataaagggatattttctcatcttttaatttatatgctttcctgttgttttcttatttttagtaaaaatgtattacttatttaatttaaactgtgagaaagtaaaagaataacaggaaaaataactcttccggatcttgcctgtgtagtaatttaaaagatgttgttcatttacaacacatcataacctcttcttttgaccctgcccagaatgaaaaataattctatttcactttttattttaggaataagtatacccctgagcaactgttttgttgaattttatgaactctgtgaattatgtaattgtctatatgtctcattgtattttggatattagaaaaattagagctaggccaggcatggtggttcacacctgtaatcccagtatttggggatgctgaggcgggaggaccacttgaggtcaggagttcaagaccagcctggcctacacggtgaaaccccatctctactaaaaatacaaaaaattagccaggcgtcatggtgggagcctgtaatcccacctacttgggaggctgaggcaggagaatcactggaacctgggaggcagaggctctagtgagctgagatcatgccactgtactccaggctgggcgacagagcaagactccataaaaaaaaaaaaagaagaagaagaaagaaacaaaaattagagttagagccaaatttgtcacattttaaatttatgctctctttcccaaaaggatatatatttttaaacttactcaaatcttttctgaaacaacatggtgtataaatatatagtgaaataaacagaaatgattaagtgattagttccattagacgattgtactcagatatcccctgtctctagtgcaagagtgccaaattacctcaaattctcatggcaggtggtcaagtcacactttcccttggacagggctggacacaaatggaataattataactcattagctccccatttcgtaggttatatacaaatcacttcatattaaggagatatcacacaaagcatgtccctattacttgccatcatatattgccttatgtgaattgcatttcagcatctctgatagagatttaagaattgctttagtccctggagaacagcatgttaacctcggcaggaatgtccacacaagccacctctcaggaccactagttttggaaatgtcccattgtttcagttgtttattactgcataaaactcttccaatacttaacaaagtaaaacaccagtcatttattattattattactatcatctcttcatggttttgggtgctgactgtactcagcggggcagttcttgcttcaagtctttcatgcactttgatagtgacagggactgaagtcatctgtgagaatgtctgatcttacatggctggcaggtaattctagctgtaaactgagatctcaaaaaagggtattgactggaacacctacaagggggtcttctcatgtggccttggttccaagggtgaatatcctgagagagagtgagccagagggaaactatgccttttcaaacctagcctcagaagtggtgcagcatcattctagccacattttactatttagaagctagtaaccaaggccagcctaagttcaaaatgaggggaattcggcttcagcttttaaagaaggcttcaaagaatttgtgggcatgctttcaaaacatttcatatatcttgctctttgatgttgattattacttgtttcagatggcttcgtttccctctctatggccctgcccctcagtggcatgcaccccactaagcctatcactatcaccaccattaacatcaccacaaagcattcaccacaatgacctggaactctatatctttttgtcactgtattacgtccccaaaactatgcagcattgccaaattctatttctttatgcttaagggaacaaggtgctatgctgagattaatattagctttcactctttgttgctaatgataatctaaaattttaatgctcctctgaatataacaggtacattgattacagcttctggacaattgtagtcatcctagtacccttagtttactcaacaaagtaaaatatattcttcatgtattttgcctttatgtatcagtcaactgtagtacctcataaactattttagattccattcagctggtgatctgtctggtcgggtagggtcaaatcaaaagggcaatatattcatgatagagttgtaaattttttttaaagtcgtttttactgtaggcacatgagatcactggagagaatcaaaggattggcttttatgagtcctgcctgtataggaccaaggttcttagaaattatcgcctaaaatagcatttcatgtcctttggaatgtgaagccttgaaaacattccatattaaaatcttgcccgcagtcaaggcaaaactcaaaatatttctacagttagagaagcaatgagaattattaagatgataatatttacagtgttttgcagtggatatctatgatagaatatagtgaagattttgcaggttgtttgtatgcatgtgatgtaaatttgtttaatggaaatgaagcacattttgctaaatcagtactaccctgtggcatatatgtataaaatcagtcatttctaaatgaatgtaacttgatcactgaactggtattaaatcattatcctatttgttactccacaatttaatattttatgtgaagtgagtgacttttaaccttcaaactaccaattttaaaatccgttgacatcgtatggtatggtatataatatatttagttaaattagtatgtccaatttgaaagacaactcaacttcttttcctcagtatagctatgtgagatttccaacagatgagaaacttctctactgtgtttaaactttgaatgtatttacagagggttaaaaatatcagcacttgcctggagcggtggctcacgcctgtaatcccagcactttgggaggccgaggcgggcggatcacgaggtcaggagattgagaccatcctggataacacagtgaaaccctgtctctactaaaaatacaaaaaatgagccaggcgtcgtggcgggcacctgtagtcccagctacgtgggaggctgaggcaggagaatggcgtgaacccgggaggcggagctggcagtgagctgagactgggccactccactccagcctgagtgacagagcgagactccgtctcaaaaaaaaaaaaaaaaaaaaaaaaaatatatatatatatatatatatatatcagcactttacagtcacatgctggtgaaaattgcctttgaaataattcatgaagtaggaaaagcagaatttaagtatcatacaatgtaatccagttttggttaagatttagtatttgtacaacactaggggatatttagtgtgtaaatatatttaataatatattttgtgttatgttagcatttttattatagaccttaactgattttaaatagacattaaaatcttcacttccctcttctgattagggagatgtttccatcttatgcctagcattaccctcatagttctagaatagttagaacagttatagagcacgtgaatcatattgtagattgaaaaaaatagaatcatttactgagagggctgcagactacaaatttttaataaataaatatttcaccatttgttgtgtatattgaacttgaaagagaaagtaaattgtgtagaatgtataattttatatggtgctgtctctctgtgttagtaatcaaatgtccctctagcaaaagaaaaataattagaggacctctaccaccaccccaaacactcagatccgaaataatgtgtcaagacacacaatgtcataaaccctagtgctcttcctggttgctgttttgctgtcatgaattgacaccattaacacaacttcaattacattatcaatcagttctccctgaactaacagattagtttgtttctttcttactttccctgtaaactataattgacttagtttttcctaggtatccatctacctgagaagtaattataattggttacagaagacctaggcaatagttaataatattttaaattagactgtgccacaaggtggcagacttgcaggtccagaattgtctttaataagtattatccatatcataggctatgaagtgtcagcctagtgaatccagtttataaatattccttatcccacccatataggactttagtctcttaagcttacttcccaatggcacaaggcaaatagcgcatagggagggtatagagaaatactgcctatttctgtctagaaaatgactagaagaaagaagaaaaggagggagagaacgaaagaagcagtcaccaatttccctgcttgtggctgcagagtataggaaggagctatctctgataaataaggataacattaaagtctgagaaggaggctacttgagagatctagaaaaggtttacttcttgggctgccccctctcctaccaaccttgaatgagattctaggaacttggcactttgatgggatctgacagatggaagccctgaaatttcctttcctgaagaaaccccaattcatatatgtcacgggtattcagtcaggatctggctggcctgtcaaaaggaaccctgtagctgacaagctaatagatgtgataggggatcaattgcaatcagcaacctggagccagtggagactgagttgaggaccaatcatacgaaccaaactaaaagggaccagatcactaactgaaccaataacaggcttcagccatgactactagcaaggttaactgcgtccatgtttacaaggaatgttgtgagagaccaggaaaatagagggcatcactttggaggactttggtcccttttcatgtcaaggtgatctttaaaatccctctctcaatataacacaagaccacattaaggtgagaagcaggggcaagtggaggctttctgggagtccaaatattttatcctgataatctgcatctctgaaagatgcttctcaatattattggactaagtttaaacaagattaaatatttagtgataatttttctccattgaccaagttggtgattgacgtggtctccgaatgacaaaataaatgaattttcatttaatttgagttacattaccctgcaagagaggagagacagtgttctttcagctcccctcttagagtaggaaatagtctccttttttttctctatcatatcattggagaaagggagggaacactgcagcactcttgtgttttgaaaatattctgtgaatgtgaattgatgtgcaaatgattattcacattgagaaaaaaagagctttctttaagctccatcttcataataaaaattagtctttaattagagtactagagcttactgaaattaagaagctgtgttttgcacaataaatagtagggactcagtacaaattgtcatcaccattttgaagtctgtcttctcctatgttccttgtctacagtatcttacacactaaaccagttctccaccatcgttgtgcgtgctatctctctggtccttctatctatcaatccatcagcttccttctggttttacttgtgccttccaagctttggccccatgagtagttgtgttaatgatgaaagtgccaagttttgtgtttatcttgatgctcttcaatgggggactgccaggaatacctatagtcaacaaagttgagttaactgtagcaacaagaaagactaaaccgtgaagaacagtgggacacttcaaacaggagttgaggaagtgaacgtttgttctgaagtgtatgttgcaaaaagcaagaacactttttttcagggtggcagaagaaactgagcagggctagaatcaccactggggaataaataatacaggagatagaaagaaattattctggcagatagtagggcaagagtccttggcagaatttcttttctagcaaaaagcaacccccaaaatcatttcttttgtaacaatgagcagcctgaaaaatcaagctgcaaatacagataaggaagctgcaagattgcatgggggagtgctagcagttgcgccaatagaaaagggctacctgggggccaggcatgtccaacatggaggttccatcttccctttttttgttaccacgtgtacagtaataaagaaatgagcaacatggagcagctcaggcagagatcctgcctgcctaacaaaaaattagcagggggcagccagagattcactccctatgcaaatggcacaactggtccaatcagtttttcgtgccctatgtagaccaggcagcacctccccaccagctcatctataaaaccctctgcatttcaccccaggtctggcaacccacttttccaggacctctctctgcagcagagagctgttctctttctttcgcctattaaacttccactctcaacctcattctttgtgtatccatatccttgttcttcgtggaaatgagacaacaaacctcgggtgttactccatacaacaaggtcgtttcagaaacagaagtcgattaagttagcagagagagaagaatatttggtcctttttgtggttgcacagaggttttgtttatgttgtgctgtttaaatttttgttgcagtggtatcatagagtatcgtcgttttcatcttgttttatcacagttacagagaattctcagccaatgttgatgttctatgaaattatgttcagcctgaatttactatagtctatctcgtagcaataaggccaactatcagctatcaagtcttagggctcttggtttcttttcttttttcctttccttttcttttcttcttcttctttttcttttgttttgttttgatttgatttgatttttgagatggagtctagctctgtcacccaggctggagtgcagtggcatgatctcggctcactgcaacctccacctctaggattcaagcgattcttctgcctcagcctcccgaatagctgggactacaggcacgcaccaccatgaccggataatttttttatttttagtagagatgggatttcaccacgttggccaggctggtcttgaactcctgacctcagggaatccacctgcctcggcctcccaaagtgctgggattacagacgtgagtcaccgtgccgagccagggatcttattttctttctcacatagaaactttcacactctgaactaccagatctgtcattccagttaccaagcttttgctgtcaagagttgatctgaagaaaattctaattatttgccttgaaaatccattacaaattaacgttttctaaccccacgtgctctttcactgctcctcatcaataaaaaaaaacctcttgttgaatttctattgtgatcacctaagccacttcagactttttatacactcctcagtggtataatttaatcagcatcttactcttaatagatgactacatctacaaactagttgaaagactgactgcatataattagaaaattcactatctaaacaccttccttcttcattgactctagatgattccgtaaatttaagctcaacctctcatcccagggcaggacttccaatttactttcgaagcttctaactcccctgattccatgttatctaactgcctttgatgatatccaatcaattctttcctctatgtcttccttcttatttttatataataaatgacagtttcctcttgtccacctacattcttttcccaaactaaaaataagctaacctattcatccttgagctcttatttattaacacacttatttgcccttattgcctttacttattttctttttatcttaaaaaatgaaaagtgtcagaaaattacagagaaatatataacaccaagaattaacaagtatttattttttaatgtttttattttaaaaaatctttactactgtaaagatttgtcgtcttacagaatgtaagaattaccttggctaaaggtcagcatgtcatataaaagtaatcaagttcttttctggaatttctgtttcactcttaaaattactttgatctccaagtcatcatatcctgaaactctattgttctgacttttctttttttcacctccaagagtagttcattaagtcctaacgattttcccttctcataatctttcacaatggttgttctatctgtgggcaatgtcacctccaaggcctaagccttattaattaatacagaagtcattccaatatttccttaatgttatctagagtctcctatatccaattattaattttttttttgagatggagtctcgctctgttgcccaggctggagtgcattggcacgagctcagctcactgcaatctctgtctcccgggttcaaaagattatcctgcctaggcttccctagtagctgggattacaggtgtgcaccaccacactcagctaatttttgtatttttagtagagacagggtttcaccatgttggccaggctggtcagaaactcctgacctcaagtgatctgcctgcctcagcttcccaaagtgctgggattacaggcgtgagccactgcacctgatctccaattaatttttcttactttcagatttaccttcctgaaataccacaataactttttcccttatttgttaaaaaaaagtcaaatacacataaaatgtgtgcacatattcttttagctgattgtcaaaattctccaaaagagaattgtttctgctacattggtggaagagccctgtgatcctgccagactcaactactcaccattccctaataatgcacttttcttcttctatattgtttaccctgtatacaattcagtcttcttcatttctcttttgatatctacccatccttaagataatttggccttcgttaccttgttggctttactgatttccctagatcttgtttatatatgacttagtttgagtcatttttatgggtcctgttatatgacacatagagacaattccttttattaatatttctttctcatataattacttttgaagagatgaattttcatggtaaaattagcttaaaatattcatcttgggatgatatagtcaacatgttgaaagaaaaagtaaattgcagtcaagaatactatacccagaaaagctatccttcagaaattatggagaaaaaaagtattttccaaatgtgcaaaaactgagataattcatcactagtatactggccttacaataaatgctcaagggagtcctattctggaagcaaaatgacaataatcactatcatgaaaacaggcaaaagtataaaactcactgctagagcagatacacaaaggagaaagataaaagaatcaaaacttagcactactgaaaaccaacaaacctcatttataaacattaagagaggaagaaaggaacagaggatgtacaaaacaaccagaaatcaattaacaaaatgacaggagtaagccctcacctatcaataataaccttgaatataaatgatttaaattcctcacttaaaagagacagacatgctgaatgaattaaagaaaacatgacgcaactacatgctgcctacaaggaactcatttaatacatacaaactgaccatgaagggatagaaaaagatattctacacaaaatgaaaccaaaaatgagcaggagtagctatatctatatcagataaacagactttaagtcaaaaattagaaatatatagaagagtctgaagggcgctctgtacatatggtcaaatacttctcaggcgtgaccaagaaaacatgttcaaacaacttcttccatctacattagatagccaggttgtgttttcttttagtttagatgaaaattgttccatttcacctgtgatgttaatctaggtacaatatgaagttatttaccagatttttgcatctataatgtaatctttaaaccttttcattgttttttatctgttgtataagaggtctttgcctaaaggctttagacatagcaacccattagactgaaaacatatcaaagaatttcctttcaattctgtagaatttcttttactgtgggcctctaccttgattgacaatttctctgggtagcataatggcattaagtatattagctctcagtgcatatatttactcttttatttttttagtaatttgacatttctagaaagagccacactttagtcacttgaatttatttagcttctagttaaggaactggattctataagaggctggactagttattatagatgaagtaatacatattaaataggatactaattaatatatgttaatagaagaactactatgaatgtatagcattgttttttccaaccatgtgaatgcaaactgcttctgattcttcttattgaatgatatagaaaataatgcattattagatcaatagctgcaaaccgtgtctcaaagtttgcattattgtgctctagtaaacaaacccaattcaatacagcagctgcaataacagctattacatagttaagtttgcagtagtctatggttatctgtgataacccatccactctgtgattggccagattgattaattaaatggagttatgatagaatgccccccaaaataataaagctactgatgaagacagaagcctgattagaagtttatgaatttacaactctctaattattaaataagcatgccacttatctgtttagtttatatactgttcacattaattatatgccactaataaaattatttgaatttccaaaagcatctccattctcatcagtttcccaattcacactcataattccttggctcaaaatttaatcttccatattttcatctaaatttgccattgatattacattcactcaagtgacccaatattttggatatttttgtttccataagtaaaaaaatgatgtatggggattatttcttccttataggattaaaataaaccattatgtgagccctttagaatttcatcaaaaacatttttgatattgggaaataatataaccacaaatctcagctaagtggtaatcttccttgatgttgaaattccattgttttaacatacagtcccaagaatatgagttctcatacagcactgaatccttatcacaagaaattgttgctgattctgctggctgtagcccagctcctttagtaatttttctccactgaaccaaaatgaataataaagtatgttctctgtgctccttagcacccacatatctccacccacccatcttctgttccacaaccaaaaaataaacctacatacacttttaaatatattatggtggatctaatttagaattctataccaggatgttaacatatttattatttctcataaatatgctccaatgccaaaattggccatttctcctaaaactgataaaagaggtactttccttctgtacattaatttgatatcactcttaaatattatttattacctgatataaaattattcaaatgtagtatgtttgtattacaagttacacagttattaaaatactaagatattttttaaaatggtgtactccctctaacaagtgagaataaaaaatagaaagatatttaccatgagtcaggaaatttgagtcacttatatgtgcaaaaatagataagcttcagtagttcaaagatttgagccacatgtcaaggacagcattgagtgacaagtattaggagcacttggtcttcacagaatagaatgaagtgttaggaaaaaaattaacaccatttctctacaaagtgtttaggaatagctgagaactttcaaggctataaactatgaaaaatatcctggggtaaccctagtagggacagaatgcttccagttcatgggataatagtattcaaatctgaacaagtttcaaaagaattacagattcctaagtcagcattgctcatttttcatctaaagtatgctgcccttccctattatttacttttttatatattcttcttgtcttaacaaaaaatttagccctgttgtattgagtcatgagagaataaaactcatggcaaaaatctaaagtacgttgtcagtgataaatttaagcaaacctctgacttccatggacaatttagtactaaaatcaacccagttagtcatattttcttttatactcctagctgtttggtagagaacagattaagaacatgtgtgtttgtgtgaataagctcatcttcacattatgaatgatgtaggcctcatctccctggaatccaacacaactgtatttgttggcctagtaaagatgcacagtcacggtaagcatggtttcttgtggatgtctttattttccaatagcataccatgccaatgaaattcaatttctagtcttggagatgggcaggaattcactctccattgcacagattcatttatagcttctctataactgcctaagatattaaaaggcagtatgacactaatatgtttttacaactcaggattatatttgtaattttctaatttaacattatagattgttaaagaaaaactattcgcgacatttgttaaagatagtaaggcagactttattcaaagtccaacaaggacaattgggggtatataataaccagtgaacatggtggcagatcagtggatgaaaaattactaagagaaaatatcaagaataagggatttctggctaaactaacttgataagatcattgctgaagacagaccagagttacaagatgttaagaagggtggtcagataccaagggtgggggattttccctaaacattcttggtggaattcttgctcaaactagattctgcagggacggggagggaagtccaaggtccaggataatcaagcaggggattcagaggagcttggctaaggttttggttaaaggagagagttttttgccaagatgttctcagtccttatgctagatagggaatatgaacacagtagacctagacttttgattttgaaggcaactttattatttctgcaccagagaataatcaaaagaattaacacctccgtgggagttagggatctgatactctgtctttaagaattataatagcccaaggctcaaatactactgggtaaagaaatatctgagtggaacaacattaatcggccactgttattataacccaggatcatcatatgggcatagattgggaatgtgtttattgccttggtttcaatgacttgccttatgcatgtatcccaaaagggtcccttgcagggttgtctgcaaatcagcatagtttaaattctcaaaatgccacaaagtagcaattcttttaatcacttattaagataatcaataaaagtgagcattttgtaacaagaatgggccattaggagaaatgcaaacaggagaatggagaaaataatctatagcaaatgaaaaaaacagaagttcaaagttttagctactttaatggagatggtcatcatttattttgccctctcaaacattttgtatgtcgttatgtaaaagaaagttaaagccatcatataagagaataccaatccattcttcccacttatggtcagacactgaggttctgaatttcttacacggaaatgctctgaagctttcttcaggtttaagagattcagaaactggtagggaaaatgaaaataatttagactaaatgatttttttattgcccctgtgggagggaaacaaaaatgactcaactgttttaataaggcttaaggttcatttaaagaatcttcatgattcatctgcctttattttttctgtcatgaaaccactcaacgctgttcccaaaagaagagacagaaatgataataaggaggataccagcatataaagataatgactggtaaaattagtttaaaaagttaaacaaggcatagaattcagacagtaaatgttagtcttaatgggtggtgtgtgtgtgtgcgcgcgcgtgtgtgtgtgcacaaattattttcattttatggctatcacatatccacagatgatgcttaactgaagtcaaattcatttctcaactttcaagataataagttatctcagaaataactgcaacttcttataaacataaccattgtaaagtattttcaaagttgagaagtgaaattattcttttttctgtagttcagtgagtagactaaaagtatatatttttttcatttgttttatttttctttttttgtcatgtcgctagactggaaatgctgattcattagcctctgatgattgtggtgcctgcaaagtaccttacttaacagtttgtctcaacacatttatttacaagcaggtcatatggcatgtaggtgagatgctctgactttcactgttgcttgagaaaggctttgacagaacacagtcagttcctccctaggcatcagagtctggcaatgaaaactcctgcgtatggtcccttttggtttacccagtattatttctgctcttttgaaaaatattgctaaaaatgactgatcccctttacccctctacaatatctatattgattaaacaaacaaagaaaaaatggtgagtaggctttggcaaagaaaacactggaaattattccactgccagcaaacctgcaagataattaaatatatttttgtttaggctggagttttttataatatatttttccatcttctgcagtatttttgtaatcagtttggacactcctcaagataattgcctaatcctatcaaaataccaatgatgctcttcacagaaagagaaaaaaaatcctaaaattcatatggaaccacaatagacccagaatagccaaataagtattgagcaaaaagaacaaagctaaaggcatcaatcacattacctgacttcaaattatactgtatagtaaccaaaacagcatgatactggcattaaaaaaaacaacacatagaccaatggaacagaatagaaagcccaaaaataaatctacttatttatagtcaattcttttttgacaaagtcaccaagaacatacattggggaaaggacagtttctttaatcaatggtgctggagaaactggttatccatatgcagaagaataaaagtagacccttatctctcaccatatatacagatctaatcaaaatggattaaaatacctgaaactatgaaattactggaagaaaacattggagaaatgcttccagacattgacctgggcaaagatttctttagtaagaactcaaaagcacagtaaccagagcaaaaacttaaagatgggattacatcaagctaaaaagcttctgcacagcaaaggaagcaatcaactaagtgaaagacaacctacagaatgatcgaaaatatttgcgtactatgcatctgacaaggggtttgtatttagaatatatgaggaactcaaacaactcaatagcaaaacccccaaataatccaatgaaaaatgggcaaaagatatgaatagacatttctcaaaagatgacatacaaatggccaacaagtatatgaaaaaatgctcaatgttgctaatcatccgtgaaatgcaaaacaaaaccactgagagatatcatctcacttcagttaaaatggccgtcattaaaaagaaaggaagtaacaaatgctggtgatgatgtggagaaaggggaatgctcgtacactataggtgagaatgtaaactagtacaaccactatggaaaatagtttgtaaatgactcaaaaatctaaaaataaaaataccatatgatccagaaattccactgctgagaatatatctaataaagaaggaaatcggcgtattgaagatatacctgcactcccatgttttattgcagcacaattcacattagccaagatacagaatcaacctatgtgtccattaatggataaataataaagaaaatgtggttcattgaaatattattctaccataaaaaagaatgaaatcttgttactttcagcaaggtggatggaactgaaggacattatgttaagtgaaataagcaaggcacagaaagacaaatattgaatgttttcactcatgcgtgggagctaaacaaattgatttcatggtggtagtgagtaaaatggtggttaccagaggctgggaagggcagtggggggaggggataaagaggggttatttaatgggcgcaaatacacagttagagggaatatgtcgtgtttggcagcacaaaggcgtgactatagtaaacaataatttttttttcttttattattatactttaagttttagggtgcatgtgcacaatgtgcaggttagttacatatgtatacatgtgccatgctggtgcgctgcacccactaacttgtcatctagcattaggtatatctcccaatgctatccctcccccctgcccccaccccacaacagtccccagagtgtgatattccccttcctgtgtccatgtgatctcattgttcaattcccacctatgagtgagaatatgcggtgtttggttttttgtccttgcgatagtttactgagaatgatgatttccaatttcatccatgtccctacaaaggacatgaactctatcaaaataactggaagagtatatttgaaataatcccaacacaaacaaatcataagtgtctgaggtctggtatcccaattaccagatctgatcactatacattgtatccttttatgaaaatgtgacatgtatcccattgatatatacaactgctctgtatctataaaaaattaaaaagaaaaaaagagaaaatttccagaatgcgtcatagcagcagtggatgtagaaacaaggaaaaaggaaaagaattgctatgttgtacccaggctagacctatgtgttcccaattatcagaacatctcctacctaatcaaatgtttttaatatccatcaaaaatagttgaaggtctcctattgctcctgagcatagcaatgcaaacatttggcagtgttcacccaaagaacatgggccagaaatgccagattattttattttgtctgtgttctctctctcattattctcccttgctttactgacctattatctcctgcctactctgtgtcacatcttcaagcaggcttccattgaaatcctcctgtcccttctccaccatcacttcccaattttatcattcctcatattcatcccagattcttgttccttgtctcctttcctggacaacactggaatgagtaactgacttctaattattctgttttaaattttccagttcagagaattcacaatttgaatccaacccccgggacagggaggttggctgaagtcttgttatgccaagtatggcttgaggactagcagcattcgcatcatatgggagattggtagaaatatacaagctcagattttactacagacgttctgaattagactccatttacccgcattttaacaagatttcctatgtaattgtttctgcacattgaagcatgagaaacactggactagacttaaagagtgtaattggattggtcctcaaacttatttttaacagcgcatctttctcaagaaaataaacagagtacatttacctcaaaatatgaatgtagctgaatgtcacattgggagtttcaactgaggaacaaggatacagcacatacaacgttccaaagtgtgtccgctgtactaaattcaaattttcaaagaaaataaaagactgctaattttctcaaatcctgaaatcttttaagggtattaaagagcagactttgaaaagtaaatttgtgagatttctctggaggaagctgttgtcatgctatgatctcacccgctatccccatcagtcccaaggtagagagttggagatggcatgatcccacctcaatcctgaagagaaggatttgaatgaagccaagacgctcatctgtgtttcttgggattttcagagttcagtggactggactatcactactgagaagcaaaccataaagtcaggtcagatgtgatggtgagctctttggtgacaaaacaaaggaaaagtgactgtacagaaatcagcctgccctccaagagtttgacaagaggaaataatgaatgttttccttagtccacaagcaaaagaaagctggagacaacttgactctggcccaagaaacccaatacagagggtaaggagactgctaaatgtaaattccagaagtcagtcagaaacatccattgattacttaaagatgagtctatgaaactcactgcaataagggagaagacctatgtatcaaacacagcaaagttgattagacttactgtagtaagagagacctcgtgtaagggagtcttaagaaaagggaagtcaggagagaatatttacagaattttagaatctgggtttggtgattttaaggctgatcttgtgaagaagggaactgtttaatatcgggcacagtttatgacataaaagctttgggttactttagtggattcagtcttacgttcccagagaaactatttcctggagcaagtaggtaaattatatattttttattctcagtaagtggccttttatgacaaaatttcctagggttgaggggagatgtgaatggcaaattattgctaatggatatgggcttattttacgggtgatgaagaagttctgaaattagattgtgttgatggttgcataactatgtgaatatacaacaaacattgaattatacaatatagcagaatgaattttatggtatgagaattacatatcaacaaacctgttattaaatacatatatacgtagtaagttagattatgagcgtgtgtgtgtctctaaatgtttatgtggtagcaactactgatggtcactagtcaactctgagagggccaggacattatagacctatctatttgtttttaaaaaagagcataatagctctaatgtcaactatgctttttcttgtgctgtgtcaggagttaacctctgtggaggaacaaaagatttgcatcaaagacataaatactttggaaaaccgaagccttgtattaattttttaatgtttaatttttgtaggtacatagtaagtgtatatatttgtggggaacattagatgttttgatatagggaagcaatgcataataatcacatcatgggaaattgagtatgtatcccctcaagtatttcacctttgtgttacaaataatccaattatactcatttacttgctttaaagtgtacaattaaattattttgactacagtcacctcgttgttctatcaaatactaggtactaataataacatcatggaaaacagggtatccataacttcagcagttatcctttctgttacagacaatcaaattacactcctttagttgtttaaaaatgcaccattattattgactatagtcacctgttgtgctatcaaatagtaggtcttattcattctttctaactatttattttgaacacattaaccatctccacctccctggcaacccctcactactcattctagcatctggtaatcattcttctactctgtccatgagttcgattgtttttatttttagatcccacagataagtgagaacatgtggtttctctttctgtgcctggtttatttcacttaacataatgaccttcagttctaaccatgttgttgcaaattacaggatctcattggtttttatggctgaatagtagttcattgtgtatatgtaccacattttctttatccattcatctgtcgtcagacacttaggttgcatccaaatcttggctattgcaaacagtgctacaacaaacatgagaatgcagatatctcttaagtatactgatttcctttcttttgggtatatactcagcagggggattgcttgatcatatggcagttcaattttcaattttttgaggaacctccaaactgttttccatagtggttgtactaatttacattcccaccaacagtgtaaaaaggatcccttttctccataacctggccagcacttgttattgactgtcttttgaatataagccattttaacagtggtgagatgatatcttattgtagttgtgatttccatttctttgatgatcaatgatcgtgagcaccttttcatatacctctttgtcatttctatgtcttttattgagaaatctctattcaaaattttgcccattttttaccggattattatattttttctctatagggttgtttgagctccttatgtattctggttattaatcgctgatcagatggatagcttgccaatattttctcccattctgtgggttatctcttctctttgtttactgtttcctttgctggtcagaagctttttaacttgtaatcccatttgtccatttttgagatggttgtctgtgcttgtcgggtacagctcaagaaatttttgcccagatctatgtcttggagattttcatcaatgttttcttgtagtagtttcatagtttgaagtcttagatttaagattttagtccattttgatttgatgtttgtatatgatgagagataggtgtctagtttcattcctttgcatatggataaccagttttcctagcaccatttattgaagacactcttttccccaatatatgttcttagcatctctgtcaaaaaattagttccctgtaaatttatgcattgtttctgggttctctattctatttcattggtctatgtgtctgtttttatgccaataccatgctgtctgggttactataacaatgtagtataatttaaagttaggtaatgtgattcttccagtttcattcttgttgcttaggatagctttggctattctgggtctcttatggttccatatatattttagaattgttttttctacttttgtgaagaatatcataggtattttcatagggattgcatggtctctgtagattgctttgggtagcatatacatattaacagtattgattcttgcaatctatgaacaaggaacgacattccattttttggtatcctcttcaatttctttcttcagtgttttatagtttttattatagagttctttcacttctttggttaattccaaagtatgtaattttatttgtggctactgtaaatgagattactttttaaaatttctttttcaagttgttcattgttggcatatacaaatgctactgatttttctatgttgattttgtatactgcaactttactaaatttatttaacatttctaatagttttttgtggcatctttaggtttttccaaacataagatcatatcatctgcaaataagaataatttgatttcttcctttccaattttgatgccctttatttctctctcttgtctgattgctctatgttaaataatagtggtgacagtgaacatcttttgcatgttctagatgtcagaggaaaggctttcagtttttccccattcagtatgatactagctgtggttctgtcgtacatggcttttattatgttgtggtatgttccctctaaactcagcattttcaggtttttttaatcatgaagggatgttgaactttattaactgctttttcagcatcaattgaaatggtcatatgatttttgtccttcattctggtgatatgatatatcatattttttattttcagttgtcgaaccatctttgcatcccagggataaatttcacttggtcatgatgaatgatcttcttgtaatattgttgaattcagtctgctagtatgtggttgaggatttttgtatcaatattcattagagatattgtcctgtagttttatattttacgggtctttgtctggttttggtatcaaggtaatactgtccttgttgaatgagtttggaagtatttcctcctcttctaattttcagaatagtgtaagaagaattcacattaattctgctttaaaagtttggtagaggtccaggcgcagtggctcacgcctgtaatcccagcgctttgggaggccaaggtggaaggatcacaaggtcaggagatcgagaccatcctggccaacatggggaaaccctgtctctactaaaaatacaaaaattagcctggcatggtggtgggtgcctgtaatctcagctactcaggaggctgaggcaggagaatcacttgaaaccggaaggcagaggttgtaatgagccgagatcccgccactgcactctagcctggatgaaagagcgaaaatccaactaaaaaaaaaaaaaaaagaaacaaaatgtttggtagaattcagcagtaaagccattgggtctgagacttttctttactgggagactctttactatggcctcaatgttgttagttattactggtctgttctggttttggatttctccctggttcaatcttggtaggttttatgtatcaagaaattggtcaattaaaaaaaaatccacaacttttgctttcactgatcttttgtattgttttcttcatttcaaattcatttatttttgctgtaatctttattatttcctttcctgtatgaattttggatttggttttctcttgcttttccagtttttaaagatgcatcattagattgtttatttgatgtttttcttcttttttgatgtagtcacttatagctataaacttccctctgactaatggctttgctctaccacataggctttggtatgttgtgtttcctttatcatttgtttcaagaaatttttcaatttatcttaatttcttcactgacccacagactggtacctgttagcactctttggaaatagctattcaacataactaattatcagggaaatgcaaatcaaaaccacaatgtgatatcacctcactcctacaagaatggccattattaaaaataaaacaaaaatagatgttggtggggatgcagtgaaaaagggaacaattttacactattggtgggaatgtaaactagcacaaccactatggaaaacagtgtggagatttcttaaagaactaaaagtagatctaccatttgatgcagcaatcccactactaggcatctacccagaggaaaagaagtcattatacgaaaaagatatttgcatacgtgtttttataatagaacaatttgcaattgcaaaaatattaaaccagcccaaatgctcatgaatcaacaagtggataaagaaaatgtggcatatatatacaatggaatactactcagccataaaaaagaaagaaataatggcagtcatagcaacttggatggaattggagactattattctaagtgaagcaactcaagaaaggaaaaccaaacatcgtatgttctcactcatatgtgggagctaagccatgagaatgcaaaagtgtaagaatgatacattggactttggggatttggggaaaatgtcacagggtggcaaggaataaaagagtacacattaggtacagtgtacactgcttaggtgatgggtgcaccataatctcagaaataaccactaaagaacttattcatgtaaccaaacaccgccttaaaaagtaaataaataaaaaagaaaaattgatgatatatcaaaaaaaaatcagttgtacaataaagaagaattaccttaaaattcatgtgaaaaaaaaccccacaaccaaccaaccaaccaaccaatacaacaaacaaaacatcctggattttagttctgtcaaagctcaatacaagtcaagtataatttggcaactgagaaactcttaggttgctataatagtaatatgaaatattagattaatgtgaaatatcatattaatatggaatcttagataagctttgttgaatctatcctggcattagaattagtgattcactaggaaattgttgaggggagttttatttctactacccagagtatgtttcttttctcaatgtaaaagagtttatagttcatgtgttcctgccataattgaatcaaaaagcattcttacacataatttgacttctccaataatatttttaaaatattggttgagtgcggtggctcacgcctctcagcactttgggaagccaaggcgggcggatcacctgaggtcaggagttcaatgccagcctggccaatatggtgaaaccccctctctactagaaatacaaaaattagccaggtgtggtggtgcacacttgtaatctcagctacttgggaggctgaggcaagagaatcacttgaacccaggaggcagaggttgcagtgagccaagatcacgccattgcactccagcctggatgacagagtgagacttggtctcaaaaaaaagaaagaaagaaagaaatattaagcaagtatttttagaaaatgcacaatatagatcctagactgtgaccctcaagtgtactattttactcatcttgaactcaatactttactgatgcttacagtatattattaacatattcatcaccatatttgctgatgattcaaagaaaactattgtctcttgttagaaaataattttcacttacagaaggaaaacgacattaaaccaaggaaatcaattttactttagaaacaataagatgttggaggaaatagtttgtcagttgataacattatgaaaacctgaaacatcctataatggaaatgaacaaacagacatggctgccactcttgactatgtaaatttatgaggagttgtttcacatctatttttcatggtagatagatgtgactttattattttattgtgctggtttcctaatttcctaagcacaaggtaacgatcaccagtgactagtggatgatacatacaaaaatagaaacaatagaaattatctatgagaaggatgtggaataggaaaatttaaggactgtaattcgaaactagtgatagtattattattcaaaataatagcttcatttgttttgagcaactattatttccagacacaaagccaggtcctttaaaatgcagctttgctttgtattttgataaacatgatctcaaatgttgcctacactattacccaaaagcaagtactctgttttgatgagtataaattatcctggatggttttccagaaaaaaggaacacttttaacaatctgtatcaaagacagattactctaatgtggatataattaagagagaatgaccaaccatccagtgaaatatctgaaaattgaatttgaaaattaattaaatgataataaaagcctattataaaatgcaaaaaaatgattaaaactaactgggttagaagtatcttgctaaatcacagggcttggagaaaattctctacagatacaacataaagggcaaaaaaagagtttctctgttattcttggtctggtgagttcactgatgcccatcatgaggttggaaatgggaaagtgacctactagcatgtaaggcagcctagtgaggtgcaagaatcactgaactagaagtcaatagttcttggtccttgctcgctgtttcactttgaggaagttatttctcttctttgagccttagctttttcattcataaaataaaggaattggaataaatgatggtcgaggtctttttatgttccaaaatactgtaattactagataactaaatgcatttttattgtcttgcattcatattttacacatttattgtgaaatattgatttatctattacagcagtttggcctatcccaagatgaggggaatttaattaataaatggaataaataaaatgcttttagacttgcttttcatacagttttgaaattggcatgcactcctaaaacacagatgggaacggtatctctgtctctgtctctctctttctctctctctctctctctcacacacacacacacacacacacacacacacacaaaagcacacacatacatctctaccttcattatccgtatcatttctgattatatccggcaactagaaggcagtctcagcatatatagcagtcatgacctcagatatcttctattttgaggcaccaggctgtccaggagtcaagacagtgaaacaagtcagcaataatatactaaatgcctgcctgagtctgacctgcaccaggagataggaaagacaaatatggcaagagtacttcctctttaggagcttatatagaaactaagtgttagataaactggagcccaagactcttctgtatctgattccattataactctctttaaccatctgattaaatcaagggtgtcaatatctctgaagactatgtagaccctgtgcacagggagaaaaaatgtttttatctccatatggctcatgaggaaacatttagtgtcataagcaccttgctgctacattgtgtcaaatctttggcttgaggtaacaggacaagcagtatcttatcacctggagctgaaaatagaacagcctagttttcatcagaggaaatagtggcccatgactcagagttctagatcaaaggtctgtcactagttggagcatgtttagacatataatctccatttagtgttacgtcttaattgacaaacatggaataatgctgctgcctgacctggcaacagggtagatagaagtggctattaaaattcattacattgttggaagtgaagagagggacacattgattctgtacattgagtttaaactgaaagatataactttttctggtttctctaatacatgatttttgaaataagccattaagaaagttgatggaacatttgtgtaacatcagatgttaatttaatcttaagtaaagtgactttcttccatcacatagtagaaaatgacaattgcggttaatgaactgtggatccactttggaaataataattttacttaccttccagccactaatttaagtgcttatcaattagttattacgtaccctgaattttagtcagtaagatttacttcacttattaaaattcaaaagaaccaataaagaattatttgagaattacttcagtaatattttaggaaaagtaatggttatttttgacatgatatatagtgcataattttgtctttttagtttataattgcatctggataggcaaataaaataactgacagcaaaaataaaacttgttaatgccatgtcatcagcaatttttgtgaaacaagcattggagagcaacaaaactagtcagaggcctgaggtatttttgcactgtcacttaacatagaaatagccatccaaattttgtttctataacctcgaggaaatctaaaaaccttcagcattcatcaaatgatgacttcactgttgcctcattaaagccttgggtgtcaaaatgtacaatgatcaagattgtgagtgccattatttgtcatattttcaggattttctgatttgcatgtagtacctgcacatattcatgtaacattagagaaatccactatcccacatgcttctattgggcattatctattataatacaatctattaaataagatattattcaattctttttattttaatattattagctctatatttgtttgcttcataagaaggcatttttttcaaaagaacttaatgactgaatggtccttaaattacaagccacacagctagcacacaatccaaacctcaggaaaccatggtgtgaaaaaatgaatttacagcaaatcatccaaagcctggagcagtgaatcaatgtacagggagagcatagcacttgacctcttcccaatttcctttcgtcatgtccagtgtttgtttattctctgctaaagtgtgctgagccatgttggcaaatactatcatgggatgtttccattgtttattgtgtggcataaagtttctttcaaaataaaagcaagaccctctctgttgcagctctggaatgtttctcatcactggaagtgtggggtctgacttactctttatacctaatttctgctactttctgggctggtacggggaaagtctgcagatttggtttgtagaatctaaaagtttttaagacaaagagatcatttggttcaataattcatatccagcttaaatctgttacacaacaggagtggagggaagaaatacgaggaagagtacattttattgttgctgctgctgcatgagtcgggatctatgagtagtgttgtgttgggtgctatatgcatgagacagacacagtttcaaatcccagctctacaattgactatttctgcgatgtcgggctcgcagcctccttaggtttcagtttattcacagactaaatgttgttaattcctgcctctcagggttgtgtagggttaactgagatcatgagtgtatagcacttaacattgtacatggtacatagttacaggctgtggttattgttcagtaaatattctttatgatgacggtcatgatgaaaactgctgataattgtgtattggaggatcactggaaattttcttcattcctgatagactatggcacggtgctgttagcaggttaaaaaaaaaaaaaggatgttgccaagtaaaagtgcaaagatcactttatgtggtcgacctccatccagtacatattgttggggttcagattgtttttgctgtggttactagagaagcttctgggggaaaagacactgtattccagttcaaattgagacccagtgtgtctgtgctttgagaaatttgttctgatgacccatgaggtatgagtcacgtttgttctcatgactaggctggcgaaaattcatgtgttggaatcatggctagacaagagggtgaaagcatgcaaggtgttctctgcttttagatttctggagacagtgagaattttctgctcagcagtataatgaaggaggtagcaaactagataattcttcaaaaagactgatctggagctcaaacttcacaaaaaagccccagctgtgacagctttattagtactcctcacgttcctgagccttagtgtcatcagcttccaggagatattcccaacctgcctgtctatttaaataaaataaatatgtgcttagaatccacaaaactctgaactaacacagtgtgtctaatatttgtgctagtgttactgtataacaacagaggtaaatctgcaggcaataaaagaaaaaagaagaggacaataatatcaggggaataagaacaaatgcgtgatccaggaaaagctatgcctcagagaagaaacaataatattttatgggaactgcgtggcatgtaacatagtgattccctattctgattctctttagtggactcatttaacacttatacctacagacctggaccatgatccatgtcctgaagacagacttgttctattcattttcattctcagatgcaccaggaagtagctcagcagcaccacaccaagttatataatcacaactctgttaaataactgatgttcaacatacgcacaaagcaagataagtgctatggcaaatgatcagtggaaaagtagccacaaggtggaaccagagggaaggttggaagcaacaagactcccccctaaaggctgccaattcaataggatctatagctacttgccaagatagctgattcaggttaactctgattggttaaaaatactctttggatatggagatttaaccagctgtaaatctacctaattattcttagctcatgtctacattttctccaaatgattctgttaggtacatctcatatgtcttattgcaatcaagaaataatgccaacaactttcacttagaatactaatgtactgatactccataaaaaggacataaagttatttcagtgtgacttgttttcgatgaacccacaatgtctcctttgtaatcgtatttattccatacaagatttgggcactttcagaatctcctgctataaattgtttcctgggattctccaacttttagaaaattataataatgtttctttttcattcgaattctagagagaatattcgaatgtccttttgaatttcttctgtaatatcaattaagttgggcagtaaatgtagaattaattattatagtaagtatttaaaatcatctcctaccttttctactctcatatagttcaatttatccaacctgttattgtatttagtcttagtatatggaagtgttttgctggccctagaaatcgtgaatgagcattgcattatggacgctttcataatgagttttgtgaatgagcattcctattatgccttgtgtagatgtactgaactacaagctcctctgggtctgtaatattaggaagctattttgagactgtgatggttggaaggtgaataagaaggaaatatgtagtgtggttgctgaaactagtattcaaagtatcataaaattccctagtgtattcaacctgatgtaattcataaatgcagcaagagcatatgggaaggggccacacttacggccagataggtgcaagcattgtggttcatggaaagctttttgctgaaaacaaaagatggagctccacatctaggggtagaaaaaagacaggcgtttagaaatttagcaggaatcaaggcctcattcggagtttcttagcccacagaaattggattgttttcagtgtactttagcagaagaccttttaggagaaaggatataaataataaacataagggatcaggtgaaaggtcagtgtattgggcataaagtgccaaaaacatactaaggtccagtatttacactatcaagtgactaccttctttgttccgtatccctaccctgggataccttctctccaggtccctgaacccctccatttggacacagcagctttcagacacatgttgggccatgccaggtgtacactcatgtactcataggcctagcatcccgcatgcctagccacaaatatacataactcttcctagatatttaaagataagccagccatatatacccgttaaagaaattatatgaacataaatatatatacccatagtcatgttacacaggcatgttaatacaaacacagaaatttacaatcaatcaccatatacatgtgcaacatacatttatcaatttggcttaaggcagaaaaccttttgctacaggtatgggtagatttctatgttctctgaagtttgcttaactttggctcagatctgagcaacgtgtctccaaaagaaaagtgatttactctatctacagttgggcaagctcttatgaagcatgatgattttagataaatgctgccatttcctacatataattgatacacttttgaaagagttttgatttatattctgttatccattctgttttctagaaacacactgtttaaataactatataataaattcgagcaacatgaaaaaatattttcaccccagaaatagattatttgtgtgatattttaagaaaatgtactcattctacttggaatagtaatgtcaacagggaaaatgtggtgatgggagagttccattttcatttttgacagagtaacttatttcaaaacaactctaccattgagcatagctataaaagctaagcaaaatagaaaagaacagctatgtaaaagcatcagaaagcaataaaagaagtgagaacttgtgaggccaaggtcctgtgggtaataaaatacattgagattgaccaaatcttttctgtttctctccctttagagtcaaatttttatgaataaataaacaaaacttgctggagtttctttgggattgaagaacaacattcatgaacttgacctagttgacatatacaacactgttccgtagttacaatatatactcttttctagtgtacttggaaagttatcaatattaaccatattacagaccatgaaacaagctttgacacaatttaaagggatgatgtttattgcagagagtagaattaaataaaaaatcagtatcaaaaagataaacagaaaaattccttaatatttgatattaaactgtatagttataactaaattgtatcaaacaagaatgacaatggatattttaagttgctgtgaaataaatggtaacatagttggcatataaaaatatgtggcatgcaactaaagacattaataaataaaaattcatagactcaagtataaatattagaaaataagactgaaaattaacaatctatatatttagatgaggacaggaaattaacccaaagaattagaagaaaaaataatgatacatgcagaaatccgataaataagaaacaattataaaatgaaatcaacaaaaccaaagttggttcttttaaaaacaacattaggcccagcgtggtggctcacacctggaatcccagcactttgggaggccgatgtgggcggatcatgaggtcaagagatcaagaccatcctggccaacatggtaaaaccctgtctctactaaaaatacaaaaattagctgggcgtggtggtgcacacctttagtcccagctactcaggagactgaggatggagaatcgcttgaaaccgagaggcggagattgcagtgagctgaaatcacgccactgcacttcagcctggcgacagagtgagactccgtctcaaaaaacaaaaaacaaaaaaaattaatcaaagagaggaggcacaaataataagtataaagattaaaaagaagatattactacagattttattgatattaagtgattatagaaagatataagcaatattatgataataacttaattgacataatttaacaaaaatgaataagaataaagggaaagtcaattgtttctatatctaataaatgtgtctgtaattcaaaacctactctcaaagcaaattctgagttcaattggcttcaccagtaatttctttccaaataaataaggaacaaattaaatgacaccaatattatataaattccaccagaaagtgagcaagatttccaaagttctacaaagccaacataacccaatgtcaaaatctgacagggacactatgaaatgataattacctcccaaactcactcatgaacacagatgctgaaaaactaaacaatatggatttgattttttaaatatattgcttagtttttctgcacctgtgttcataaatgtagatagtggaactccctggtgacttcaccttccagattattacaaatagcttgctgaaaaagcctccaaacctttctatacaaatccaaaatgttctgcaattttttcgtgcaacatatctcactcatttttccatgtcagtatgtacagatccacctaatgcatattaatgtctttaatttggatttggacatcttttatctcttctactgatggatattttggctgccctcaatcttccactgttaaaaacaatgtgataataaacattcttgtatatgtcattttgtacatagaagaaaataatcttcagattaaattacttgaggtagaaatatacagtaaactagaattaatcttcctaaaaattattttactatctcctctttaggttttattactcccacctctgatctttaaggattttttctgaccatggctttgtcaaactgtctataagacattttaacatcttgctaacccttcccaattgtatttttaattataaccttcacatgagtcaagttcacaaacttgcctgatctcaagctgtgtcttcacagagttactgatgaaaatattttaagcatcaaccacagaattactatcaaagtcaatataactgtttttctagctcgtatattatgctgaatacggacattcttcttgctggatatggcttaaaatgtgaatttctctgttccagattattggttaggctactgaatattaaatcattaattttattcatttattaagtaattctcttagggcacatgtttttttcatgaaggcacaatttctagcaaagatctaacctacagttccaggaatttcaatcagaaggaggaaataaaatctaaaataaataaatttaaatatttacttaatatgggaattttatgttcaatgacaatttaatcaccttattaaataatcatcttatttaatattgcatttaaataaaacactttgattatgatatcaaaatgttgtggccatatttttctctgccttacccttgataggagagtctcgataatttccatgggcttagcggggctaacattcaccagtcagtttttttgtgcataacttaacaaacagttgttgtaaaatattgaccttatatttgcatacacggtgtcccaatctacctcacaatgactttctagtctaaaaatatattgttactggaatgatttggacacaggcccttcctcatatttatgtctctgtctggtagttttatatctcttacccatgaggtttggtctcccacctagaggtacacttccttccctaattctgccctcgaaatattcctttctttaccctcagagcttccaggttgcatcttttgaccctggtctcggttcctctccacacacaaataccggtttggaaaggtgtcttcattggccaaacaaatgaaaacaggggtgatatggagggagaaaatgagagtggccctgtagagaagctctttcctctattcacaatcactttcattttactaagccccatttcccatatgcctggcacagcctttcttgcagagcccattcctctaaactgttgctaaatcctaattcagtgttttctacacacaaacattaatttatttcttatgggtgacctccttaaatagtctctttgaaaaaaactttagggaaaatacaggcagatatgtctcccttgtcaaagacaagaggacactgactctaacctttttgcacatttcactgtactttatttattaaaatgctagctgtgaaaaccgtcagaactctaatatgctggttccaaaattaccagaacagtagcatgaagcaccaaggttttcaaagtgccagggaaataataatccaaataaaaaagaacagacctttatttgggtaatgtgtaagtcctttgcctactacatgtgggaaatatttttcattttatttatcctttgtctttgtctttttgtttagttttactcctgataagttttaaatttataagcagtaaaattaacctctttttatcatgaaatgcataacatatatacagaaaaatacaggatatagaaatggaaaactcaacaatttgtcccaaactgaccaccaatgtctgttaacagcaccaggaagctctcttgtaccctatcccaaccaatattccatctctccctctcctgtaatgcccaacctcagtcggatgttggtaataatagttgttttttccccctcattgctttgatgcttaaatgtacattgccaccattaattatacctttatacctgccttaaacatttttatttaaataaatcagatagtattttgtgtctaatacattttgctcaacattatgaggcatccatgttgattaatggagatcattcacttccttttttcatactgttcaattgtgttactataccatacttgatttagccattattaggttgttttcatatatttgttactatattgatagtgccatgaacattcatatatatgtttactgttgtacatgtacaatgtcttgacttttttggccctttatatttccatatacattttagaaacatattttcaggttttattagaaaatgtatacacttttggatcacatcacaccagcagatcaatttgaagagagctaacatctttagaacgagtcttctaattcattaatggggtatgtccccctacttatttatgtcttaaattatctctatattatagtttcctccatagaattcttgcaaacattttgttacatttagtcatattttatactttttgcaaaaataattattgtactgcaaatttttaaaattttatttcctggttgtatgttacttgttcatagaaatgtaattacttctttttgttgttgtttattattttttgagatggagtctcgctctgtcaccaggctgcagtgcggtggcgctatattggctcactgcaacctccgcctccctggttcaagcaattctcctgcctcagcctcctgagtagctgggattacaggcccgtgccactacgcccagctaatttttgtatttttagtagagatgggatctcaccatgttagtcaggctggtctcaaactcctgacctcatgatccacctgcctcggcctcccaaagtgctgggattacaggcatgtgccaccgtgcctggccagaaatgtaattcattcttatatggtataagctatactatataaatattaataaataatatatgaatattaattaatcttgagaaattcacttaaatttttattattaaatttcataatttatctatagattgttctttattttgatataaatagttatattattgaaaaatagtaaatattttttctatgaaatccttacaacatttatttatttatttttgttttaccatcaaggcctttggtacaatgttgaatggaagtggtgagagtgaatatctttgccttgtcttttcctcaaagggaaagctttcaatacttcaccattaagtatgatgtttatgtaggttttcagtagctactgtttttcagattaaacaaagacttctttgctttatttctaattgataaaactttataaaaatcttgattgatttttaaatttatcaaatgctttttctgtatttattgagatgatactaaaaattttttcttctatgatttctcttaacatagaaattccattgatgggttttcaatattaaactaatattaaccaatattgcattttctaacagtgctcagaaagaactccccaactccaagatgacagtttttggaggcagactatccattttttcagtacctgtattgtttcttcttcactttctccttctcctccttttctaccactgctgtttttatagtgtttgactcctctagatttgtttggtgtaaagagtgaggaaggaaataagcttgttgttccaacccatttattaattaatgtatcttttcccctattatttgatataaaacttttataatatagtgaattcctgtatacacatagctctattattggactatagtctgtataattctttattgtagtatgtggctgcagtaatacatgttcattattcttttctcatgttttcctaaacattctcacccatttacttttccacattgacatgatatataaatatctttctatttatatggcccatcttcttagcttaatgaatcatttcttgtaagttacatctgtgatatagcacatacattgtaactcataagagaatcttgactataagtaataataaatggactatttactatatcacatcatgtaacaaaactctaaatagtaggtcgtttcagggttcagtcagtgacttaatggtattatctaagatccatcttccttctctagtaatctcagcttgttgctgtaacatagcaatatcagttacagatactgcattcaagttaaaatatctataaaaagaaatgttcctgtcttgaaaccctttttaaggtagagttgattataattttcccataagtccttaagtatgtgttctttataccacattgatcagaattgcaacacattgctgagcagctagcaagcaaaagaactgtcataatagacatagagaccaatcaggaaacaccccttggggctagataggaattcaattttccccaaccatcatggatattcaaaattgggcaaaacccaccaaagtgcttgtattaatctgttctcacattgctataaagaactatctgagactaggtgatttataaagtacagaggtttaattagctcatggttccacaggttgtgcaggaagatggctatagaagcctcaggaaacttaccatcatgatggaaggtgaaggagaagcaagcatgtattaccacggcagaacaggagagagagataatgagaagacaggggggcagggggaaggtgctacacacttttaaacaaccggatctcatgagaacaccatcacaagaatagcaagggggacgtctgcccccatgattcaaccacctcacaccaggctcctcctttaacatgtggtggttagaatttgacctgaggttttggtgggaacacagagccaaaccatatcattccacccctggcacctcccaaatctcatattcttctcacatttcaaaacacaatcatgccttatcaatagtctcccaagttttaattcattccagcattaactcaaaagtccaagtccaaagtcttacctgagacaagacaagtccctttcacctatcagcctgtaaaatagaaaaacaagtcagttacttccaagctacaatatgtgtatagacattgggtaaaccgttccattacaagagggaaaattcaaccaaaacaaagggcaagcccatgcaagtccgaaacccagcagggtagtcattaaatcctaaagctccaaaataacctcctttgactccatgtctcacatccaggacacactgatgtaatgggtggatcccaaggccttgggcagctccacccctgtggctgctttcatgagctggtattgtgtgcctgcagctttcctatgtgcatggtgcaagctgtcagtggatctaccatactggggtctggaggacagtggccctcttctcacagctccactaggcagtgccccagtggggactctgtgtgggggctccaactccacatttcccctctgcactgccctagcagaggttctccatgaaggctctgcccatgcagcagacttctgcctggacattcaggcatttttatacatcctttgaaatctaggtggaagctctcaaacctcagctcttgccttctgcacacccacaggcccaacactatgcagaagctgccaaagcttggggttacaccctctgaagcaacaacctgagctgtaccttggccccttttagccacagctggagatggagtagctgagacacaaagtaccatgtcctgaggcttcacagagcagcggagccttaggcctggcccatgaaaccattatttcctcctaggtctccaggcctttgacaggagaggctgccactaaggtctctgaaaagccctgaaagcatttttccagttgtcttgtctgttaacatttggatgcttcaaaatcagcagagtcttcccacttatgtttcgggattgagtagtgtttgctaaagtagaagaacagactcttgtgcagtgtttctgtctctagtatgccttcctttaaaactttaaagtaatttaaacttgtaagtatgtgagaaaaattcaaaatctaaacacttttaaaattaaaaatgaagtcttacttcttgatcccaggctttcttttaaaaagtaacattgttgatactttttttacaaatcctacactatgcatcttttattaatttttggtaaactttttattgaaatatgaaatacataaggaaaggtgcgtggatgttgagtgtatatcttgatggattgtcacaatgtgagtacacttgtgctatttgtgcataaatatctcccactgcacttatgcccattcaaagagcctagagaaaaatattttatagttcctcaccaatgcttcaaaacttaaccccctctagctggccaccccagaaatcttggtcttttgaacatatgaattagctccccacatggcagccttcttctatttctgtgatttttgcaagactattaccaacatatggagtttagaaggccaatagatggaaattttctcttctctcctaagttcagaattgagagagatgcacatacagacacacagagtataaattgtattattgggtaaaagctctattgcagtatatcttagatttgttgtgacaacagaagtggacaactccaggaaagatgaataagaaaacaacgcttggacatgtaatcattgactttaataatacaccacccctaagttggattagactccatacatctaagctatctcatttcaggaatagaacttatctgataaacttactgcataatgagaaatagttcagagtaagctctgtgaggcaaggcataaaaagaggccaaagaggtgcagggtaatttgagcatgctcaagtatccagtttatgtataaagtaagtcacttcttccacatactccacaccttgctgcagccccaggacagacatggggagaggatggagaggaacttgaaatgctcttcccacaattttattttcctggagactagagtagaaattccatttttgtatgtggaaataaggagtggagaaaaagttaaaatgaaataatatgctagcaatttgatttcttctaatttataattaaaatagctatcatgaccccaaaaagaaaagaaaaatctcataaaaacatcaagaagtaagactggcagctgaactagtttcagaatatgggaagaatttcaattaggtaaaatacaagaaaacttaaatgagaaccccagttctttgtaactgcaacaaatgtttgccatgtaagcaatgttaggggcattataccattttaatacaggcaaggttcattttattgcatttttatttattatgctttccagatattgtgatttttacaaattgaaggtgtgtggcaaccctacctatatttagcaattacagcgacactactatttcaacagtatgtgctcacttcgtgtctctgtcacatttttctaattctcacaatattttaaacttttacattattattatatctgatatggtgatctgtgatcagtgattttttatatacttattgtaattgttttgaagtgccacagactgcgcttatataagacagtaaattgaattggtaaatattgtgtgttctgactgcttcactgattggctgttcccccatctgtctccctctccttggacatctctattcaatgagacacaacagtattgaattaggacaattaataaccctccattgccttctaagtgttcaaggaaaatgaacaatcacatgtatctcactttaaatcaaaaaccagaaatgattaagcctaatgagaaaggcatatcaaaagccaaaatagactgaaacctgggcctcgtgtgccaaacagttagccaagctgtgaatgcaaaggaaaagttcttcaaggaaattaaaaatgctactccagtaagcacacaaataattttaaaaagtgaaacaaacaatgctgatgttgggagagtttgggtggtcaggatagaagatcaaaccaaccacaatattcccttaatccaaagcctagtccagaggaaggcccttcctatcatcaattctgtgaaggtttagagaggtgacaaagctgtagaagaaaaggttgaagccagcagaagttggttcatgaggtttatggaaagaaactgcctccataacaaaaaggtgcaaggtgaagcagcaagtgctgatacagaagctgcagcaagttatacagaaagctaagctaagatctaagataatgaaggtggctacactaaacaacaaaatgttgatgcagatgaaacagccgtctattggaaaaatatgccatctaaggctttcatatttagagaggagtcaatgcctgacttcaaagcttcaaaagacagactgactctcttgttagggactagtgaagctggtaattttaagttgaagccggtgctcatccaccattctgaaaaacctaggttcctaagaattatgctgagggaggcagcaatatggtcaactagatgcagccagaaagatcatctgctaccaaaggaccaggacatcaggaagaccagtgcactcctagcagatcttcagaaggaaggcattgagagtagatggaggggagatacggatgctgggctgaaggagaaggaagctggtaactctgaatggggctaccctgcaccaggactcactcctggctccaagtgactcctgaggaaggggtgtgttgaacaggaaaggcgcaacctgctctcgccatgtgcctaaggaatcctggcagaaggagacctcatgaccacaaaggacacgtgaggtggcaggaagagctgcttagaaaagtggtaggggcagaacttcagccagtgcagagcccagagggtttggtgcaaagcatctggagtggaggacctccaagatactcatttcccaagcttgacttgctcttgtaggacactttagtcctaggggaattgtcagacctgaactctgcaaggagatcttgcccatgagatggaccagtctgacctgagcacccctcagtcagcttgcctctgccaaggccccagcctggctgtacctgcttgcagtgcagcctcggatccccctggggacctgcatcatagctcctgaactggcagatgacacctgacagagagctccagccgagaggcccccactgacacacaccagcccatctatgccttccccaaactgcagcctcccctgtgccactttgcttgcacacactcatctactgccaccccccacattgctttgctggttcatgtgtgcatgggtagaccttgactccccttccctgccaaggcaagggtgcacgtgcaccctgctatttcactgctgctggcataagtgcaccacaccaccctactccctacagcacagccactgctatcagaggattggcaggaatagagtccatcaggcccaccccaaccagcaccctgcccgtgtattgacactgccactggtgcaaaactaaccacagaaaacagtggacctgcccccatcctgactggcagtggacaccactgcccaaatgaaaatgtacagagggcacacatagtgcccagcagtgctccacccttgtgctaacaccaccacaggtacaaacaaatacacagttgccagcagagcccacagcccaacccaagctatgctgccgatacaggagctagaaagaaagtatttaggcagatagtgagggtaagagagtccttggtaaggtttccttttaataaaaagaagccccaaaatcatttcttttctaacaaaaagcagcctgaagtatcaagcttcaagtatagataagcaagctaaatgcttgcagaggtaaatgctggccactgtgccaatagaaaaaaaatacctggaagccaggtatattcaacacggaggttccctctttccttttctttgtcaaccatctgtgcagtaaagaggcaggcagcatgacaccaggcaggtagagaaacaatttgcataataaaatattagggtggagcagccagcttctttgcacgctatgtaaatggtacacctggtccaaccaatcttttgggccctatgtaaatcagacactgcctcttcaagcttgtctatgaaaccccatgcatttcaccacagaactggaagccccactcaggagtccctgtctctctgcaggagagaattctcttttctcttttctttcgcctgttaaacctccgctcgtaagctcacttgtcgtgtgtccacgtcttcgatgtccttggtgtgaggtgacaaacctcaggtatttaccccagacagcaatgctgcctcactgccaccactgctgctgtgaccaccagcatagaggcagggaccccagaacccactagcaccatgctgtcttgccacactgctgctgctgctggcacatgtgaatgagcatgagtctcactgccactgccctacaaagtgctttgactggcaccacccaatgaagcactcagcgccttcattgcagcaggtccctaacatcaagaagccaaagaacaaagctggggctcagtaacatttcctcatagttagagcacacaatccagaaacctgagctgagtcttgccacctaaaatcttacagaaacaaagctagtcgactgaacccaccttatcccacatccaaatccccagggtcatcaaatagcctaaaacaaacaaaaaacacccaaggaacagcaactttaaagattgagagaacatcagcccacaaaaattagaagaaacccgtgcaagaactctgacaactcaaaaagccagatggtcttatttccaccaatcaaccacactagttgtccagcaagggttcttaactaggttgaaatggctgaaatgacagaaacagaattcagaatatgggtagaaataatcaagattcaggagaatgctgaaacccaatcaaagaaagccaggaatcacaatagagcaatacaggagcaaacagacaaaatagctagtatagaaaaaatgtaactgactgatagagcttaaaaacacactataaaaattacaaaatggaattgcaagaattagcagcagaatagaccaagctggggaatctcagagcttgaagacaggcttattgaaacaagacagacaacaataaagaaaaaaaaatgaaaaggaacaaacaaaacctaagagaaatataggatatgtaaaaagaccaagtgtatgacacaatttcctctctgaaagagatggagagaatggaagcaacttggaaaacatatttcaggatatcatccatgagaacatcttcaacctagctaaagagaccaacattcaaatacaggaaacgcacagaacccccataagatacttcaccagaagaccatacctaagacaaataataatcagattctccaaggtcgaaatgaaaaaaaaaaaacgttggcccgaggccgtggctcacgcctgtaatcccagcactttgggaggccgaggcaggcggatcacaaggtcaggagatcgagaccagcctggccaacctggtgaaaccctgtctctactaaaactacaaaaattggccaggaatggtggcacatgcctgtagtcctagctactcaggaggctgaggcaggagaatcgctggaacccaggagatggaggttgtggtgagccgagatcgtaccactgcactccagcctgggcaacagagtgagactctgtcttaaaaaaaaaaaaaaaaaaaaaggaaaaaatgttaaaagcagctagagagaaataacaggtcacctacaaagggaacctcatcacatcagtggcagaactcttaggagaaacccttcatgttggaaaatactgggggacctatattaaacatatcgaaagaaaaaaattccaaccaagaatttcctatctggccaaactaagcttcataagcaaagcaaaataagagccttttcagagaaataaatgctgaaggaatttatttccatgagacttgccaaacaagagctcctgaaataagcactgaatataaaaaggaaagactgttactgcgttagtccattctcacactgctaataaagacatacctgagactgggcaatttattaaggaaagaagtttcattgactcacagttcagcatcgctggggaggctttaggaaacttacaatcattgcagaaggggaagcaaacacgtccttttccacataatggcaggaaggagaagtgcagagtgaaagggggcaaagccccttataaaaccatcagatctcatgagaactcactcactatcataagaacagcatggaggaatgctcccatgatctaatcacctcccatcaggtcccttccccaacacgtggggattacaattcagattacatttcaaaatgagatttgagtggggaacgcagagccagaccatatcagttagcatccactagaaaaacacacatacacagacaaaggacactataaagtgaccgcacaaacaagactgcataataaccggctaacatcctgatgacagaatcaaatccacacataccaatattaaccttaagtgcaaatgggttaaatgcagcaattaaattaaatccaattaaaatctcagagtgacaagctggataaagaagaaagacccagtagaacgtggtcttcaacagactcatctctcataggctcgaaataaagggatggaaaaaaatctaccaagcaaatggaaaacacaaaaaagcagaggttgcagtcctaattttagaaaaaaaaatagatttaaactgacaaagatcataaaagagaaagaaggacatgaaatgaagagaaagaaggacatgaattgaaaggttcgattcaacaagaagtcctgactaccctaaatatatatgcaactagcacaggaacacccagattcacaaagcaagttcttagagacctacaaagagatttagtctaccacacaataatagttggagatttcaacaccccactgacagcattagatagatcactgaggcagaaaattaaccaaggtattcaggacctaaactcaaccctgggacaagtggacatgatagacatctacataactctccattctgatccaatatactatatgttctttttatctacacatggcacatggtctaaaatcaaccacacaatctgacataaaacaatcctgatcaaatgcaaatgaaccacaatcatattaaccactattttatgccacagcacaattaaaatagaaatcaagactgagaaagtaccttaaaaccatacacttaaatataaattaacaaacctgctaccaaataactttggggtaaataatgaaaataaagcagacattaatacgttttttcaaaactaatgagaacaaaatacaacataccagaatctctgggacacagctaaggcagtgttaagagggaaatttgtagtattaaatgcccacatgaaaaaattagaaagatatccatttatcaacctaacatcacacctaaaagaagtagacaagaaagagcaagtcaaactcaaagctagcaatagacaagaaataaccaaaatcagctgacctgaaagagatcgagacatgaaaagctatttatggtgtcaacacatcgaggaggctttttttttggaaaattaataagatagacttattggtagacaaatacagagaaaaaaagagaagatccaaataaacacaattaaaaatgagaaaggggatgttaccattggccccacagaaatatcaaagagaaaaaaaaatagagacaaccgtgaacacctctatgcactcaagctcaaaaagctagaagatacctgaatgaattcctggacacatacaccctcccaagactgaaccaaaaagaaattgaattcttgcacgaaccaataatgagttgtgaaattgaatcagtaataaatagcccaacaaccaaaaaaagcccaggaccagactgattcacagccaaagtctactagatgtactaaaaggagctggcaccatttccatacaaactattctgaaaaattgaagagggactcctccccaacccattctatgaggccagcatcatcctaataccaaaacctggacacaacaacaaaaaaaacttcaggccagtatccttgatgagcactgacgcaaaaaccctcaaccaaatgctagcaaaccgaatccagcagcacatagaaaagctcatccaccatgataaagttggatttatcactgggatgcaagattggtttaagatacaaaaatcaacaactgtgattcataagcagaactaatgacaagaaccacatgattatctcaatagacgcagaaaaggctttcggtaaaattcgacacccctttatgttaaaaactcccaataaactaggtattgaagaaacatacctcaaagtaataagagcaatctatgacaaacccacagccaacatcacattgaatagtcaaaagctggatgcattttccttgaaaactgacacaaagcaaggatcccctctctcaccactccaattcaacataatattggaaattctggccagagcattaagactcaagtacttacttcaatatcctagagaaatgagtcattaatccaatcaaaatgtgggaaatctcgatacttatttattcatacttctgagaagacaatatcatgccttatggctcagagttatgtggtttctgaggttctccacacagaaggtaaacttagcaagagctaataaaagcaaaacaattacaaagtcgattggatcagagtgaacgtcattcggcttctgtaaaaggctggcaggtgctgcgtgtggatacgagaggcagcaagatttcagataacatgagtctgctggagaataaaaatggtgtcctgagttaaggtaaagttcgtagagcagtcagaggcacacaaaaatgtcaaaactgggactacttaggctccgttaaatcaacgcacttcatcacattgattttcattgtttattctcattcccttgtttacttattcattacatgctgctccactcagagcatttttgacttgcttgaacatttctttattagcttgttggtgctggttttgcttgtcagctacactattcatttctggaataacactttatactaaggcagttggtgcttcttgactgaacaggccagttgtaatttctctgcactctatagtgatgtcagttttcttcaacccaagaaggactatttgcacaagtaagatgctttcactcctagttgtttttttactgccagtcaggtactcaccaaatttcgtatcttctttactcttctatcatgacatcattatcccgtgggatcccagttatgcacatgttatctaagtgaattattttgtccacaggctctgctatctgatttttacattcccatctagcacttgctgaaatttaattttcttcaaatttggtgactttggataatactattaccactgtggtttttaaactctttgaaagtctttggggcctataaaaggcacagggctttacaaaagtaattctcacatattggtgtgtacaatttaaagaccatgtgaaatgtagatgactggctccactttgaaaaaattatgatttactatatatggggtgaggggggccacaattatgcattttaaagaagctacagctttctctcctgtgtgattaatagtgatttgttgataatccatcatgatgcaatacatagtttaaaatggaagccttctattttagaataattttagatttatgaaacagttgcaaacactgtacaaagcattttcatggacatttcactcagcttcccctaaaattaatatcttacattgtacatgcatttaaactaaaaaattaacattaacatattactattaactaaacttcagactatattcggatttatagatttttatacccatgtccttttttagtgccaggatccaacccagcctaccacatggaatttagttttcatgtctctttaatctaaagtctgtaactggttctcagcctttacttgtttcccatgacctttatggttttgaggagtacttgagaattttgtaaaatgtccctggacttgggtttgttagatgttttctcctcattaggctaggattctggaatttagggaagaacactacagaggtgaagtgtttttctcatcacatcctatcagaggagcacatgataccaacgtgacttctcactgctgatattggatcatttggttaacgagaggactgccaggcttctctcctaaaatgttactatttttccctttccatattctgttttttagaatccagcccacactctggggagggcatttaaatttcacctgctggagggaggagtatctatgtacattttttgaaattctttgtaagaaagacttttacctttctcctcatttatttatttgtacaattatttatatcagtatggactcatgaatattttattttatactgtgttataatttttaaattttaattcattttgttgcttaaattgttttaactttggccatcgagtgctctttcagtgtggctcctgatctgcttttattcttttgttttctgagcacttctgtattttctggcattacataatactccaggctcatcttgtgttttcactgccccaggcctagaattactcatttctccaaggatgtctgttttttgttttgcatttgttattttggagaatggtatttagaaaccaagatctgggcactggaggtacctgttgctaattgggtgtcatttttttctagtttctcagcagacagagctataaaatatatgcatgtatactaaccaatatgtatacacatctataattatttctttagctattaatctctgtacatgttaaaccactatatattataaacttttttgtgttctttgttttcttattgttaagttttaagatttatttatgtattctggatatgtgtcttttgtataatattctactttgaaaagtgaaaaaaataaagtggctgtaaggtacaaaaactgtttaaatgaacagtcacctgaaaatttttgaagatatccagttgatctttaagagcttcaatgtgtgtttttctgtgggattatttagaatatagaagttttattcaaaccttcacccattttagataagtgagtactcatatgagcttgctagttagagtactgttatagagaattggtgaagcattggctcttgaatttaacacacagtccatggaatttttctaagtaagaaagttaaaaataaatccatatcaaatttggtcttaccaacttcacattatgaaatctactaaatatcttgagactttaacatagattcttataatcgataaatgaaaatatttgtgatatataaatgtatgatgtttgtttttcctttatttagacactgaatgtagaatatttttatttccaaattgtagtaatactatataaaataacaatattttactggatgcttattctgttccagaccctatacaaaatcatgttatatagattatcttgatttacacataaaccatttatttgctttaatgagaaacctaaaagaatatatattgcgtctattttgcagaggaggaaccaaagagaagagaggcgttgatcatgcttcatttacaaggaggaactagggtatacctgctagtaatggtagaaaacattgttcagctgcacctcacaagggaagtcagaaaccttcttttcaaaaatgagtaagaatgtacaggaaaaattattatgtgatgagaaagtgatatgcataaggaacaatgcaggctgaatttgtctataattaaaattttttataaaaatgctttttcataggtattgttttaagcaccataagagagataaaaatttaactgatattattcaaaggaaaatcaaaaattacgactggactggggggtataaagatactgagattggaaaggaagacaggaaattgtcttgtgtgtgtgtgtgtgtgtatgtgtgtgtttgtttttgacggagtctcgctctgtcgccaggctggagtgcagtggcgcgatctcggctcactgcaatctccgcctcccgggttcaagtgattctcctgcttcagcctccctagtagctgcgactacaggcacgcgccaccatgaccagctaatttttgtatttttagtagaaacggagtttcaccatgtaggtcaggctggtctcaagctcctcaccttgagatccgccttcctcggcctccaaaagtgctgggattacaggcgtgagccactgcacctggcctcaaactgtctttattcacagatgacattatcataaatatagaaaattcagtgaaatctacaaaatgctcctgaacataataagtgagtttaccaaggttgtatgatacaagatggatatacaaaactcaatatttatatatgctaacaacaaaaaattggaaattgcaattaaaaaacaatactacaggccgggcgcggtggctcatgcctgtaatcccagcactttgggaggccgaggtgggtggatcacgaggtcaggagatcgagaccatcttggctaacacggtgaaaccccgtctctactaaaaatacaaaaagtcagcagggcgcggtggcgggtgcctgtaatcccagctactggggaggctgaggcaggagaatggcatgaacccgggaggcggagcttgcagtgggccaagatagcgccactgcagtctggcctgggcgaaagagcgagactccgtctcttaaaaaaaaacaaaaaaaaacaaaacaaaacaaaaaaaaactacatataatagtatgaaaaacaatatttagggaaaatctggagagaaaaagatttgaaagacacatacactaaaaaataaaaaatattcccgagaaaatgaaaaatcacataaacaaatggaaagatgaccttcctcagtggtcagaacatttcatattggtaatatgccaattatcctcaaattgatctatagattcaacagaatcctaatcaaaatccaaacaggactttttctaagacatagacaagcagattttaaaatttctatagaaattcaaaggacctagaagaaccaactttgtaaaagaacattgttaaagaattagtacagcctaatttctagatttattataaagctagagtaaccaagatagtgtgaaatttgtgtgagagaaaaatcaatggaagagaaaacagtgcccagaaattgaccttcaaatagacaactgatactctaccaatttccgaatgtaattcagtggagaaaagattgtctttataaaaatagttctgaaattatcagatatgcgtaagcaataggtacatttttaaaataaaaactttgatctatatcttgtgctgtttacaaaaattatagcatttaaatgaaaaaaatctttgtgacctttggataggcaaagtttttcatagatacatcaaaagaagcacaatccgtaaaagaacaaattgataaattggacttcatcaaattaaaaaacttctctttgacacagacaatgaaagagcaaagccaaggatgaagtgaaaaatttgcaaatcatgcatctgataacctatttacatctagaacacagcaaggattctcaaaactaaatatgatatccagcaacacaatttaaaaatggggggaaaatccacagaaacttcaaccaaggggagataaggatggcaaataagcaaatatagagatgttcaatatcagtagtcattaggaaacgcaaatgaaacccagaatgagattctactacacacctgttagaatccgggctgcgcaggtggcgtcagcgctgccccacctccaggaaggaacctgggctgcgtgtggctggcggtctcctagcgactagagcggcagggatctggaacctcagaagctggagaggtggcacaacagagagggccaccatgggggaccggaggccacaggaccggccaaggtcccaaggcatggactccaagccctggtactgtgacaaaccgccttccaagtacttcgcgaagcgcaagcacaggcgcctgaggttcccgcctgtggacacccagaactgggtatttgtgacggagggcatggacgacttccgctacgcctgtcagtctcctgaagatacgcttgtttgtcgccgtgacgagtttttactccccaaaatatctctcagaggtccccaagctgaccgcaaaagcaggaagaaaaagctgctcaagaaagcggccctattttccgagctctcgccagtacagccagcacggaaggcgttcgtagaggaagtggaagcccagctgatgaccaagcatcccttggccatgtaccccaatctgggaaaagatatgcctccagatctcctactacaggtgctgaaacagctggatcccgagaggaagctggaggacgcttgggctcgttgtgaggcccgggagaagacaaccgaggtacccaccgagtctggtaaatatccctgtggggaatcctgcccgcggcctcccgagactccggtgtcccgtctccgtcctcagcttcccaagactccggtgtccagtcgccgcccagagcctcccaagactcgggtgtccagtctccgcccagagcctcccaagactcgggtgtccagtctccacccggaacctccagagactcgcgcatctcatctccgcgtggatcctcccgagactggagtgtcccatctctgcccagagcctcccaagactctggtgtccagtgtccacccagagcctcctgatactggagcgtcccatctctgcccggagcctcccgagactcgcgtatctcatctccacccggagcctcctgagactggagtgtcccatctccgcccagagccttccaagactcaggtgtccagtctctgcccggagcctcccgaggctggagtgtcccatctctgcctggaacctcccaacactcatcgggtgtccagtttcctactacaggtgctgaaactggattctgagaagaagctggaagacgcacgggctcgttgtgagggccaggagatgacaaccgaggaactcaccaagcctggtaaataccatttttgggaatcctgtccgcggccttttgagagtcggatgccccatctccgcctggtgcttcccataactcgtcgaatggccagtctctgcctgaagcctcccaagactcgtcgggtgtccagtctctgcccggagcctaccaagaccggagcgtcccatctaaaagaactgtttcaggaagatacaccaagcacaatggagtgtgtttctgactctcttcaacgtagacacacatcgagaaaactccgtgacttcaagtgggctggagacctaggagttaatgaagaatccatcagcagtctgtttgactttacccctgagtgcagaacaaccgatcaagaccaaaagattaagaaggcaaacgagtgtgcttcaaggctgatgtacggcatggagctagacgacatggatgaggtcgaattcttacggataaaatactgggacaggagacgccgggcggcaccgcattcttatagtgcacagcgtgggaggataaggtatggaccatggtacttcgagcctaagttggggaaaaagctaagaagtgatgaacctttgattgaccccaagcccgtacttgaaaagcctgatgaacccgacattcttgacggtctttatggaccaattgcctttaaggatttcattctaagcaagggctacagaatgcctggcgtcattgaaaagctgtttgccaagaagggatggacttacgactctgttaagactcctattcaacgtgcagtgcaagtttacaagtacaaagaagacgtcacagatgcatcaaaagaagattagatggttttcaatttactgcttaattgggtatttcttgctctcattctaaacatcaatcagaatttatgatgactggccccgtgaatgtacaactttggcaacatctgtaaattcaatacccaatgcttataaatatgtcttaatgacctgctttggcctcattatttcatatattttatcaattatgtgatttatattcacatatacttttttcacattgttgaagcattgtgaatattacatcatcctttcaattatttgtaaaaatacatacaaccagaaacaaaagcagaattaatattagaaagagaagtggggtcgggtgcgttgactcacatctgtaatccctccccactttgggaggcccaggtgggtgcattgcttaagcccaggagttcaagaccagcctgggaaacatggtgaaacctggtctctacaaagggcaaaatttagccaggcatggtggcgtgcacgtgtagtcccagctacctggggggctgaggtgggaggatggcttcgtgccaccgcactgcagtctgggggacagagcaagaccctgtctcaaaaaaaaaatgtgctgagtaaaagaagaattatataactcttcttatatgaaaatttaatgaaataattataacaattattttgttaaccaaaaattggagtctatagccaaaataatgttaacactttttaatagtaaaattattatcttcccttttaggattccatcaaacccccaaaacaagtttgaaaactatgtatcaaaatcataggtgaaacttgagttacgccattttatcatctctctcaattgaatgtatataactattcaccatgttcataaacattcactacaaaagactattaccaaatcgtataaacaggtgcagaataggaggcagcttcaactccctggcaaatctcatgtgcaaaatagatctgtatgagaaaagtaacatcaaatatccttacatatctgttcaagttcaaataattttcatttcattaatagcaatttgaaatgcattcataagtttaaaataataaatcaagcaactgctttacctttcaaaaatagcaggtaaaactggtataggtaaatttgtaggtaaatatatttgtagtgtagatctgaagtgcactttttctttcggagatgaaagaatccatctgtaaatggacgtatatgcatatatttcatccaagtaagcagtgatatatatatctgtctatgtgcaaattctgtttctagtgaagtttgtgtgtgggcattgtgttcctgaagaaccaagtcttttttgtgttgttttctaagccaaggcctagaatttctcttcaaactcatcatcataaacttaggttcatgtcaccactatctctttttgcaattctgcaatggtttccaacctgtgtctcctcttgagtgtatttttgcaaaatataagcacggcttgttaattctccaggctcatctaaacttatctaggtacataaacactcacacacacatgcacacacacacacacacgcacatgctcctgcattccagactccagtcaatattccttttcttacctccttgtctttctcgtgtcttcgtacataatattctctattgttaggacttcactcaggccatgtaaacctgttgcagtgtctccccaccaaggtcaatttcatgattacttttattaaaatcctatgtctgtagacaaggaaactcattttccagttgtcttccactgaagaactcacctcaatatcctagagaagtgagtcattaatgccttcaaaataagggaaatatccatacttatttactcagacttctgagaggccaatatcatgtcttatggctcagagttatctggtttctgaggttgtccactgaagccttgggcttcatgcaacagcatccaatgttcagttcctttcagcaagagacagacctacttttcacatttggttatgtgaccttgcacttcacggaggatgtatcctcatttacacgatggataccatatgatgaagctcaaattctggtgagacttaaaagattacttattaaagtccctaatgcctcaggcatcacagaattgatactcaacatatatttgtggaagaggaggagggagtaggaaaggaagaaaggtactaaacatagcacaacagaaaaacactattaaaaataactttttggtgatgtttatctggtgatagccttcacctatatcacacacaatcttagttgttgcttaagatgaaaatgtggtgcttgctttggctacacatatactaaatttaagatgaaaaagtgtaattgcaaaataagagccactggttagggcttctattgcttattggcaatgatttcttccagtgaaataaactttcctcagagaaattatgtgggcttctccacgctgtaattacacacattggtattacttgtcacacagatataaacagaaacaatgtttgatctatttgggatttttagcaccagttggtcttctgaaaatatcctgacttcaaatccataggttttagaaaaagagagaattcaagagagcttgatatataattgtgcctaaagctatgaatggtatattccataaatactgtagtaatcaattgtattacagcatcacataggtttcataaaagctttggagaatttgtatgcaagaatatgtgatttaacgaagatgaagggaattatttttcatttctgagagtctgcatgaatgagcaagggctttggagctaggcaaaaatgagttcatatcccagtgctgccatgttcttatcctgcagctttaggcagaggtagaacagaccgagggaaaacacagaggctgggctgaaggggaaggaagctaggaaccttcccggggctactgcacactggaatgtgttcctggcccccagtgactcctacagagggggtgagtttaacaggcaaggatgaacccactctcactgtgagccttgggaatctcagcaggagaagaccctagaccaccatggacacttgagttggcagggaaagccacttagagaagtggtaggggcagaactccagccgggggcagagcgcagagggtgtcctgtgggggcaactgtagtggagcactgtcagagatgtgcatccccctaggctagatttgttcccatgggagactttagccttaagggaactttcgaacctgaactctgcagggcagtcttacccatgagacaggaccggtccaacctgagcacctctggcatcttgcagggccccagcctggccacagctgcttgcaatatggctgccaggagccccctggggcccacatcacagctggtgcatcacacctgactggcagagtgttccagcagagtggcctctgcagacacacaacaggtcgttcacaaccatagccaccctccacatctctatgccagtgcgtctatgcccaagcagatctatccttcccttctccaccagcacactggtactggtatacctgcaccctgcctttccactgctgctgccatgagtgcaccccctcaccatcctcaccctactgcaccgcttcagaacatcggcaggcacagagctccccagccccacccctgccagcaccctgcccctgagcctcagccaccagagcaaaactagacatagaaaacagtgggctagctcccagccttgagcagactgctgccagcttgaacatgcacagagggcacacacagtcctgcacccaccaatgccccacctccatgctataaccacaacctgcagggacatgcacagagtctcagtgggggctcttcacccccaccaagccaaactgccactactgctgttgcaaatacccacattgaggctagcaccccagcacccatgagaaccctgctgcatcaaatggataagtgtgcaccccgcaatgctgctgcagcagctgctgctggtacatgggaacaaggacagatcccactgtcactgccctgtgaagtgatttggctggcatcatgcactggaatgttgtgaccagtggtctggtagcaccttagcccctccagtacaacaggtttctaacctggaggagccagagatcaaagctggggcctgataccagtctaccagagttatagcatgcaatccaggcaggagttctgagctgagccttgacccctgaaaatcttccagtcatgaagccagttgactgaatctaccttatatcacaattaagcccccaaggtcatcaaataagatgaaagtaaaaaaaaaatagcccatccacagtacagaaacttcaaagatttaagaaacattagtccacaaagatgagaaagaaccagcacaagaactccgaccattcaaaaagccagagtgttttcttttctccaaattactacactggtactccagcaagggtttttaattggactgagatttcagaagtgacagaaaaagaattcagaatatggataggaatgatcattgagattcaggagaacgttgaaacccaattcaaggatgaaagaattaatataaaatgacacatgagcagacagacaaaatagccaatatagaaaataacgaatctcaccctatggagcggaaaaacactctacaaaaatttcataatgcaatcacaagtattaaaagcagaatagaccaagctgagtaaaggatctcagagcttgaagactggctttccaaaataatacaatgagacaagaataaagaaaaaagaataaaaaggaatgggtaaaacttcaaagaaatatggaattatgtaaagagaccagatttattacctattggtatcactgaaagagatggagagaatggaatcaaccaaaaaagacaaagaagggcattacatagtggtaaagagttcaatttaacaagaagaccttactatcctaaatatatattcatccaacatagaagaactcagatttatttagagaccttcaaagagacttagaatcccacaaaataatagtgggagactttaacaccccactgacagtattagacaaatcatcaaggcagaaaattaacaaaaacatgaaggacctgaacacaacactggaccaaatgcttatctgcacatggcacgtactctaaaatcaaccacacaatcggacataaaacaatctcaataaatgcaaaagaactcaaatcataccaaccactctcccagacaatgaggcaataaaaatagaattcaagatttttttcgatgcgcaaaaccatacaattacattgaaattaagcctgttctggaatggctttaggtaaataatgaagttaaggtggatatcaagaagttacttgaaatgaatgagagcaaagatacaacatgctagaatttctggaatacagctgaggcagtgttaagagagaaatttacagtacgaaatgccaatataaaaaaaaataagaaagatgtcaagttaatgacctaacatcacaactaaaagaactagagaaccaagagcaaaccaatgcaaagttagcagagacaagaaatagccaaaatcagagttgagctgaaggagactgagacatgaaaaatgattcgaaagatccacgaagccaggatctgggtatttgaaaaaaaaaaattaatgagatagataggctgctagccagactaataaagaagaaaagagagaagatccaaataaatgaagtcaaaaatgacaaaggggatgctaccactgactctacagaaatacaaataaccatcagagacaattatgaacagctctgtgcacacaaactagaaaatctaaaataaatggataaattcctggacacacacatcgtcccaagactgaaccaggaagaaatagaatccctgagcagaccaataataagttctgtaattgagacataataaatagcctaccaacaacaataacaacaacaaaaagcccagtacaagatggattcacagatgaattctaccagatttacaaagaagagctggtaccattcctactgaaactattccaaaaaactgaaaaggagggactcctccctaactcattgtttgaggccagcatcatcctgataccaaaacctggcaaagttacaacaacaacaacaataacaaaaactttaggaaaatattcttgatgaacattaatgcaaaaatcctcaatgaaatactggcaaaccaaatccagcagcacatcaaaaagctgatccaccacagtcaagtaagcatcatccctgggatgaaaggttggttcaacatatgcaaatcaataaatgttattcatcgcatgaagagaactaaggacaaaaaccacatgattatttcaatggacgcagaaaaggcttttgataaaattcaacataccttcacgttaaaatctctcaataaactaggtattgagagaatatattgcaaaataatgtgagccacatatgacaaactcactgccaacatcataccgaatgtgcaaaagctgagagcattccccttaaaaacaggcacaagacaaggatgccttctctcactgcccctattcaacattgtattggaagttttgttcagggcaattaggcaagagaaagaaatatagcttattcaaataggaagagaagaagtcaaactatccctgtttggagacatgattctatatctagataaccccatagtctcaacccaaaagttccttcagctgataaacaccttcagcaaattttcaggatacaaaatcaatgtacaaaaatcactagcaatcctatgcacccataatagccaaggcaagagccaaatgagtaacacaatgtcattcataattgccacaaaaaggaaaaaaacacctaggaatacagctaaccaaggaggtggaagatcgccacaatgagagttacaaaacaccactcaaagaaatcagagataacagaaacaaatggaaaaacattccatgctcatgaaaaggaggaatcaatattgttaaaatcgccatactgccaatatacagatttaatgccattcctatcaaatcgccatacaaagcaatatacagaatcagtgctattcctatcaaactaccaatgacattcttctcagaaacagataaagctattttaaaattcatatggaaccaaaaaagagcctgaattgccaaggcaatcctaagccaaaggaacaaagctgcaggcatcaagttactcatcaaattatactaccgagacagtaaccaaaacagcatagtagtggtacaaacacagacacatagaccagtggaacataataaaaagaccagaaataaggccacgcacctacgaccatctgatcttcaataaagctgacaaaaacaggcaatggggaaaggacttcctattcagtaaatggtgctgggataactgactagccatatgcagaagatcgaaactggaccccttctttataccatatacaaaaataaactcaaaatgggtgaaagacctagggagtaccatggtttaaatggtaagacttaaatgtaaaacacaaagctataaaatccctatatgacactcctagggagtaccagggtttatgccagggacataaaccctggcaaagatttcatgaggaagacaccagaaacaattgcaccgaaaacagaaattgacaagtgggatctaattaaactaaaatgcttttgcacagcaaaagaaactatcaacagagtaaacagacaacatacagaacgggaggaaatatttgcaaactatgcatctgacaaaagtctaatatccagcatctttaaggaacaaacaaatttacaagaagaaaattaacaatcccattaaaaagcgggcaagggattcgaatagatacttatcaaaagaagccatccatgcagtgaataagcatatgggaagaaggtcaatatcaccgatcattagaaaaatgcagatcgaaaccacaagaagacaccattttacaccagccagaatgactattattaaacagtcaaaaaataatagatgttggcaagatagaagagaaaaaggaatgcttacacactgttagtaggagtgtaaattatttcaaccattgtggaaagcagtgtggcaattcctcaagagagctaaaagaagaactaccctttgacccaggaatctcattactgggtatataaccaaaggaatatgaatcattctatcataaagatgtattactgtggtatgttcattgcagcactattcacaatagcagacatcgaatcaatgtaatgcccatcaatggcagactacataaagaaaatgtggcacatatacaccatggaatactacatggctataaaaaagaatgagatcatgtcctttgcagggacacggatggtgcttgagaccattatccttagcaaacagatgcatgaacagaaaaccaaatactgcatgttctcttttataagtgggagctaaatgttgagaaaacatggacacaaagaggggaacaacagacattggggtctatttgacagagaagggtgggaagagggagaggataagaaaaaataactattgggtacttggcttactacctgggtgacaaaataatctgtacacaaaccccctgtgacatgagtttacctatataacaagcctacacacgtcctcctgaacctaaaataaaagtataaaaaagaactatgctaattactctgactgtgctctgtaaaggggaaaacaaagcctggatgacagaacatctgtttacagtatggtttaccgaatatctttttgttttgttttgttttttgttttttgagacagggtctccctctgtcacccagggtggagtgcagtggagcaattataactcactgcagcctcaacctcccaggctcaaactatccttccacctcagcctcctgagtagctttgaccacaggcaggtaccaccatgatgcccatctagttttttttgtatttttagtagagacgtggtctcatcttgttgtcccggcttgtctggaacccctgagctcaagcgatccacccaactcagcctcccaaaggctgggattacttacatgcatgagccaccgtgcctggacagtttactgaacatcttaagctgactgctgagacttactgctgggaaaaaatgattcctttaaaaatattactgttcattgacaacacacctagtcacccaagaactctgatagagatttacagagatgcatgttttttcttgcctgttaacacaacatccattctgcagcccatggatcagggagtaatttcaacttttaagtcttattatttaagaaataaatttcataaggctatagctgccatagatagagattccaatgatgtatctgggcaaagcaaactgaaaaccttctggaaaggagtcaccattccagatgccattaaaagcattcatgattcatgtgagaaggtcaaaatatcaaccttaacaggagtttagaagaaattgatttcaaccctcatggatgacctagaggggttcaagactttagtggaggaagtctctacagatgtggtggaaatagcaaagagaactagaattagaattggagcctgaattgctgcaatctcatgattaaacttgagccaatgatgagttgcttcttatgaatgagcaaataaagtggtttcttgagatggaaactactcctggtgaagatggtattaacattgttaaaatggcaacaacggatttatactattacataactttaattaataaaatagtggcagagagtgagagggtttacaccaactttgaaatactttctattgcgggtaaaatgttatgaaatactatcttacactccagtgaaatattttgtgaaaggaagagtcaatcgatggagcagatttcattgttgtcttattttaagaaattgccacagccaccacaaccttcagcaactgccatcctgatcagtcagcagccatcagcattgaggcaagttcctccagcagtgaaaagattgcaactcactgaaggctcagatgatcattaaaaattttttaggcggggcgcggtggctcacgcctgtaatcctagcactttgggaggccgaggtgggcggatcacgaggtcaggagatcgagaccatcctggctaacatggtgaaaccctgtctctactgaaaatacaaaaaaattagctgggcgtggtggcaggcacctgtagtcccagctactttagaggctgaggcaggagaatggcgtgaacccgggaggcggagcttgcagtgagccgagatggcgccactgcactccggcctgggcaatggagcgagactcggtttcaaaaaaagaaaataatacaaaaaaacttttagcaataaagtattcttcacttacattatatacattttaagacataatgttattgcacactttattaatagaatatagtgtaaatataactttatatgcattcgttaacaaaaaaaattgtgtgacttactttattgtggtagttggattcaaacccacagcatctcccaggaacattgctttatgacaagatctcattctatatttttggtctgtatttccctcaaaacgtggcattattagaagtgaaagaggataggcatgccaattatttctgttataaattgaagatgattattatttttctatcagaaaattaagatgtttttctcagaagacctaagaagtttctagaaaagtatgactgtggcacttttgctccctcaaatggccatggccaagatattaggggaaccaagacccatccattcatgctattttggacacatttaattgttgacaaattgatgcttattcaaggataatagaaggttttttttcaaattaattgggccttgtagcttggttaccaaattttggttcctacaaaaaagatagaaggaagcccttctggttaatcagtagttcactatttaccatgggatgctccttctgccttcctggtccagccaatgaatcattttttatttttgtatccacactccttggtttttcttttatcctccatacagtgattttgtccaacaattgccaccaaggttcaaggaaatgataaactccaaaatcccgaagttgacagaaaacatataatagagaaacagatactttgatcaaaagtattcttgtttggctgagtgcggtggctcatgcctgtaatcccagcactttgggaggtcgaggcaggtggatcacctgaggtcaggagtttgagaccagcctgtccaacatggctaaattccgtctctactaaaaatacaaaaattagccaggtgtggtggtgcacacctgtagtgacagctactcaggaggctgaggcaggagaatcacttgaacccaggaggcagaagctgcagtgagccgagatagcaccaggaggcagaagctgcagtgagccgagatagcaccactgcactacagcctgggcgacagagcgaaactctgtctcaaaaaaaaaaaaaaaaattatcctttccattataaaacaaagatggatttatcactcttatttttggcaaaaatttttttaaaaagttttactcacaaactgtgcagctcatagaaaaattgcatttacaattaaaaagaactcttgctaattgggcatatgacaagattctgcagcataaaagaagatcacacactttagtttgagagaagaaaattattctgaagcagttagcaacaagaagcagagaaatattcgagaaaatatctgtttggtatacttaatgatattgacaaaatgtattttacacgggtcggtccgatcttatatagatctcatacagatcaaaacaaaatgcaaataaagattgagataaaatgggagctaactgagaagcagaaagtaatgtagcttgtttagttttaaaaaatgaaattattgaaagtattaaaatctgaattaaaatgtaagcagaactaaacagttatattgggaacgaattggggaaagatattttaagaaagagacaaagatgtgaaaatgttgaagatcattactgtagagaacaaaaagtagagatatcaaaattgtgaattaaatattcttttaaaaggaaacaacagatggaacagaaacaacagtgaaaaataggtttcaataaaaaggtttcaaaatctgcagacctcagcctgtgtagtaagagattttagtaaatgtcaggaaagtgtaattaaataaataaaatcaaagaattagtctcatgaatttttaaattgaggaaaatcatccaatttaaataggaaaaaagtggttctccagaagaaataaaccaaaataggctggcctcagacttccttagaacattaatcaccagaaaacaattttgtgactcataaacttgatatgcctctaagttattatttaacatgaacagcaaaagaaaagcattctcagaaattaaagggctcagaaataataccacccacataaataaagtatttggtaagatatcctatggaccaagagatgttcaaaataaacataaatgaggattagcagggaatagtaaaataagttggatataaattaaagtctaaataattatgttaaaatatgcaagtagtaaaataaaattttaaaacagaaattatatttctaaaagaaaatctatagtaagagcaaaagtcgtgtgtgtgtatatatatatatatatatatacacacacatagttgatccacattatttgtggattccatatttaaaaatttgcttactactaaaatgtatttgtaactccaaaatcaatacttatgctatttttgaggttattcttggatatgcacagagcaatggagtatttgagtcatctgatgtacacgttcccagctgagcttcaacttaccttcttgtttcagctctcatactataaacaaagtcctttggtagtatatttagtggcacatttttcatattttttgtgtttttggtgattttactatttaaagtagcctctacacatagtgctgaaatgatgtctagtgtttctaagtgaaagaaggctgtgatgtcacttacagagaaaatatatgttagataaactttgtccaggcatgagttatggtgctgttggcatgaactcaattttaatgaatcaacaatatatatattgaataaggtgactttaaaaagaaaaacacgcaaaacgaatttacacatcaattgattaacaaaaacatcgtgaccagagactcacagaaaacttaccctgcatttcttagctaggagtaatggttcagtatttgataatttagtatttgtggtgacttcatataaatgaactactgtgaagaatgagaatcaactgtatgtagtgtgtgtgtgtgtgtgtgtgtgtgtgtgtgcgtgtgtgtgtgtaattatagaaataatcagaaaactttccagttcattttacaaggctaacatacccggcaagagaaaatatgaaacctgacaaagataaaaaccaaaacaagcattcccaagcaatcttatttacaattattttggtagattggattggattattattcccatttatttacttttttcttccctataagagaatcatgtatctttgtccatcgtcatacaatatgcaatatctccctgtgggagaagtgtaattcctcaactcattaaaatcaggctttgccatgtaattggtttgatcaatgaaatgtgagtagttgtgattctggataacagttcccagcgaaaggtttagcagtatgggtgaatttcatcagctcttttaccctttttatttctaacaagataaaagataagggttgatctcttaccatctcaggatggtaaagacattggaatagagctgcagtggtcaacatgtaaattgggggtgagagtgagaaaattcttgtaatgtatgacactgacatgttgggtggctctttacctcaacttaatctagcaaaagctgcctaataaaaagatgggtgcaaagatgatcaacaaaaacaccaaatttgaggaaaacctttgtttaattcaataagttaaattaaatgtaaaatatttatttaatatattcatgattttattaaactgtaataaataatgactatgcaagttttactccagaatttatcaaaaggtttaacagtatgaaaattattaatgtagtatgtagcaataggaacaataaaaaaaagaaacctacaatcatgtaaattgatcaaaaagatatatgtgataaaactcaaaagtgatttaacagaaaaatgcttaataaacagagtaaaatacaaataattaacacaataagcattatttcaatagtgaattcttagaggtttaatgttaaggaacaattcaaccacatctattctcactgctattttcaacattgttctgacattctagtcaatagttaaaggcaaaaggtgtgataataattttaactcttgaaaaagaagagatctaattatgtatgtttagggagctgctggaacattattggaatcaaaaataataaaatataaaaataatggctagaggctagaaaatgaacctagagtaatcagttcaattcttatataacaacaataacatcttagttcatgtaatgtaacaaaatatatcatttacaatatcaataaaaatacacattgtatagttctagatatgtatagatggatacatttaaaacaattatatatgtatgcctttttagtattatgaatagaatattaaaaaatctaaagtagtattataaataatcgattttaaaaattaactgctactagtacacagttgtggtattttcacaaactaaccactatttctttctaaggactaatttatttttatatagaattatggttctatttaattcaccccttttccacaaatcaatacctccttttttagaactgtaattgctgttactcttcctaatggtcacttaataattgggatagttgcatcctaaaaaaacaaaggttttgtttttgtttttgtttttgttttgttttgttttttagctgggctaagtaaggaagctaagctaccttaaacaaccattctgtgccaagggacttacatagtcttatttcatcctcaccatatctcagtaaacaacagcattcccatttaactcataatgaagcacaaagctctattttttcaatcatatttatgtttctgaaaaagattgttccttcagcaaaatacagtagtaccagtgtagtatttatacacactgtgagtctatggaagattaggagaaatttagctacgtcacttaattccagcaggaaaaattttgtatttagatatcactaaatatttgttaatttagttaacatgactcattttatttcaaaagtacttgtaataaaaagcatgtttatttctaaatattgacattctatcctataagggtgtattagtatttttcacagaaacagaaccaacaggatttctctctctctctctctttctctctctcccactctcctcttgctttaaaagcaccaccaccaccaccaccaacatagttatgttattcagattgattaactccttgtatcagaaatcaaatataaacagtaaaggttctcaatgtcttctacaggctcaaatttagaattttaatgtatgcaatattaaaaaccggatgcatgcaagtcttgctttatatccccatttgtttccacatgtaatattaaaaatatagaacctaataaggttctgtttcctctcgtgttttagcaattctgaaaattgttctgctgcagttgcctgttaatggattggatttttttttttatttttctctgttttggcttttaactgatcacaaaacatttcaggctgagacctacctcaggtttatctcaaccaccccctcaatattataatgttaattcctgcatcatggtgttatatgtcccactaaggaagcactgctattgactgtggtctttacttgtggtggatcatcctctgactatgctttaattaaatgtttacatatctgtccattccatttaatcattagtttttcaaaggtaggggccatatcctgtttatgtcctcaggatgtaatatgataatgcagaatagatatcaggttggttgagggaattaacataaagaaaagggccagttactaacaggaaggaagctgagttaccaagcccaccaccaaattctataactttgagcaagtcagttgtagactctatgccgcttccctcaactacagaaaaaaaaatcaagttactagatggtaccactttattttatttaaagcattttctataatacttagctctaaaggtgttcaatgaacacttccttcatgaatacatcattagttgagccttcaaatttctcctggttaatctgaaccactgtctagaaattatcctcgatgaaccccatattgacaatgtcatttatgggtagaatgtcatctatgagcagaattggatactattttctgatttcttaaaaacagaaaaactgtttaaattttttaagttgttagggacattaagaataagcaaatcgtgtttcataatgtgtatatgtagccatggtagatgcaaaattgagttcagaaatcctaagagaaaagagcttacacagaacagcatatgatgcactagttttaggaggaagcttcacataaaaggtctagttaagaagaataattgctcccatttcttattttgtccgagtcatattcacataacattcctgtaatcaattggcaaattcactggtggtaacacaaatgtccaattagccaacactatttgaaccaaactagatattccaaataagttaccctaaggaggccattttccctgtctaattctttgaacattatgcttgaaatattgaaatgtaacacatttgtgtttcatgactgtgggtactttagcaagaaggagccaacaactcttttcaattgtacccatgcctattttggtagaatatcatgaagaagaactcttgcttgttgaagtgcacactctgctctagagatcttcccttatcatttgtattcctgcaaagtttaattacactttccttctaagccttaatataataaacttagtgtcagcatttttccataactacctccatattttaggatttataggttcagtttgaggaacatcttatactttggaaatttcttttttcatttatgattgacacataataattgtacatatacttaaattatctcagcctgtttatttcaatttaatatgtagatgtttttgtttcatgggaaaaataacaaagaatgtcaaaaacagtttctaatctttgtgagcaagcaatgagcaggatttgtttttgttaatgttagatgaaataaaataatacaactatttttatatccagagtacttgtcagagaatacaattctttcttaagtgttcctgttattttatttcatttctataccttatacttacttttactatagcacatggcatagtataaagttatcactcagctgatgctgcaataattatgcataacatattacccaaacttagtggcttaaaacaatgagtatattggtctcactcacttcacattgtatcaactgtggattgactggtttcacctgggctcactgccctctgtttcaaagctgcaagttgctgagcttaactccaaataatggaatagatttaggtctgctccacttgactttgaacctctataattaactattaactgtctcaaattttatcctatttgtaagttaacaagtttcctctcacagtttcatagatgctgacagaaaacatgagactctttgggcagtgaccaaggacgctattatttatattactactactattattttattgtatttttaaatgttcataccaaagcagacagcatgagattcatgtttgccttagtttattttacctgttaaactttatggagcttatgtggaggcaggaccaggtggatgttttacacttactgggtcggtgtcatacttgaggaacgctgagcttaggaaatccaaatattttaaaagtgacttctagcaaacctgctcagccattaccccagaaagagccattatctttatttttctggacagaaatctgttctctgcctcagagggaaaagtcatctctaacgtccaaggctgttttctctacaaacattcaggcaatgatattccagaaaaaagctgtcaatgctttttgctcagaagaaatacagaaatgtgagtgatccatgtagaattttctccaaatatactctttggaccaatgtctacccagggtatgttcttctcgtggtaaagtgcatgactacatctgtcaaccttccactggacaaagtaaggcatactactaatccaaactcagtgtggcaaggaaatacaccccactccaaatgaaaaacagaagaatgtacatttgccgagcaatgatccaacctatagtcaaagaatgttgaaattacttagcttctctttgatgctaatgctaactgcggttaaagactatgttttattcaccactgtattttccatgcactgccagattatgtcagtgtgtgataagctttttttaaattaatgaatcaatgtccatatcagtatgttcagtataattaatacaaatatataatatttaatcattattactgcagttgcaacatggtacttaaaagacattacaagaatgtggtccctggagctatattttcagtgttctaatcctgtatggcactttacctggcaaattactcaccctttatgtattaggttgtggcaaaaaccacaattacttttgaaccaacctaattccttatcagtaaacaggggctaaatatagtacccacctcatagagttgttatgagcatcaattgaattaataaataaaaggcacttagaacaggtgggacaatatatcaattgccatgagtattgggtatcattattaccaggcatattgttaggaaatttacatgtatgaatcctaattcttataataacctatgagattggtattatgtctattttacatataaagtcattaactcctgaattatttagcaattaactaaaattaatatctccttctactaccaataatccattatttcaattaagctagaactattatatctatacaagatagatattcaagggtgaattttgaatatttataagataactaaataggctatcaatatttactctatttcacgattttagaatcttcttataaaattatgaattccccatctaaacagggaagatatcaataataataattatagtgataatcatgattataacaacactgaaatttttgaaaataacagaaaataacctctgttttgaggagtttaatgtgtctttttggattagtgaaatatatatgcatatattcactgagatttttctctagaatattggcaatcttttacagtttcaaaatgctttaccatggattttaattttgataatataaggtgatcatcaagttaatagtttttttttttaatttagtacgtaggacctattttagctctcactttccaagtgaacgtgtaggcacgttcctcattaatggatttgcctatcaaaattccaaaacaaaaaggtgcctagtgtgggctattactgaatgactcatacttctaaaatctgtcatgtttttttcctactcaccacctaaatagattataactcttcctctaacatgagtgcgctcttactgttgaccttaatagatcttgatttcctactatgcttttttgtgcactattttttgtgtgttagtgtgcatttcattagggctgtttttgtatctctctctgttaattagttagtgactaagatagtaagagattccttttgggaggattttatctatcaggcctcacagaaacaatattcatttcattttatagctaaaacctttcacaatggaagagctaaataaaatctgtaacaactaattatctctaccacaaaattatttacattttttcactaaaatacacactataaacactaccataaaaacacgttaccgtattatttcaaacttttctttaatctataacatactttgtttcatatatgattattttgtaaattttgaccatcatgtcttcatggtgttgcatattttatcaataaaagtaatcccatccaatgtttctgaacttaaatttaactttcttgaatctgaattcttaccatatccattttgtttttatttttctgctgttcagattaaaattttttcaattataataaatgtgcttatgataattcaaacagtaaaggtatatatattacaaattgtctctcttttgatcctttgttattcatgtatcaaagtcaatattaataatttattctggttcctggtataatttttctattattacgtgaaacatatacatttgcaaaagtttttgtttccttattaaaattccggtatttgaaatacttggtaatctatacattctttctttgcttaataaaaaaaaaagacttctagcaaaaatttgtagttccaattcattcttttatataataaccagaaagagtttatgattatgattatgattattattattatttgctttctcaagtaatggaaagcattttgcaggaggcctctactaactagtgtaattaaatatctgtgtgttgttcccttgcttactagggagattaagtcacttttgggaggggcatgatttagtttccttctcctattcaagtccttcctccatattttttgttgcttatttatatatattctttatgtattctgtattacagcttgtgtttcatatgttttgcatgtatctcttcctatctgtcactcatcgtaacttttttttaattatatacacattatatattttgatgcagtagattttacgtaagtcgcctttgtagcttttgatttttcattattttgaaaggtttttatattaatatagttaaatttgccaatctttctgtattgtaattattttatgtttaattaggaaattatttcccaatcttaaaattataaagttatctcactttttgtctcagtgttttttaatttttaatttttgtgggtacatagtaggtgtacatatttatgaggtgcatgagatgttttgatacaggcatgcaatgtgaaataagcacatcatggacaatggggtatccatcccctcaggcatttatcctttgtattacaaaaaatctaattacactcttttttgattttaaaatgtacaattaagttgttcttgactacagctacactgttgtgctatcaaatagtaggtcttagtcgttctttctaaatattttttttgtactcattaacaattcccacctcccatccctggcctccactaccattcctggcctatggtaaccatccttgtactcactatgtccacgatttcaattgttttgatttttagatcccacaaataagtgagaacatatgatgtttgtttttctgtgtctggcttacttcacttaacataatgatccccagttccatcatgctgttgcaaatgaccggatctcattatttttttataatagttttgattttttttacatttatcttattaatctacctgacatgcatggaaagtcagctgtcttagtttcattacttgaatagtttattcttccccgttgatatatcttcctatacaaccaccttcccaaacatgcttgggacatgctttccttttgttttttattgatttatttgcctattttcccataacacctgttttgattattttatattttattaagataatgtctgatcttctttagagttatcttatttcttttaggatcctatatattccaccttaataatagaagtaattttattgtaccacaaaaacaagctgtttggattttattggaattaggtttaatttatggatttgtttgaaagaaaactgacacttgaaaatgttctgtcgtttctttctttgttttctagtactgccaaatacttctatttgatgcagctttgtctttcctctagaatttagggaaagaaagggtagagcgactgaagtttttgtcttaaaactagatttctaaaaatatagaatccattgtttttcagtcacatagcttttgtcacaggataacatatacaatgaacacttaaccaaagtttgtgaatgtaagtttgaattatggacaactatattccaactatgttcccttacagtccactccaaatatagttggcctctatggatgtgatgcccacaggcagcttgaaagttctgcagatatacctgtgactcatgtctttccagatgaaatcctagaatatcaacatttaaacatagtttaaacacaggacttcagtacctgagatttcataagtcttcattctaggacccagcactgtagctcaggaccatcttcttacatggcaattatacctctgaggtttttaaccattgatgctttttaaaaatcattgcatacaagaattctaggatacctggtaaataagaaaagagacaaaatgggagaagtcttatttggagaagaggaagagatccacttagaaaagagtgtttgcatagggtaaatgtaggattaggggaggagacgatgcacaatttggaggaatagcatggtgcaggatttgttgtcttggtggtggttgggtacctggctaatgtgcagagagtgactgaatagtggcaaaagcaagcttagtcccctttcataggttgcatggatcatatgtatcccagtcaactacaatagctaaatcttgagcagccagttgatggctacgcatctgtgtctttggcaagcacaatgaggtaagggatatgggagaagtcaactgcaagcttggtaggaaaggaagtggaagccatataacttctcagtacattattttcactcaaaattttagaaatataccattcgcatctatttaaaagcctacatgccacatgctcactatggacactgagggagtatttaaaattatgagtggggcatttaggtaggtggagtgccaaatctccaacatgaatttgaatgtagcattggccttagtacttctgttgaaaacatgtgctgagaaagttaatctccaaatatcatcagtattgatttctaatgttggcacaaaatccttttctgactttaggtgagtgaagaaagtaaagcagttattttgtcctttcaataaatgactgaactttatcccttcatgttgtgctcacatcaaaatttgttgaatttgcctcttggcagacagggagaaggaggaactcaaggcctgtgtagcagtttctcagtttgataatggcaacattccatcagcaggcaacgtggtctgtctcctgaaactgtgcatctgtaacatggcagcctgtgacatcctgccactttaatccttttattcctgctgtcagtttacatttcataaacatttaatgatattgcaaaaatctattatagaaactgtaaccgttattgtaaaatatacatcaatttgaaaactcgtttaattatttttattcccaaaagagacaacagaacacgttggaaagatttcccactagaaaaaattaatttaatctcttctaatgggcatcaatgaagaaactgttttgcctaattcacaggtatgtaatttcctttcaattttcttcctctcagtttttgttggcaacttaggtctgagaaagacagaagtcccccaacaatactgattgaaaaaaatcacctgtaggattgtcatgaggttctccctgctgggctctgctctttgttttctgttaccctctaggtaggtgcttcatgaacacctttctgtggttactttttactgtctcactaaaactgttttcatccatacttcttagaaaaggagaataacttgatgctgtctgtctgattgtaaaatatttgctgggaaagcaatgcaaagaagataaagagggagtttcctgctgcagggctacaaccactgaaaatcaaatttcctaaggtttctttgttcttatagtgaattggattgtaatttgctgtgccttaagcactttgctatgtcctagatatcacatttgaaatgttcatcttccggggtagtttcacatggtttctgagattagttaattaagatgagtcgaatgttattcgatgattaaaatagtatcacaaacaaggacagttgtttatcatgtcccatgcattgtgcttcgcattgaacatgcattagattatttaaccttcacacaatactatgaggattacattatgactgtttattctttgatggcaaatgtacaaactgaacctcaaagatgctatgaaacttatccagggtcacacagctagtgcatttggggtatagttcaaactcaaggaatatgacttctctctgtgctcttaacctcatgaatacagtctccagtgcacaatgaccaagtgtgttcatcttacaaactgtcagagaatctgtgacagatttctaacactaggtgaactgaagtatttaatgagtgaattaattatttccttcaacagacatttattaggttactctgtgcccagcactgctctgggcacaagagatacagctgcaaacaagtcagagaaagaatctgtagctatggagattgtattattgcagatggatgagaaaatgacaattcccccagtttaccttgtgcattcgctggaatgttagtgacattttcatgaatcaacgagtgatttgaatactgcaaattcaggctgcaagaatcagtgctttaagcattaattttacttgtcattgggacaagagtcgtgtcttatttgtgtggcattttcctccatgagcacagcaccttgataagtagtcactagtggttcctcaaaaatatttattaaatgatagagtgttatgagctttaaaaattatatgctactttctgattttaaaaagagaagagggcaatttgttattttaagtaccatgtctaattcttaataatgggccatgtgctttctgagtaatttgacttcctagccttgatcaggaaagtggaatttcaaagcagtattatgtataaacaaatgctggattaataaaggtgtccaaatactttctattaaataaatactatagttttagctttttaaaagggccttaaagtggatgtgagaacacagtctcagttttcaagggtatagacatttggagcaaaaaaaaaaaaaaaaaaaaaaaaaaaacaactggagataggtattcctctaattctgcagagatctccaaaaggatcagccattaaagaaatagaaaaccgtctcttgccttcttataaatgtggaaatggtagcaaaggcagaaccagcatctagacacagtctgaagccagctggttgttccctcagtgaattaattcattctttacttcattcaatacactgacctgagtgtgtgctcataagcagtcgtagaccttgtcctaaaggagtatattttctggataagatggcctgtgtatatttggctgaggaagtttcagagcaaatatttcagagtgcaacgaagactgagggagcagcaactaactacatggggcagggaggaggagggaagtctggaaaggagattgcattggagggccacaaaatagaaaggatcctaactagacccagcaggctctttatattgttctgattcctcttaagaaatgcaacttgttgtactcagacataaatgaatgttacaattttaatcaccaggaatcagtgttatcaggattatatggaggaaaaaaaaacagaaaacaagtgtgccttaacgtaatcacagctgcagggtttctcagatactttggagcatgatggctggaaagacaaaaaaaaaaccttttaataatgaaactcagggaaatttaacaaaaacatttcctactttctttctttctttctttcttttttttttttttgagacagagtttcactcttttttgcccaggctggagtacaatgtcgtgatctcggctcactgcaacctccgcctcccgggttcaagcaattctcctgcctcagcctccggagtagctgagattacaggcatgtgccaccacgcctggctcattttgtatttttagtggagatggggtttcaccatgttggccaggctggtctcaaactcctgacctcaggtgatccacccgccttggcttcccaaagtgctgggattacaagcgtgagccaccacgcccagccaacatttcctactttcaagaactcttgcactatcagagcactgaacctaagatgataattgtatgaaactcagatacaagggtttcaacctgtaacagcatgtcagaagccactcctggcttctcttgggactttatgtaacctctaacattgcatctatattcagtttattcctccaaaatgtgatgcaattccagttaaagtaaccagataggcttgtgtaatattaagctataagagttttcaaagacaatgtgttaactattgataatatttaaactcaattatattattcctcctcctttaaacttacattagaagagattttcaagtgccattatataaaatatataaatttactatttaaaactatatatattttttgcagactagctcatgtgccagagattttttttaaagtcctttctaaaatttaacatagctcaaaatttatgaaactgagcaaggatctctaaataaatccgtatttaaactactcattatttttggcctcttagcaaaccactgcaattataattttaaatgctctttgattaatataaatatatttttgttaataatataagccctgtagtaatttaaactggagacctttctttccttatgctgaaagcattaataggaaaagaaaatttgatagaaaaataaaccagaatgcagtgatgtcagaaatcacttcggctctaatcttcagatcttttggaatattcaacatgagtgataaggagtgggatttgcagaatagatgggcgtgactctgggacaagtatgaagacactgctcccttcttccaagcttatgctcaatgttcatccctatggaaatctcctttatgccaaattcttcctgagatccattgtctctttttatttgactccagatttgagcaacttgttattctacagaacccactgtacaaatgatctattattattttaagtcattgatatttgggtattgttacattctggaaaacaaacttgcctatcttgactcattcaatcaccttccttatacaagagacatattaatgtaactggaattcaagataaggaagtttgcattagaaaactaattgaggctttggatttcttgagttgattccttccaattttactgttttttcctttctctatctaaaagtattgtaaatttaataaacagacacattaactcagccaattgattgcaggatatggagatattctcaccttccctctgagctcactgccttgaatatcaagccgactgtaagtctctgtggcaactcctgtagtgttatttccctgacagattctcaatagtctgtgagaacgtaatcactggactcattccaggcattcatgtcataaaatttcttgacaaatctgacactgattggcagacttgcttgcagctggaaatacgggccagaactagaagcacatcagctcaatgattttgcttgatacttgactttgtgagcagaaagttatgaaagatgcactcactttacaagggaaaggacacctgctctactgcttttcccatctgaaattattattcaaactcaaaatatgctaatcaggagcataaagggtttttctgaagtaatatcagagtcctttttccagttgctttctatagacagcacagcaaggtgcatggcttttgcaggttagaccatcttagcctgaagtcctaaagtacattcgctctcggcagtctcacagatatttgtttgtcaatgtatggtctaaattgctttctggtcctgtgtgattagtgttagttttgtacattgtcttttcaatggttacatgatcatcttttctctaattaaatttatactcctggtatcccaaaatgaagaagaggctgcctgcctaccagtttagctttagtgatttttttatgcttcataatggagtacttgtagaacataagttgagagatttatgagacatatctgttcaacaaacttgtattatttcttcctggggtcccaaagaaacaattgtctctatatgattaaaactttatattttctcctaaaccaattgcttcttttgcatttcctgtcttggttagtgaaactttcttcccttccggtaaatgccagactctaggcatggacagctttgaactttcctgcaagactgcaaactctatttctcatggccattggtcatatcatttattgccctatattacatcaattaacatgcttatcttatcttcattatcagacaaaaaatgagaattatgcctaattcatatttatttatttacttattttgtaaagatgggatctttatgttgcccaggctagttttgaatttctggcctcaagtgatcctcctgtctctgcctccaaaagtgctgagattacaggtgtgagccactgtgcctggctatattactttttatccttaacaattctttcaaaaggtcttctatttatatagcagatgattgctttatgtttgttgaatgaatgggtaattttagattgaattagtctgaattttcacttcaggaatactgaggatttgaactcttaatattactttaaatgagaatttcctaatatgctctattacttttaggatatctatgagaggaaagctggaaagagatttaaatgtaagtacaaatcaaggctctgataaccttcatgagatatacttctgacattatgatgcatattcaatatgttctttggtgtatgctcacaaagcaagtacaaactctctgtctgacaatgtcactcctgtttgggccacctataatacttgcgggcattgtaacaagagaataaataaagacccacataacataaatttatgtttttaaaagttatagatactgctaataatatgctaaataaaatgtgttctatgctcctaccttgaaaaaataacttcctaatcacctcgaagtgtaggttcaaattgtgatctcttagactctttgcacttctcagttagaaggcagcagcacagaaaaaagaacatctttaggcggatgctactggtcctctccccatctcttcttccccattcgcatcctccaactctgggaaggtacttgcactaatatgaacactactatatataaattaaaattttatttacactttcccactaacttttgccactttgttagccattgagcctaggggtatatacacctgaggtaggtctgcactgagcatgatgggccaaggaggaagcccacagaaccctagaagtggacttagggccatttgaaaagggaattcctgggacattaatacacagagggtaggttacaagtggggtgctaatcatcccactggtagacccctcagggaggctatgcctggggctgttgttgcttgggcatatgggtagtgtttctggttcctaaacatctcccctaaatacactatttaactcttatgaagatataatcaccatttatagcttcatgtacatttaagagaaattaatgtttcatccttgaaaaagctatagttaatgaaattcatgaaatgaacatatgtagaaaattctgaattcttgaaatatacagcagaatatgttgcaaaaagctcaggggtgcaaataatcaaaactgattgtaatcatgtgtgaaaaagatttatgatagtggatgaacgaggaaataaagaaacaaaggacgctgcataaattgttaaaaaacaatgagagtatccatgaaaaattgagactaaaaaaaaaatcttgctgcagaaagcttatatcgggatagttaaatagacccaatctgtcaaaaatatctagtttcctgatgcattagagaagaaaggggtctgcatctgataagttaaaatcctttgccaggaaggcttcctcaaacttctttttatttagttcaaaaatattcaaaaaattgaattggagagacttccactaaaattaccaggagagctgtaattttagaataaatttctactaatttgtgatggctctttcaataataactgtaaaagcatactatatgtttcaaaatacaaattaatttagtgagagttaatttttaggaataatgtagctttacaaaagttatgacttgatgtctgtggatggcaactgagaacactgaaaaaaaccctggattcagatcttggctttagttggaattgtagcactcactagatgtataacattgggtaaggcacttaaacagcatactttgagaaacaatttctcaacataaaattaggacaatggtatctaacatggttgttgtgaagactaaatgtgactacatgtgacaatgctttgtaaatggcactgtgtggtaccattgttacacactaatattaatattatttgtcttaactccctcttactatgatttctaaaatatgtcatatatataaagtgtgcattcctcataagtgatttacttcttttcagctcagtagcagttaattccttaaatttgaatcactgtagagcttcgtttcagtcattaaaatgactgatctgaatcaaggtgtcttcttgttaggttttgcttttatctgaacaagcaatttggatcaattaagcagtcatctatttgaccgtttgacaactgagacttgttgtaattaaaataaacatctcagctgtgtttctggtcaatcttgcacaatatccaacattattttactgatttttttcttctgaagagagttaaaatgtacatgatgaaaataacaaaatataaggtaagagacttttatattatattctacaatatgtatgtcttgaagaaataaaaaaggcattttagatcagcaaacatattccaaaatattaaaaaatcaccaaatgaggtggaaatctttcaaagtcaggggaaaatatactgttggatagtcaactacgaagatcaagcaaagccacaaacaaacatataaatgattatagataagaactggaaaaaagattggaaagggttaatgaagagctagaattcaaagtaagtgtgtgaaactgacattaaatacaactaaattttacctcatatgacatatatgattaccatatcagtaagagcctggcctcggcaaaatctgtggcacaaacaaaagtcttctttggcctccactgcttcttttacacaaactcttaagtgtttgtactactctttacatcctttatgcctttatatggacttgtggcttttgaatatatcataacttcttaggatatgatttacaatgttgtcttcttctccctctttttggggaaaatacttattttacttgttcattatggaaaacttttaacctacacaaatgtggacagatgaacataaaatgaactcaggtacccattctccagcattaaaaaccatcactctatggcaaatccttcgccacctacacactatctactccctttcccatctgtaaagtcttcagtctacatatacttagatatatgttataccgttgagatgtatttttaaaacccagtcacaatactatttttgcacctaaaataaaaagtagttcattagtaccaccaaacatccagttagtattcaaaattagaactgatttataccttttttcacatttaatttaataaatatgtaaataatgcctatgtattataataatggatatgtatgttatgctcttctaatctatacattttgccttcatattttctggccatttctcccaccattcaataatagaatagttagacactaagtgtcaaatcctatggaaagctaatctttctaatttgacttgtggcttctaatcattagaaaagcatggcaaattggacactgacaccctcattttctcttgcctaatactgtatttcaaatatagggttctgtgactacaaattccgcatttttttttttgcatcataccatgaacctttccattttatcccaaaggaacacaaaggtaccatcatctatatttttactgcttttttcccttgccatgcggttttctgtcacaaccatgctattcatcagacaaaggagaatctaattcatttcttaagataaattaatacctgtgaagagcttaatgaaaacttggatatggagtggtacataacatgcaccattatggattaattaataacaagtcaactcaaactcacctcatttcataattttgacagggtctaattttacttgagtggtggatgaggggaagagcacagaaagatagcacatgaactttattaagaaatgttataaaacctctcacagtattcttgtggcagtgataaagaattggaggttgtatgttagtaaatttatttaaattcaaagagtcaagacaaataaaataaaaaaatatctcaggagataggaggcaagatggctgactagacacagctgcaagcaacatctgccactgagagaccatgacaacaggaaggctggagcactcctagcagatcttcagaatggtggcatggagaatggactgagggaagacacagatgctgggctgaagtcaggggaaactaggaaccctgaacaaggctaccaccactcactggaactcatttctagcccccagtgactcctgggaagaagtgagttgagaagacaagaagcaacctgccatgtggagcaaccactggcaccaaactgccagtgtccctgggggctgtggagactcttgctgacaggattccagaggtccgtggtcctgccagcaagagactccacaatccccaaggaaactggagctggcagggaaagctgtttaaataataggtaggggcagaaatccagcaggtgcgaatcccagaggtttcggtgtgaaagcatctctagtaaagcatagccggggcgcctattctctaggcttgactctctcccataggagactttagtcctagggcacctgttggacctgaactcttcaaggcggttttgcacaagacgaggctggtctgacctgagcaaccctcagtctgctggcctctccctgggccccagcctggccatacctgcttgcagggcagccttggatgaccaagtggggtaccacttgggggcccacatcatattgcctgatgtaacagaccatactggaccagtgaagagctctagtagagtgcacctgcagatgcacaccagccaacccaggccctcccctcaccacagccttccctgagccactttgcatgtatgcactcttccacggcaactgcccaactgtactgccattgctgttggaacattcacaggcatggagaccatcagccacatgctggccagcacccagaacctgcgctgctggcaagaagccatgcagggacaccagtggacccaccccatccctagcagcagctgccacccatgtgaatgtacacatggagggcacactcagtcatttgcctaacagcaccctgcccgatgctaacaccactgccaatgcaaatgtgtgctggaatgctggtggagcccctcccctctcccatgccatgctgctaccactgctgttgtgaatgccagcatggaagctggcaccactgcatctaccagtaccctgatgcagctgagaagcatgcaaccaatggtgctgccactgctggtggcatgtacaaatgaggacggatcccgctgccaccaccctaagaagcacagtggctggcaccacccattggagtgttgtggccagcagtcaggaacaacatggccccttcagtgctgcaggttccttaacaccagggggaaacagaacaaagccaggggcctgacaccagccctccagagttagaacacgcagtttacgagtcctgaaacgagccttgcccccactaaaatcctccagaagcaaagccaatcaaatgaaccgacattataccacaatcaaacccccaggaccattgaaatatgtttttcaagttgcttggtttctctctctgtctcttgaatacaacatactgctgggtcttgccacactgtgccatttaattggggtatttatccaatttatattcaaagttagtattgatatgtgtaaatttggtcctatcatcatgataaagctactgacccaaagatcagtagctttaaagattgaagaaacattagccaaaaaagatgagaaagaactagcacaagaaatctggaaactcaaaaatccagagtgtttcttacctcaaaaggacagcactagtttcctagcaatggttcctaaccaggctgatagctaaaatgacagaaatagaattcagaatgtggttaggaatgaagatcattgaaatacaggagaaaattgaaactgaattcaaggaatccaaggattacaaataaagacacaggaactgatggacaaaatagcaattataagaaagaatgaaactgagctgttagagctgaaaaatactctacaggaatttcataatgcaattgtaagtattaacagcagagttgaccatgctgaggaaagaatatcagggtttgaagactggctgtctgaaataactcagtcagaaggaaataaagaaaaaacaataaagaatgagcaaaacttctgtgaaatatatgattatgtaaacataaccaatctatgattcctgggttgcctgagggacagagagagaaaccaagaaacttgaaaaacacatttcaggatattgctcatgaaaattttctcaacttcaccagagaggcaaacattcaaattcagaaaatgcagaaaaccccagaaaaatactacacaaaaagaccaccccaaaacacaccgttatcagattctccaaagttgaatttttttttaagtgcaggtcacttacaaagggaacatcatcaagctaacaacagacatataatcatgaaccctacaagccagaagagcttggagacctatacacagcattcttaaataaaagaattttttaccaagaatttcacatttggactaactaagctttataaacgaaagagaaataagatccttttcagacaagcaaatactaagggaatttgttatgaccagacctgcaatataagatctcctgaaggaagcactaaatatggaaagaaaagaccattaccagccactctagaaacacactgaagtatacagaccagtgacactataaagcaaccacacaaacaactttgcataataaccggctaatatcatgatgacaggaccaaatttacacatatcaatactaactttggatataaaattggataaataccccaattaaatggcacagtgtggcaagacccagcagtatgttgtattcacgagacctatctcacatgcaatgacacctataggctcaaaataaagagatggagaaaaatttaccaaacaaatgaaaaacagaaaaaagctggagttgcaatcctaatttcaaacaaaacagactttgaaccaacaaagatcaaaaaaagacaaagaagggcattacataacagtaaggggttcaattcataaagaagacctaactactaaatatatatgcacccaacacggaagcacccagattcataaagcaagttattagagacattcaaagaaacttagactttcacacaataatagggggagatttcaacatcccattggcagtattagaaagatcattgaggcagaaaactgacaaatatatgcaggacctaatcttaacacttgagaaaatggacccaacagacatctacagaactctccacctaaaaacaacagaatatacattcttctcatctgcacaaagcacatactatacaattgagcacaaaattgggcataaaacaaacttcaagaaaaaaaaaacgaaattatactagacacactcctggaccagagtgcaataaaaataggaatcaatgctaagaaaattactcaaaactatacaactgtgtggatactaaacaacctcctcctgaatcacttctgagaaaataatgacattaaggcagaaatcaagaaattccttgaaactaatgagccaagatacaacatgccagaatcgctgggacacagccaaagtagtgttaagaggaaagtgtatagcactaaatgtctgcatgcaaaaactacaatgatcttaatttaacaagatttgttcattgatttcttgttttctactaggtttggggttagtttgctcttgtttatttggttcctctaacaccacatctagaagaaccaaataaacaagagcaaactaaccccaaatctagtagaagacaagaaataaccaaaataagacctgaactgaaggatattgagatgtgaaaaaccatacaaaagattaatgaatccaggagtgctttctttgatagaattaatcagatagttagactaaagaagagaaaaagagagaagatccaaagaaacacaataagaatggcaaaagggatgttaccactgaccccacagaaatacaaaaaaaagaaattagagaacatgatgaacacctgtatgcacacaagcttgaaaacatagaagaaacagataaattcctgaaaacatacaacttcccaagattgaaccaggaagaaattgaatccctgaacagaacagcaatgagttttgaaattgaatcagtaataaatagcctactaaccagaaaaagccaagggctagatggattcatagccaaattctaccagatttgtaaggaagagctggtacaattactactgaaactatttcataaaattgaggagaagagactcccttttacctcattctattcagccagtatcatcctaataccaaaacctggaagagacacaacaaaaaaagaaaacttaaggccaatatccttgatgaacacagatgcaaaatcctcaacaaatgactagcaaatgaaataaaacagcacatcaaaaacgtaatctaccatgattgaataggctttatccctggatgcaaagtgccttcaacatatgtaaatcaatacatattattaactacataaacagaactaaagacaaaaaaattatcatctcaatagatgtagaaaaggctttcattaaaattcaacatcccttcatgttaaaaaaccctcaacaaactaagcattaaaggaacatgatttaaaataatgagagtaatctatgacaaacccatagcacacatcatactgaatggacaaaagctggaagaattccccttgaaaatcagcacaagacaaagatgccttctctcatcactcctactcaacatcgtactgggagccctaaccagagaaatcaggcaagagaaagaaataaaaggcaaccaaatagggagagaggaagtcaaactattcctatttgcagatgatatgattctatacctagaaaacctcatagtatctgaccaaaagctccttgatctgatacacaacttcagcgaagtctcagaatacaaaattaatgtgaaaaaaatcagtagcatttcaaaacaccaacaccacccaagctgagtgccaaatcaagagtgctatttcattcacgatagccacaaaaagaataaaatacctaggaatacagctaaccatgaaagtaaaagacctcttcaatgagaattacaaaacactgctcaaagaaatcagagatgacacaaagaaatggaaaaacatatcatgcttgtggataggaggaatcaatatcattaaaatggccatagtacccaaagcaatttaagatttaatgatattcctattaaaatacccataacattcttcacagaatgcaatacaatccttaacaaaaacagcaaaggtggaggaatcacattacccaactttaaactatcctataaggctacagtaataaaaacagcatggtactggtacaaaagcaggcatttagaccaatggaacatagcagaaagcccataaataaggccacacaactacaaccatctgatctttgacaaagccgacaaaaacgagcaacaggtaaaggactccctattcggtaaatggtgctgggatagctggctagccacatgcagaacactgaaactgtatccctttcttacaccacatatgaaaattaactcaagatggatttgaatacaacccttaaaagtaaaaccaaaaactataaaaaccttggaatataacctaagaaataccattctggatataggacctggcaaagacttcatgacaaagatgccaaaagcagttgcaacaaaaacaaaaattgacaaatgaaacctaattaaactaaagagcttttgcacagcaaaagaaactatcaacagagtaaacagacaacctacagaatgggagaaaatatttgcaaactgtgtatctgacaaggtctaatatcacgaatctataaacacaaaatttacaagcaaaaaacaaacatccccattaaaaagtgggcaaaggacatgaatagacatttttcaaaagaagacacacatttggccaacaagcatatgaaaaaatactcagcatcattaatcatcagagaagtgcaaatcaaaaccacaatgagataccatttcacaccaatcagaaattaggttggtgcaaaagtaattgcattttggcaaaaccgcaattattttgcaccaacataatttttaaaatttgaaaaataacagatgctgatgaggttgtggagaaaagggaatgcttgtgcactgctggtggaattttaaactggtttagccattgtggaaaacagtttggcgatttctcaaagaacttaaaacagaatgaccatttttacacagcaatcccattactgggtacatacccaaaggactataaatcattctaccataaagacacatacttgcatatattcatcatagcatagaggcgctttgcctgatacctgtatttgaacagctgtcagctctccaagcctattgtgtacagtatagcataaatttggggtggagtttagctgtttcctaattagatgtaaaaggtgcctttttgtcttgctgaaggagaggaaggggctaaagcctgtgtggctatggtacatgggaaaagagggactattttataatgttcagtttctcaatcataataaagtctttataagcttaggttggccggttaaatatgccagggcaacctggaagtggaggatagtagcaattctgcacatacacaacagtttgattatgtagagaggcaaaagtcttacccactcagcaaatcacacagcatctatgtgattccaacttatatccaaaagtagaatgccaatccatatctttatgttacccatccttgttgtttcttatgaacaggagccagaggtcaattgttggctcacaggaatgagtgggatcagtctcttgtgttccgtcagcctgtgaggctgcataagagacaggtttaattagagacaattagactcagctgtttattcctgtaactttaactgcatttggggtactaggagaacttgatagggtcccttccattttggggaaagttgatctgttggggattcttccttgcaaatattccgtaggaaccaatctcttggctggtttataaaaagattctcttccttagtaggggaagggattctttggtttccatgttcaaggagtggcttttgcacttgtcctaagttgattacatgattttgtagcttgaaagtatctatgtctataaggatatctgtagttgagaaaggccatacatacattatggccaaagggctgagctgcagatttttggggaagggatcccacactcataacaaggctacaggcaatagagacagccagatttctgatgtttcctggcataggttagcaacagtcctttttagagtttgattggttctttctactttccctgaagactgtagcctccacagtgaatgaaggaagtactgaattcctggggctgaagatacattttgggtaattgtcactgtgaaagatgggccattattgctctgcaagctcttaggcagcccaaatttaggacttttttcctttaataagagttagaaacttcatttgctttctcacacccaataggaaaagactccatccaactggtaaaggtgccaatgaatactaataaatatgtaaaccctttacatgggggcatctgagtatagtttacttgccaattttcaccagggtacattcccctgtgcttaacaggtcttactagaggaggaggtaaagattggttattcaggttatcctgggcagagttcacaggtctgagttacctgctttactgttttaagaaagctttttgctataaaaggatgagagattaattgaaacagagaatcttcccaaatgagtagagtcatgcaaatacttaactattttttcttgattagcacccagaatcaacagtttgttgtcattgataagccagtcagcaggatcttgaattcaaccctgatctttagcccattcttgttcctctttagtatatctccattctgtcattactggggtggtgagcactaacatgcccacaagtctaactggctccttccgtgcagctgccgcagcatctgcaaaggagtttctctttgccacactagggtctcctttatgatgccctctgcaatggattacagctacttccttgggcagcaaaacagcatctaatagatttaaaatttcccagtcacattttacaggagaacccttagcggttaggagtcccctttctatcaagctggaagcttgagcatgaagtaccagaaaggaatacctagaatcagtgtaaatgttaattcttaagtcctttcccaattgcagtactctaataagagcttttaattctgccttttgagccaaggtagaagctagtaaagactgagattcaattacctcatgttgactgacaactacatacctactttttctgtttccctggtgcacaaaactacttccgcctataaacaattctacctcagaattatctagaggcttttcctttaaatctggccagccagaataagcttgctccataacttgtatacaaagtgatctagggtggctgtgggctcaggaagaaaaagtagctggatttaaagtctggtagacttttgagttacatcaggagtgtctagcaacaaagcctgatatttcaataagcgtcccacaatttattggcttcatctaccaaaagagcagttggggcaactgccctgagacatctaggccatcctgaagctatgtggtctaattgtttagaaaaacggccaggtgcggtggctcattcctgtaatctcagcactcttggaagccaaggcaggcagatcacctgaggtcaggagttcgaggccagtctgaccaacatggtgaagccctgtctctaataaaaaaaacaaaaattagcctggcatggtggtgcacacctgtaatcccagctactcgggaggttgaggcacgagaatcacttgaacccaggaggtgaaggtggcagtgagctgagatggcaccactgcactccagcctgggtgacagagtgaggcttcatttaaaaaaaaaaaaaaaaagaaaagaaagaaagaaaaaaaaagaaaagaaaaaaaagataagctattggtcaggggatattttccagtttcttgacaaagacacccaggagggttccttgctttttagccacatagaagaaaaaagacttatcaagattaggaatccctagggctggagctggagctgatcctgatttcccattgagagcattaaaagcatgtttacaattgctatctcattcaaaattatctagatctgctcctttcggggcctcatttaaaggcttggccatatgcccaaatccaggcactcataaatggcagaattctactatcccaaggaaagcccacagccactttctagtttggggtttttgaatgccccggatagcttcccttcattctggggctattgctcaggtgccagaatttaggacatatcctaagtatttaacctctctagttaaaatataggacttatacaatgataccttatacccactagttcccagaaaagttagcaacttaatggtgttttcatctgagtctcttttagttggactagcaacaaatacgtcatccatacattggataatagtgttcttattcatttgtaacatccttaattctctagccaatgcattagactgtccctaacccctcggtaagaactgtctaagttaattgagaaaccaaatgactatcaggatcagtccattcaaatgcaaagataaattgcaaatcagggtatactggaatgcaaaaaaaaaaaaaaaaaaaaaaaaaaaaaaacatctttaagatctaagactataaaccatttggcatccccagagatctgggctaacagcctgtagggattggacagaataggatgtatgggaatgatagtctcattgatagcttgaagatcttgaacaaatctgcagtcttcatttggctttttaactggcaagattggcatatttacaaggagactcacaggaccttaacaacctgaattgcaaaaacttagctattaatggttggatccctttttgtgcctccggctttaaggggtattgtctcttccaggggtatgggacatcaggcttaagttgaatgcaaactggggggattttaaagttttgcttggaacctcagtgtctcatacaccaggatttacttgggaggttatttcattaggtaaggtagataagtcacctactgacctttctcccttttcacaggagaggagaaagagcaatctctcatctgccttgtgatttccaaaaggtaccactgtttgcagctgagtcaacaaatatcttcccccaaaggaggtgggacattcaggcctgataagaaaggcatgtgagaaagccaaagttcctgaagagcagcttaaaggataggtaaaataatgtctatgagcttgttaatctatacctgtgaccatatagttttcggtgacaggcctgttattataggtcaaaacagagtaaacagttcctgtatccagtagtaagtgaatattcttacctgccacttcaagggtaaccagagattcctccagagatatgactagttgccaaacctgagctgttgtccaattggaagctcttgggttccgtcactcttgggcttgcttaactatttctgccatcattggttcaggtgccaacagctccattcagagtgctgagcattccctctttcaatggccaattttcttacattatgcacaatgatctatgcccaaggcacagtgacttggatgtcaagctttaggttttccacctttttgcttcctttgttcagaccaagagccagaagaaaccttatgtggaagatgagcttaaggttacagccaagagctacaccttgtgggaggttcttttttgctctttctgcttcctttgttctgttattaaaagctttaaatgccatatcccaaagcaaattaataggagtctggggacccatagctggtttttaaagtttcctatagatatcagggtagactgggttataaaatgtactcccaaaaatgtctgtccttcccttgagccagaatcagtgttagcatattttctaattgcctcaactaaatgcccttggaacaaagtgggattctcatctttaccctgagaaacttccttaatcttttcatggttaacaggctttttcatatacttcttcatcccttacaatgaacaagtgaccatataatttctcctccccaggtcctcactgccactttgatagttccattctgaatcttgatctggaactgttgcatcctttgctggatatatattatggttagggttatgagccaatacctcatctgcatgggtcctagctggtcccaaacacagtgtttctctcctactgtacaacacagagatgacaaaatatgcagatcctggcaagttaaactataggtaagagttaatttttcaaactcgtctaagaattttcctggatcttcagagaaatgaccaaacttctgtttacataaagccaaatcagacatagaaaagggggcatatattcttacagtgccttcttccctgttcgccaccactctatgtggacaaagatttccttttggaggttgataagaggctccactatgagtagtacttgcagggctatgttcctcagggtgtggtgagtatagagtgggactaaatgggtaaggaggaggagacaaaggggtcacaatagaactttcagatggactagagggagaaagggctgatgcacctgaaacttcagagctgacagaaggaggctctgctccacccaaaaatgcctgctgaactgtgggggcttacatcaagggatcttctagtatgcctatttttttcccctttccgctaatcaaacatgcacacacttgttgcagggttttatcctgtctgagcagcaaaaatgcttgaacatatggtatttcatccgattttccctcctgcttacaaaacaaatcaaattgaagtatagtattaaaggccatagttccagtaggtggccatttttcttcttttccaaatagtatcgaggccagacagtattacatagaaacaccaatttcctctttttaagcccatttagtttaaactggtcccaacattcaagaatacattttagcagtgagtcctttgggattgatgatgtggttcccatgaaggagggaggtgatgctgaaagaaaagttccaaatcttgtattgtcactggccaagttccactaaaaaggatacgggaggttttaaggccagctgcattaatgaggggatccctgctgaaaactgaattatcttattcacactgccaaataatataaatgaactgagtcatgaatctttttttttttttttttttgagacggagtctcgccctgtcatccaggctgaagtgcattggcatgatcttggctcactgcaacctcagcctcctgggttcaagcgattctcctgcctcagcctcctgagtagctgggattacagttgccattcaccatgcccagctaattgttttcttttctttcttttttttttttttttttgtatttttagtagagacagggtttcaccatgttggtcaggctgatctcgaactcctgacatcatgatccacacacctcagcctcccaaagtgttgggattacaggcgtgagccacagagcccagctgagtcatggatcttagataaacaacaacatggaatcagacacaagaaatgtcaaataatgcaaaggaaatgaagagcatttagatgaggatgaccagagcaagctggtctgggcaatagtggcagtgtggattggacaagcaaagccgatttgcctgaatccaagaaaggaaataagtttttatagtgtgcaaatgaaataaaacagcaaggagaaaagtcccctgatttccatcctagtgcttctcgattatgcctaataggcgcagctgcagcaaaacataaccgcgtctatctaatcttattgctcatagctgttaaataccaagtttcaatcagcaattttagagatgaggccttagcagctagagtcttaaaataagccaaatataagtaagccaaatcctgcaatgccttttgttcccaatgtttcacaagcaaatggatggaaatttggaggtccacaggggaataaaaagttaaaatacctaacacctgttaaatgaagtctcctgaaaatgacagtgaaacatagacaggaaccaagaaattgatccatgcagcaaaaaaggacaaggcaaattaatacaaagacaaaattaacaaagaaattaataaagacaaagaaaaaattaacaatcagttaaatttctgtggtgccaaacccattcttagcggagggagactttactgaatggaacctctaactccctaaatcttaggagggattctaaccctcccaagctgggccttgaacccaagtttggtcaagtgtccttgccttttattaagaggagcctttaactttctctggagagacactaacttccctaagttgggtctctaacctaatcccatcctctactcaggtaaatgcatcccacttacccaaagtcagccaactggtattgcatgcaaatgattttcctttgggtccggggtctcttcagtataattccttcatggttcactagaaagatgttaccagaaaggggtcctaaatcagaccccaagagagggttcttggatctcacacagaaaagaattcagcatgagtccacagtgtaaaatgaaagcaagtttattaagaaagtgaaggggtgaaagaatagcttccccatagacagagttgggcattcctgaaagtaagaggtggaacatgcctacacaaggtaaaatgcttgtttatatataggataacaaaaacaaaatcatggggagatgtgctctactacaggggtttgtgataaaggattaatttttttaattactacattttgcaagaaccattattatctttaaagcaaaattaggaatgttttcgttctcaagatatcgggatatcaggacattcctgagcttgggtctgtttagtaagcgttattaatctgttcccttaaccataaacatctagaggcctcctgggagtgcagcccagcgagtctcagcctcatttttcctcaccctcattcaagatagaatccctctgtttcaaatgcctctgacaatataattaggtgggttaatacgaaatccagggttaaagcataaagacaacaatttaaaaaattatgctttgtatttctatatcatttgttaagatgtacttaatccttctattgttattgaacaattttacaataaaatcacagatatcataagccaggcacagttaacacaaaataaaaataagtagtgaattgaacaatgagaacacatggacacaggaaggggaacatcacactctggggactgttgtggggtaaggggaggggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaattaaaaaaaaccgaaatagtagttttttaaaaatcttgggtggtagtttaattcaacctcagcatatatcatctggactcctgcttcaggtcaattaaatgtcaatatttgtaaataaaaaaatatatatatataaataaaggtgataagaaaaaattctgagaaaaatgattaagaaaacataaactttttgccattatagtatgatacaaacggaaggattcatttttatgctttgtctttctattgttgatggaaaaaccaaactaaaatatttgaagacattcattttgagccagtgaggaccatgaccccatgactcagcctccagagatcctaaggacatgtgcccaaggtggttgggttacaacttgatttcatatattttagggaaacaaaagggattgtggaagccaaggcaaggttctttttatgtaggtgtagtctccaggtagcaggcttcagaaataatagatggtagctgtctcccatcagactttaaaaggtgtcatactcttagttaaatatctcctctatcaggaaaatacatggaaaggaaaggggattttctacagaatataaattctccttgcaagagaaggctttgcagggcctttacaaaatatgccaaataaatatgtttgggataaaatgcttttgtttcctttagggcctgttatctgccatgtgatgttatactagagttaggttggagctggtatcttattgctacaaaggatctgttctgtcagtcttagaatctctattttaatgttaatactagtcagttttgtctaaactccaaaagggagagagcataataaaacatgtttgacactccattcccatcatggcctgagctagtttttcaggtttctttggaattcccttgggtaagaggggaatccagtgtcaattggggttcttgtattttatattttgtttacactattaaactgtattctaccacttatctttgactttggtctttgtcttagaaggcaaaaaagctgaatgcctgattcaacataattttttgcatccttgaatttctggctgattaaaattctcatgattaattcaggcatggtggcatgtgcctatagttccagatgttcgggaagctgaggtgagaggaccacttgggcccaggaatttgagtccaacctgggcaacttattgagatgctatttttgtttttaaaaaagtctcatgattgcaaagaatcacagttaaatctaataagctgagccctgtcagtaatattgtcaagcatatcaattgaattttgtgtcaatacctgaatattaactttcacaataggttgataagtacaaaattagaaagaataagaactaatatttgatagcacaacagggtgactattgccaataataacttaattgtacatttaaaaataactaaaagagtgtaattggatttttttgtaacagaaaagataaataattgttggatggatatcccattcttcatgatgtaattacttgatactgcatgcctgtataaaaacatctcatataccccatatatatgtcattttatagacaattttatagaaaactttaattttaataaaaattaaaaattaaaattaaaaaataaaaagatcatgagatatattggtacgcattttcttctgtttaaaatacttcatttagtcattttttaggatagggccactggtgacaaattctcttagtcatcatttatgtgagaagtcttgatttcccccttcattcctgaatgatacttttgttccatatagaattctgggttgactgttcttttctttcagcacttgaaacatgttttgcccctgctctccataactaccaatgagaaatatgctaccatcctaattgttgtttccataataataacgtattatttctttctggcaattttgtctacagttataagaattttacgtatgatattttggtgtggatttttggcgtttatcctatttgaactttgtttaactttttgagcctgtagattatgtcttttgctaaatttgggaagtgttcagctgctaaatcttttagtactctttcagcaccaccttctttctcctttctttttgagattttattgtcacaaatgttaggtattttgttatagtcccatgtttttgaggcttttttcattttttaccagtctactttctctgtttttcagattgggtaatttgtatttttctgtcttcaacttaactgattcccctattctctccattctgctgttgtgtctatccatcgagtttttttttccaaaaaaaatggtaatagcatatatttttagaatagactatattcttatagaagttttaggtttacagaaaaattgagtgaaaagtatagagatttctcacatatgccctacccccatgcatgccaagcctcctccagtatcaacagcttacaccagagtggtacattttttacaactgttgaacctacactgacatatcttttttacccaaagtcaataagttacatataggtgttacaataagttacattcttagtgttatacattttgtgtattttgacatatgcataatgacataagcctactctttcatataagaaatagtttcaccatcctagaatcttctgtagttcactacttcatcccttccttctccaacctccttcaaccgctgatctttttactgcctccacagttttgccttttctggaatgtcatatagttggagtcatacagtttgtagctgacatagtttggctgtgtcctcacccaactttaatctggaattgtaacccccatatgttgagggagagacatgtaatccccacatgccaagggagaaaggtgattggatcatggggttggtttctgccatgctgttcttatgatagtgagttagttttcaggagatctgatggttttataagcatctggcatttcccctgcttgcatgcactctctcttttgccaccatgtaatacgtgcctgcttccccttccgccatgattgtaagtttcctgaggcctctgcaaccatgaggaactatgagtcaattaaacctctttcctttatgatttacccaatcttgtgtatttctttataacagtgtgagaatggactaatacagtagctttttcagattgacttctcatagtaatatgcatttaagatttctctatttctttttatggtttgatagctcttttatctttagtgctgaataatattatattgcatgaatgtaccagagttcatttatccattcacctactgaagaacatcttggttactttcaagttttgacaagtatgaataaaactgcatcaaacatccaagtaaaagttattgtttggacataactttttaactgatttgggtgaatacctagagtatgattgatggattatatgctaaaattatatttagttttgtaagaaactaccaactgtcctacaaagtggaggcaccattttgaactctaccaaataataaatgagagtcattttcctccacattttcaccagcatttggcgttgtccatattttgggtttttgcaatcgtactttaatttgcatttctctgatgatatattatgtagaacatcttatcatatgcttatttgccataaacatatcttctctgatgaggtgtttgttaaggtctttagtgcattataaatgaggttgtggttttcttattattgagttttatgagttttttgtatatttagataacaagcctttatcagatatgtcttttgcaaatgttttctcccagtctgtggcttgtcttttcattctcttaatcttgactttcacagaggagaagttttttcaaattttaattacatctaacttattacatttcctttatgaatcatgaccttagtattgtatctaaatagcatcaaaccaagtcatttagatttcatcctatcttatcttctaggtggtttacattttttgtattttacatttaggtctatgatgtattttgacctttgtgaaggggtaaggtctatatctagattcatttattttgtatgtggatattctatttttccaacactgttcgtttaaaaggctggttgttgtatttttagttctaaaatttccagttggttcttctacaaagaaaaaacgtctgtctctttgctgagactttctatttttttgtttgtttcaaatgtatttatgaaggtcactttataattttatgatggctgctttaatatacttgttagatcattctaatatctatgttatcttagtgttggcacctgttgatcttcttttctcaatcactttgagatcttcctgactcttggtatgatgattgatttttaactgacaacttgatttttttaatattatgttagattactttggatattatttaatcttgtattttagcatgtatcttccaacatcactccagcaaaaataggaggccagtgtcatgttactgccatgttggtctcgaagtccaggatctctacttctccacatgaggactaacgatgttgtcttttcagtctgaaaagctggcacatttagagaaaagaaagcaagtgtattaaactcagtgatttgagtatcagaagtacaggaagcataatgagttccctgataaactccaatgacactcaaggggtaaggggtatcttgttactgttgggtggggttaggaatttaggattccagctagatcactgctaatacgaccttgtttgggaaagtctaaggctctaagcctggctcttcactgctccctgatggtctccactaacactaattgacggatacccttgttaccactaaacagcggtgaaagacctaactctccattatatcacctctggcatgaactcgtgaggagggagaggaatatcttgtaatcactaggtcagagtggaaatccaagctcctcatgtgctctccactgacactgctggtttacctcttcttttcacctttcagagtcttcttgtgttcatgctatttaatatatacaatgtccaggggattttgttgtacttggtgggaggaacagggaaaggtaaatttatcccatctcttcagaagctgaattttcccttactggatattatttacccaattttatctcactgtgaagatgctacacttgatctgtttacaattgatagtattttattcaactgggttttaaagtttgttcactgtcaagaatacggacactttacaaatgacaagcaaccctggccaaattctgctgtacggaaatataacaagaaatataagagttgatgaatggaaagaagaaccagttcaaattaaccaaaatagatgcacaagtaaaatcctttcactgggaaaggacattatgcagatctagggaatattatctaattgcttgtctgtgcatggccatgagaagtaacaattttatctcttcagtctgaaaagccaggatgtttcgagaaaagaaagcagggtgtgttaaactcagtgctttgagtatcagaaatacatgaaacataatgagttttttgatacatttcaaggtgacagtcaaatatttttgctgttaagtctcagggggaaaaaagcctactcaaaaaaatgacaacttttttatttacaccagaacagataaaaaaaaagtatggatacatacaggattagaaaacaaaggtagactaagacgtggttaattacagctgaaatatagttaggagttatttaatttgtattagtttttttagaaaaacattttcttatacaaactcatactttccaatgacctttttttggtaccaacactaaggtgttaaactctgctaatgaaatggtaaacacaaataaactttgtccttactctcgtggagtttgccatctaatggaagaaaagcatacttatcaaacaatcatgcctagatatgtaaattatattcatgtagttttggagcagttgtcaggtaagtcttctatgaagcagtcccaattgaaatgcattccaaaggactaaatggtgctaaacgtgccattagtaggaataaactattccaggtagaagaaacaacatataaattgccctgcagtctgagggggtgagttgccttaggaaaatctgaaagaaggaaaggagagccagaggaaaaatagtgaagaaaaacatggtgcaagatgaggttgaagaggtgaggcgggtcgaactattccatctatttgtacttgtatatttgagcctttatcaaatataagtcagaaactactgaatggatttaagcagtggtatattatttctccatatgaacatcaaaattttcaccttgaaattactggaaaaatggaagaattgataaaaggtaccattttatcagtagtttaattcattagtttaattttagggacaaaacaattaattgagttatgctcctatggaagctttttgccatatacatcaagggaaatcttagcttattgatccattaatctataacctgtggcataatttccactcagctctttgaggtacagccacagtgtcaaaaagcaaacaaaccatttctgaagtgctatcctcacaaactcagaacttcacagtgatgacaaatgtcacgagttttaataaaggtatgaaagatccaaatcaaatatcactgagagatgattaagagacacatgctgtattctgttatgtttgcatagaacatagggaaagaacttcttttaaatttttcctttagtttgttttccagaggatcttagatttaaggtagcaaacatgacaagaagaaaattacggccttagaaactgtcggactaaatagctcattctgaaaagaatggtggtttcttttagatatagttaaatgccaaagctataattttccatttacattctttcgtcattgtatatgtaagttatttatccaattttataccatttgctcttttttagaaaaagtcttcctgcagattcattttaacaataacttttttttcctaaaacacattgtaaaaactgttcctgtcactcttcttttgatatcagccatttcctcatatagaagtcagtcatcaaatgactgagggaaaggctgtgtaattcagctctaatggactgtattttaaactgctctagtttaaaatgccacagcccacatatcctaacatgtacacatttcaactagaaaagatcaaattctactgttattgttactggaatagctattgacagctttgtatttatatttttgggggaagatggaggtttaatttgaggaaagacagataaatcacaggtgagctggaggccatggatgaaagctactggatgttggatagctgggacagaagttgaggctgcacatatatttttttttttggtaccagctaagttttgatccaatctacttcaatttcatttaatacattttaaaaataaactaattatttaaagattgttatatgaccataacttgactataatactatattgaaagcagacttagtttaatatgtagtttattttgatttttccctcaaagggcttaattttcttactggaataacacatacctcttgagtaaacaaccaaaacactctctactgccattttatttcttttccaaaatgttgaataataagcctagtacattcctcagtacctttgcgttgtcatatgacactgaggctgacagtccttgcttgttagaaacatgaagtaccagggctgtggggccactggagcactttctaagactgttgacaaagggcccagtgcccacacattaatcacactgctgggctatgttaactcttttcactgtcataaatgcttagttccctctccactatttactgcttagaacccaccaaactgcaaatagcaggaaatttctgggaagagagagtacatgaattttgcatcctgaataggaagagacaaacatactcagaatgctttaaagactttactttatgttctgagctattcagcacatggctgagctcatttcttgctccccagatatctcagttccaaggaaaacttgataaaatttcagtctaatttgtatttgctatttcctaagatgagttagaattgcctctttatttttaagaaataaaatctctggaattatgaatgcatataaagggactatgggtagcataaacttcggaaaaaattaggatgcattctgtgatcaaaatagtttttgatatattctttatgaaaatatttactaagtgcttgtagccaagatgaaataactcagaactgtgtacattgccttaaaaatcaatcgtcactttactctaaaccccacagtggcaagtacagggtaggatttatgttggttctgagaaaaacaaaaaaaaactattcaataaatatgtattgataaattcaataatattaaaagtacctggctagcagtgttaacaaaaggcagagacatatgttctaagcagaagaaacatacttagcttttcaatggaagtgcagagaccacacagacagacagtggcaaaatttcaaggtatagtcatcatacggggggtggtggaggtggtggatgttgttttctgataaaatcagacatgacttactgacaagagcaattatagttatatatatatgtgtatatatatgtatatatgtatatatgtatatgtatatgtatgtatatacgtatgtatatgtatatatgtatgtatatgtatatgtatatatgtatatgtatatacgtatatatgtgtgtatatatatatgtataaggaatatatatatattccttagcttctcttggggagtgagttaaaaattgtatatgccctgggtcctcagtgtgtgttgggaggggcataatttgcatccttaactagcaccctaaatcttcctgatgcaggagtgccacagaagacctcctgaggaatatcatcctagattgtgggaagcaaaatttacagaaatctgagaaaacagactacacatggagtggaaaggaaatggacatataaggtcttaaaaaattaaacacttagaggaagcttgctggtgaatctgagagagaagaaaagggagtatcttcataaaatatgtatcagcagcaattctttaaaaaggtgtgtatcagaagacatcagtcaccctctctttcaaataatacacacaaacaaatgattctaaccaacctcacagcttcaaccttgctccaaactcccatcttctctcgtaagtaacagcaactccttctagctggtctccctgtgtattagtcaattctcacattggtataaagaaataccagagactgggtaatttatttttttaaaaaaggttttaattggctcagttccacaggctgtacaggaagcatgatgcggcatctgcttgtcttctgaggaggtctcaggaaactaacaaacatggtggaaggcaaagggggaataagcaattcacatggccagcgtaggaggaagagtgaagggggaggtgctacaggcttttaaacaaccagatctcattagaactctatgactgtacagtaacaagggggaatggtcctaaaccattcatgagaactccaccctcatgatccaataacctcccatcaggctccacctccaacactgaggattacaatttaacaggaaatttgggtagggacagagatccaaaccatatcaacctacatccacagtggacctgtacaatctattccccaaaacccaaaagacagggttaccctgttaaaacctgtcagatcatgtcactctgcagctcaagacctctttttattaatagtaaaaggcaagttccttaacatgatctatcacatcccagtaatccatgatcttcttcctttctgaccttatctcccactgctcagctcttgatggctcttctccagccacagtggtctccattttgatttctgaacacaccaaacatgctcctgccctagggacttaacactagatacttctgctttctgcctagaatgtttgccctaggagtctggatggttaaatccctctcagtcttcaagttcagtgatgtcttctcagaaagttctaatttaacagcttaattaaaatttcaacacctctacatacacacacacatacacacacaccaccttgagtatccttaccaatcttcaatccatttccatagcatttatcacatattaacataaatataataatttataaatttattatgcttgctgtgtatttttcttccatgcctagatccatgctatatgaaatcagtgatttttccatattttgttcactgatgcattcccaacatctgaaactgtccctgacacatggtaatcattcagtacatacgtgcaagaacaaataagtgagttagtgaaatgcctgaatacacacgccagattctaaccctagatagtcttaagaagggtatggacatgtatttcttcctctctcctctctctctctctctctctctctatgtccctctcctcctctcttctcctgcctcatgcactttcttgttgttcccttggtgagtttgatatgcactcttagtgaagaaccaatgaggcctccagatggaagagagttgatccttactatcaaataaagttaaatggtgaaaagctataaaaagactgatttgacctccaggaaagcattctaacaatttacagatattcaaaagtggagtcgcctactattgaaagcaatgactttcctattactataggtgtttgacaggaaggaaagcaagcactggcatgggtggattcaggttagagaaaaagatgaacaggggagcccacactgggaatacttaaaatgtagtatagctatacctagcacaggtaaagaaagtagcaggaaaaatgttttcttgtattgtgtttgatttaaacacactcatcatacacgtctttatcccagaacaattctagctgctttcattttcaattactgatgctttaaagtcagcatcactataaaaatatatataatgctgtcagtttatatctatttttaaaaactacttctactaccaatgaatatattcactatatgtaccaatgaatatactcattggcaatggaagtaatttgaaaatgttagcaataggaggtctttagttaagtgcttaacacgtggttcaataatataatgacactatataaccaattacttaaatgctaacaacaacagtcaatttatatattcatgttaagaacttatagaactatttcaataataatttactggcttttcatttaattttgggggtatatcatgtttggggattgcctttagagtccatcttatcagtttgtggccacactgttttggacaaaaccaacaatgatataaacaacaacaaacagtgtaatttggtaaactcggtcactttttaacctgatataacttaaaaattatatttatatttcaaaatataaaactccttctccctcaaaatgttgacagtatttcattattcaggacagtctaaagagaaattacaaacacaatcacaagttcaaaatatttaagaaatatataatattttaaataataaaaatatttaagaaatattttgaacactggcaaatatttatcattctatgatgataattccttggatagaaagcactcatttcctagtaaaatgttacatatgcctatggtcaccagttagtcattcaaatattttatcgtcacatacggtgcatgttggggagaggctatttatatatcgtaatgttgtgttaatcccccaaattttaacagtggaaatgtcctcttcatgtatttttatataacaagatttataaatagagattgtggtaagtgtggtagggagaataacgcctcatgcaaagatgttcatgtcctaatcttcagaacttgtcaatgtgttgggtagcttgctaaaggagaattaagcttgcagttaaaaattaaggttgttaataagccgaccttgagataaagagattatattggattatcaaggttggctgagtgtaatcataggtccttacaagtgaatgataaagacagaagggagagaatccgagagatggtagcataagatcctgaccaaatgttgccagctttaaagataaagcagaggagacatgaacaaggaatgagggcagcctctaaagcccagaaagccagttttcccttagagtattcagcagggatccagtcctgctgacatcttcactttaactcagtaagattcattttagattgcttacctttttaaattgtgagatgataaatttgcattgttttaaggcattacaattttgccaatttgttgcagcagcaataagaaactaatacagtcagcaagcatttttgtagtcataatcttcttgaaactgtttgaataatgattatgattttttctaatattaggtaccttcaatagcattgtatatactctgttattgtttactaaatttcttgaattagatctatatactagcatataagtgcttaaaagtgttttctaaggaaagttttttaactatgaaaaaaaatgtgatgcacatacatctcccagatttttatgttcattgtttagttgcctaatatgtaacttttaaaacaaaatagcatgtataatagttctgaatataagatgagaaatgatgtgcagtgactctctatgaactgaacatttctgattaagataaatgctacctagatctgaaattatgaaaaaacgcacactgggacaaaaccatccttttacttcagtaactagtgagtcatgagtatatcttgattaatagctgtcagacctctaaaagtttaatttgttattttctctaattactttatcaaacagtagtttgcataattattaaaaattcttataaaattaatattgaattctaccttttcttttgttaatttagactttaggatttacaatgataataactctgaacatgaaacaatttgttcatactttcttcattgactcagaatttaatgttaactaaaaagggttgtaaagagatgatggcgagatgttgacttctatcatgataagctctgttaacacattccccagtgacaccagtgaaaattattaaaaggcaaccttttaaagctgcttgaaatggtccttaggacaaacagcaaatgaagaaacatctaattttaaaattatataaaactcagtaaaaagagtaaactgtggtatttgaaacaagatccctccttctctcatctctcccacctcagtgagatgaaactccattccagactgttgcagccaagaacatagaactccattttcccacagtcctagttggaaggtttccttttcaggaaaaagaggatttcagtatttctcattcagcccagctgccttttgctgaacctaagtctttgggtgaagggagcactgtccctcattcctctcaacgctaatttgtagaacagggactctaccttggctgtatcacagtaagagtactggggccgtcagtactccttcctgtgactcatggtgcaacggttccatgacagggaaggcaagccttcctactttcttcataggctgctgccttcccaaaacaaatactcagcttctaggacaggggcattactcaaaaagaaccttaccattgtccccatctctagctctggagccctggattaaagatttttgcctacaaaagaggcagaatgtaaaacagatagcttgaaatctcttccaaaataactgatttaatttgcaacaaagcatagagaagtttcaacttaaaagcactcccaataacagtactccacgcctcagtatcacacctcggtacatacccaggtaacaaacctcaacatatacccccctgaatctaaaataaaagttgtaattatatgtgtgtatgtatatatacataaacacacacactatatatacatatacacatacacataaatatatgtgtgtatatatatacacacacatactgatatatgtatgtgtgtatatatgtgtatatatatgtatgtgtgtatatatacataattatatatacatacatatatttatctgtatatatatacacaaacacataaatatatgtatgtatatatatatacacacaaacacataaatatatgtatgtatgtgtgtatatatatatatacacacacacacataagagactgattgtgatgaaaatcaattgagaagaggtttaggggggtcatgtgaatacacagtttcaactgtagggtgtttagttttgcaggagagaacttggaattcagaccatgcagaagagctttaaatgtcaaacattgatcttagaaactataacttcaagggagccacaatctgattaagttagtttgtagagaagtttatgcctcagggtattattgaaaagaattgagcaactgacctgaaattagtggagtgtaacagctgggtatgatcagggaaatagtgaaagaaagccatagcagtacgtctgtcatcctagggtgactgtggacatatccaaagctgtgcctccctgatgagcaatagcagaagattaaatcctttcgtgggtgattgggcagatgggtgggaaatagacttcaccaaaataatctagccattcactaaacaaataaataagtaaataataagaagccctagatttgaaggcagtacccagagttgtaaaaatgtattgtcaaaacgtggaatttacagcaaaaaaataggaggcatgaaaataaacaggaaaatgtgacccaaacactgaaaaaacaaagtggacaacagaagcgacctgtgagaatgtccagatgccagatttaatggagtaagaagtcaaagtagacattacaaatatgttcacagaactaaaggaaagcataattaaatgagctttaaaaggaaggatggtaatgttgcaccaaatagagaatattaatagaaagataggaattattaaaaagaatcaggccagatatgatggctcacgcctataatcccagcactttgggaggccgaagcgggtggatcacctgaggtcaggagtttgagaccagcctgaccaacatggtgaaaccctgtctctactaaaaatacaaaaattaactgggcgtggtggcgggtgcctgtaatcccagctactctggaggctgaggcaggagaatcacttgaacctgagaggcagaggttgcagtgagccgagattgtgccatcgcactccagcctgggcaacaacagcaaaactccatcttacaaaaaaaaaaaaaaaatcaaatgatcaaatggaaattctaattttgaaaagcacaaaaacagaaggaaaaaataactagaagtggcagaagaaaaaactttaaaaatttgaagagagatttatagagattatacaagccaaaaaacaggaaaaaaatgaagaaaaatacccacagcctcaagaaatgtgggacatcattaagtgcaccaatatgcttataatggaagtaccagaaaaagagatgagaaagaagaaaaaatatttaaataaataatggctgaaaactacctaagtttattaacaacaacgtacacatacaaagtgctgaactaattccaagtagaataaatgcaacaagaccccagtacagacatatcatattaagaatacttaatgtcaaaaacaggagaaaatcttgaaagcagcaagagaaaaaaagtaccatgagagaactgtgataaaatcaacagctgaattctcatcagaaaacagtgaagactggaaagtagtgggataacaaattccaagtgctcaagggaaaaaaattgtcaaggaagagcttcatatccagttaaacattgagttaccatatattccagcaatttcactcctaggcatgtatcaaagagaaatgaaaacatgttcacacaacaacttgtacatgaatgtttgtagtatcatttgcaatctctgagaggcgtatacattctatacgtctaacaagtgatgacttgttaaaatatggtgtgcgcataaatggactattatgtggcaattaaaaataatgaagtactgacacatgctacgtcataaatgatcacggaaaatgttatgctaagtgaaagagaccagtcacaaaagatcacatattattattcaattcatgtgaaatagcaatacagtgaaatctatagagccagaaagtagatttttggttgcctcaggctgggggaggtagggtggctggaagagtataaggatgatagctatagggtactgggattttttgttttgttttttgttgttattgtttttaccaagtaagtagcatgttctaaaactagatgtggtgatgattggacatatctgtgaatatactaaagactattgagttacatacttttaatgaatggattgtatggcatttaaactacatatcaagtaagcaattttttttttttttgagatggagtctctctgtgtcccccaggttggagtgcagtggtgcgatctcggctcactgcaagctccgcctcccgggttcacgccattctcctgcctcagcctcccgagtagctgggactacaggcgcccgccaccacttctggctaatttttgtatttttagtagaaacggggtttcaccgtgttagccaagatggtctcgatctcctgacctcgtgatccgcccgtctcggcctcccaaagtgctgggattacaggcgtgagccaccgtgcctggccaagtaagctatttttaaaacgttttggaggtgtgtatgaaggatttctttggtcagaaaagtcagagaaagattttcaaataaagtgaaaattgagttcatttctgaaaaatagaaagccactatatatggtgggtgaaatagttacagagagtatacgaacgtatagggaaaaaggtatagaaggttatggaataatttagaagaaattatttgtacatagataaaattgtgcagagataggctctaaaataggagagaccatcgtgcatttgaggaattgaaagagagccctgtgattatgttatagaaaaaggcgacatattttatgtgatgaatgtggaagaagatgcagaggacatatgatgcaggaacctgaagatacttattaggaatactagtttttagccttagaacaatgggaggctaataaattgttttaaggaggagagtgtcataattgcatttgacttttaaaaacagtattaataaattattagcaaagcaatccttttcaatgaaaaaaaaactttaaagattacccacaacattgattcattttttctgattttttattataaaccatataaaagatatttgagataggacttaaaattatgtaattccaatttgacttaaaatcttagtgattaaatgcatatctatttgtattctccagagactaaattagaagaaagaaaatttaaaaggccaaaacccacaaagataaagagaatgaaaaaagaaacaagagtaaacagaaatctccacacaattttggaagttggaaagaagatgagaaatagtaacagattcacctgactggggaaaaaagtagaaagtgaaaccaatgcagtagaagccaaaagagagtaagaccaaaatctcaggtttcagagttaatgattttcactgatagcaggtcacatatgaggctaaagatagttgtaatagttaaaatctgcttaagaagaaatgggacttcacttcctgtgtcctcttgattcctagaaagcaagattttactttcctcactttgatataagatagaccatttattttctggtgagattgagtcagagaaaatcagtacttgggtatacttaaaaacggcaatgagctcatacataaaaactagtacatgaagtaaatatctatccagaatggtgacattcctagtgcctatctccaaaagaccccactcagctgtcccaaaccacacaggctgttttatactacctagccaaaatataggaggattccattttgcgacaattgatgggtctcaaggaaataacttatataaatactgccaatggaggaatcaaacaaacaaatgttggccaagaatgggcctcatcataggtaagtcaggaatggaaacaatgacattcaaataagtagtatttccaatatggtttttaaagtgtaactcaaaaacaagcatcatgaaaaagtggagataaccttaaacaaagaaattaagacaaaccaaaagaaaaacttttaaaaaacctgataaaatgaaaggggaagaaaaaaaaaacttaatttataattaataccattaaatgatagataattctattcattgtaaaaaatgttataaaaacaggaacactcatatgataagaaagaatacttgtaagtacatgtgtctatataaaatcttacattaaaaatataattttaaattttggaaaatatagttgaaagatctcagaagatggaaaggaaaaatacaataacaagatgagattagttatagaaaaatcaaatatacactaatgagaatatgaggtggggagggcagagaagaccaaagagaaaaatggatagtgtattaggctggggaagtctcacaatcatggtggaaggtcaaaggcatgtctcacatggcggcagacaagagaagagagcttgtgcagggaaattcccctttttaaaaccatcagatctcatgagactcattcactatcatgagaatggtgaagggaagacccccccccccataattcaatcacctcccaccaggttcctccaatgacacatgggaattgtgggagttacaattcaaaatgagatttgggtgggaacacagccaaaccatatcagatagaattggaagggaggaaagaggagaaaagaggggaggggaggggagatgagaagagaggacaagagaggaagggaatataattacttaaaaataatataagccaccaccccactcctggcaaatttccaacccattcaatgcacatgtacctcaccaaactgttatggctgctggcatgcacaagtgagcacagattactctgcaaccaccataaccaagttatttggatggcacctcccttcagattgttgtggctaacagaatggaaacacctcagcatctccagcacagtaggtttctaacctaaaggggccagagaacaaagccacaggcctggaatgaaattgttagagttagatcttacaacacaggagtgctgagctgagccttggccccctaaaatcttccagaaatgaagtcagtcaactgaatcctccttatatcacaatcaaaattccaagagcatgaaagaagcaaaaaatgaaaaacaaaacaattaagcatggctacaagatctagaaaatagcctcaaaaggttaaatctaagaattattggccataaagaggagatagagagagaaataggaatagaaaatttattcagaaggataataacagagaacttcccaaacctagagaaagatatcaatatccaagtacaagaaggttatagaacaccaagcagtttttcttctctgactaaaagatacaaaaattagctaggtgtggtggcgggtaccagtaatcccagctacttgggaggctgaggcaagagaattgcttgaacacgataggcggaggttgcagtgagccaagattatgcaactgcattccagcctgggcaacagagcaagaccccgtcaaaaaaaaaaaagtcaaaaaatatcagattctggcaaggttgtgaagtaaagggaacacttccattacactgatggtaatgtaaattagtacagtcattgtgaaaagagtgcagtgatttctcaaagaacttaaaacagaactaccattcgacacagcaatcccattattgggtatataccaaaggattaaaaattgttctatcaaaaagacacacgcacatgtatgtttatcacagcactatttacaatagccaagacatggaatcagcctaaatgcctatcagaggtagactggataaagaaaatgtggtacatatacaccatggaatactatgaatccacaaaagaagaatgagatcatgtcgtttgcagcaaagcagatagagctggtggccattatcctaagtgaactaatgcagaaacagaaaacgaaacactgcattttctcatttatcaatggcagctaaacactgagcacacctggacacaaagaagaaaaaaaaatggacatcagggcctatttgagggtggagtctggaaggacagtgaggatcaaaaaaccacctatcaggtgctgtgcttattacctgcgtgacaaaataatctgcacacccacccccctgttacatgagtttccccacataacaaacctgcacatgtacccctgaatgtaaaataaaagtttaagaaaagcaatataagaacatttttcagaattatatacatatgactttcaagagagaaagagcctggtgaatgccaagcaaaagaataaatcaaacaaaactccaactgtctcgaagtgtttatcttttggctcttttaggacttggttttcaggataaattcagcagcagcacataacacagcagtggctgagagttactctgtgtcctaccctagccccatttgtatggattcagtcaaccaggaaggggggttagtgaatgataatcattggtatcataaagaatgatattagtaaagaagatgtcagcaaaaaagatgttcttaaactacatgatgctttttttagtcagcagttccctactttagtgctcatacagtgtacttagttttggttctttgttatcctgctagactattactttcatgtatcccagtagtaccaaagcagctacaggacccactgacatgtgaagaggcaaaaagtaggtaattcctactatctttagctctgctgttagcataggcctcataactaactaatggatctgccagagtacctggataattatgctttactttattggaataaaaacctcctaaccaattgtttatcttcttcaagtggagatttatcagaaagcaaagtatattttttccaaaaagtttaacaagtaaatattgggttatgcagaattacatcatcccctgctcctatacagactccattttagacattctatgaatccctattttgagggagtaatcaaaattaatagaaaacaatagattagggatacatatagtttttaagatttcataataattaaacattttattgagacaatagggctgttgaaattttgcataatgttagtcaggtgctttggtctgaatgtttgtgttccctcaaaatgtatatgttgaaatcctgaccctaaggtgatggtattagaaggtgggacatttggaggtgattaggtaatgtagaaagtaaaatgtctcctcttcaaagttttccttcttcttaaataataaatcataagtgttagaaataatagtttcttttaaagactaactttcttcaagcctccttgctttgtgctaataactctttgttaagccctatcctatgtagctgttggacatgctcacaagtacgttgcagttcacagcctatgcgccttccttatttggaaatgttattgcttctttaaatcattcgtaagcaacttcctcttttcctttgttctcccttgtctttacctatttaagaaagttttaggttgttagcaaatcgggtatcagtttagacatgaggttcggctccagtcaatggatgcagaacacagcagtaaggacaacccaaatgcgtaagggataaatatgtctgcttttcctttgttaggtgtactctcatggcaagactactggcgagtgtaccctttctgcagaaagtaaaaattgccttgctgagagaattaaatttatgttcaagtgctatttctttctggtaccggggaacaagaattttgcatttctaacagtaatgaggacttcacccacatgtatgggattactgcccttataatagaaccctgagaggggttccctgccccttctaccatgtgcaggcacagtgagaagacactgtctgtgggccagaaaatggttcctcaccagtcattaaatctgtattaatcttggaatgcccaacttccagaactgtgaaaaataaatttctgctgtttataagcagcagtactcagttcatggcattgtgctgtctctcttttgctctggctcttgccattgctcttgctttctcactctgttttatctttttggtaccattcatacttatcaaagaattaccaccaagtgtttataataataataatgattttggggcaacaaagaggctcagagaaaagagtagttttgcagtcaattctcaggagcttgccatcattttcttacgactgtatttgtctataattagtattatagcagcactaacagactgagacataggtgttccaaatatttgagttttcatttgtaaagcccttttcctaatagaagagaatatgtctgcagcgtcaaggtttgctgcttagaattactcagccaaaaacaatgttttgtattcacagctatagggaatccttaccttattcaaggacagttgaagtggtgcactttattttcttgtcatcttgggtgtctacagaaaagttatttaagcgtattctggccaattacttaacaaatgtgttgctaaggtgttttgaccaggagttgaagacattaccataggcagaaggatgtttgaaatattgttttctttgttcagaaaaatgtaaaatgccagttcccaaaacaaaataaactaaactgaaagaaaattaaaccatcctgctcaggatgccacttgggggtgttttgagccagtgatcattgaatttgccattattttatgattccaacagggttaatcctgctgtgctgcagctatcaaaaaccacagaaaattctttatttctttattttataatcatagctcaccgacacctatgataagtagcaggaatatttatggcataattttgtgccgaggttgagttctctgtttctttttcctttttcatgcagtgactggcttgctagatttcttctgattattttaccaatcttataatttgtttggtttattagcaacaaatctctatttgaattgtgtaccccacaggctgaagtgcaatgcaatccaatacaaatacctataattcacttcagctgttaacagtattcattccctacctggccatgtttagagtcctttacaaccaacacaactcatctactctgtccactaccacagctcttctaaccttttctcccaactaccctatagccccaagggtagttgaaattctacatcctaattgagttgaagaccttttcccaacatgattctctaagatctcaagtcaatgaagtggcacatgagatattgttgaagaataaacagattctaggagaagagacgtttatatccataccaagaagatgagtaagcaatccatactagtgtggggatataacacagaaataaacataagttgtctctttgttttaaagttttctgttgaaacaatgacactggaattgttgggagtaccagcttactattctgttcactcatctacataatgaaaaactgtcaaacataggtgtttaaactgctttttgataattaaatagaatatttttgcctagtcagctttctttggagcagtacagaacacggctttagtcttgaaattactttttctggctgtttatgttaattcaggcattacatttccctattactattgtccaatcctagtttacacttgaatcatctctcatcccctcagacctgagaaacccattgttatatttcaagtgtgaatattttcacatgattaagattttggattggactttgaatggctctaccctttccccactatgaagggctatgaatcaatgacaagttgcctttgaacatagacattcacatgtcctaaaaacagaatgcaatttttgtgaaattcctgataaacgtgagttagaaagtccaaactacttgacctgaaagtacgtgctgtggccttggtgatccagctaattagagggtccctcattctaaagcacaatctaagagcacaacctccacattccttttaaatgactcaagcattgaacactgcagtgtgggtgagacactgctgtactttagtagatatcagtaccaaagagacatttgacattctcctcccatcctccaccaatcatgagtagataatttggttgtttccatattgaagcagaaaacacattgacacctgcaaaccaggagtagaaaatttcactcagtcactgagggggagacttctttcctgcacttatacccaagtcatggccatggaaatgaatcaggaaaaccatacacagagagaccaaaattctagataggccaatactcattcagaatgttctctggacttcataattcacagttgtttgctatcaatccggagatgtggcttaactgaaaccctgtcagatataagaacaggaagttttaacatttgtgaatcaaactaagtcagtaacttaaaatggccacaaaaattgataggttaaaatgtctaaaaatagatttatacctagagtagctcataagggatttctctttaatttagttagtagcactgaagttcttgcttatatacaaaagccagacaccatcattatcacttccccactcgttaacaagttccctttaaccataatgcctgtacttgtgatatttcccagtgatttctgattaaagccgcctgacacctgtgtgcttgctttgaggtttgactattgagtatctttagaactgtgaggcatttgttcttagcctggctggtggtccacttataatgcatagcaacgttccttctgcaaattgggaatataaagagggagatgatttttagaacctgagagaagtgtctttcatgaaaagaaaagctggttgcatgcctccctgaagtcctgtggcagttaacgctggccctgagcctcctggagtgaatttatagcatgtaatcaagtgtgatttgttttgattacctcagaactaatgaaggagtacctcccacacaaggcctccatctaattagaagtatctggtaagaaggtatttgcatattttcaagtcatattatgtcatgaggacgtttgagttgatgaaaactgacatttactataagataaaaaggcaatgcattgaaatcaggagtcatgagagactcacagctgtggatttggatgcctgttttaattgatgagacacagaggctctgcctcatgaacaaatcagaaaatgaagcatgaagaatgtaaagatgcagaggtcagaatatcacggctggaggcagagctgcagacactatgattggtgcatccaggtcccctgattgcagtttctagcttttttcctctcttgcactgggattatcagaatttaggtgaaaatcttccatctctctcttgctctggctgttgctattgctcttgctttctcactctgctttagctttttggtgccattcatacttaccaaagaattactaccaagtgcttataataatagtaataatgattttggggcaacaaagaggctcagtgaaaggagcagttttgcagtcaattctcaggagcatgccatcattttcttatgaccgtatttgtctttaaaattacagtaataactgctgcttactgtatgtctagcattgtcctacattcatcacatgaattaattcatttatattttaaaaattcactaaagtaggtgcttttattatgctcatactaatatttaggaattggggcctaggagtgctggagtaatttgttcaagatcacccagcttttaagctaagttcagaatttgaacctagctgacctgactccagattctgagctctaaccacctgaacttctgctgtttttttcctcaagggaggagtgttcacacacacacacacaccacacacacacacacacacacgactgggtcaaagtttggcaggtagtgacccagcccagttaatcagatccctctccacaactcttgatacatctagtagggaaaaggggctttttcgtgtccagaattgctagctgtaagaacactatgtgtttagagcagcatctttgtttccacatgggaaaactggtctaggaataaatgcaagaaagagaagagcaaagctgagatatggagaacagagaaatgagtcttaatgatataattcaagccccccaatcagaaaggaattcagccatatctgaagacagcaagcaccactgttttcatgcaatgctcacatccatctctttggtttaactggtctaggagaattttctgccgtggatcctgaaaaacaggctgtgagagtgaaaagatgaacaaggcgtgttgtatatacccaaatatcacatatattgtgctttggagcgaagaatggagttagatgatagcctgcactagggcatcttcagaaagggaaatactccatgtttttctcctaagatgtaaacgaaagagttcacatttgcattatagaaagcattttaaaaatatcttcaaaaaacactgacactcagtccctcccttgtcctgaggacatctgaggaatcaagcaagtagtataaaaagtagtctttttatatatttcttcacagttatttttatatatttatttactgttgatgaactggattggttctctgcattttgttgttgaaacaacctcttgcttgcattattatttccattttgtagatgaaaataatgagccgcaagaaggttcatgttttatccaaggccatagaagtaataaggggctgagcttacatttgaaaccaagttttctgattctatatatgatgttgatacctgaagataattctttcttccattcttactagtgcctcattttccagcaataatttttacattcagaatacattcaaatcatccatttttttacaaacagatttactgagatataattcacacgccatgtacttcattcatttaaagtgttaactcaataatatttaatgaactcacaaacaggcacagccattagtacaattttagaacatgttcgtcacttcaaaaaccgactttttagtaatcactcccactttctcctgctactgccactccacactcttcagccttaaggaaccactaatctacttcagttttctatatactttcctattctgggctttcctacgaatgcacttatataatatgtagtagtttttcgtgactggcattttacacttagtataacgttttcaacatttatccatgttgtatcatgtctctatacttcatttttgtgatttaacaatattcaattttatgtctataccacattttatttatccattgattagatgatgaacctttgggctgttttcacctcttggctattatgaatagtgttgctataaacatttctgtacacacttttgtatggatatatatttattttttatttctcttgggtacatgcctagcaacagaattgctgggtcctacggtaacttaatgtttaattgtttgaggaactgccatactgttttccaaagtgtctgcaccattctattttcttaccagcagtggataagtgttctggtttctttacatcttctccaatacttgatgtctgacttttggtttcagtcatccttgtggttgtgaggtggtatgtcattatagtttgcatttgcatctctttgatgaataattatgctgaacatattttcatgtgcttattggcctactggtgtgtcttctttggagaaatatctgtggagatttttctcaaaagaaaaatctcatttgggccattgtgttattagtctattcagtactcagtactgtgttctaagaattatttatatcttctaggtataatatgtgataatctatgtataataacatcagatatatgatatacacattttttcccattttgtgggttactttttcactttcttgatggtgtcctttgaagcatgaatgttttaatttttataagaaaatttttctatttctttttttcttttattgctgatgcttttggtgttgtatctaagaattctttgccacataaaaggttacaaagttttttctaagagttttataatttgatctctcagacttagatattagaacaatttgagttaatgttttttatataatatgaagtaagggttcaacttcatttttacttgtggatatctgcttgccccagcaccatttgcttaaagactcttcttttactcattaaatggtcttggcatccttgttgaaaatcagttgaccacagatgtataagtttatttctgaagctcccattctactgcattcatctatatgtttttccttgtgccagtaccacattgtcttgattaccactgctttgtagtatgttttgaaattgaggagagtgattactcttactttattcttatttttcggaattattttggctcttttgtgtttcttgcaattccatattaattttaaagtcagcttgtcaatttctgcaaagatgtcatctgagattttgttagggatatatatttataattgttatatcttcctgaggaattgatatgtttgtttttataaatgtctttcattacttctaataataattttttattttaaagtttgttttgccttacattagtatagccactcctgcattcatgtggttactatttgtatgctatatcttttccgtacctccatccctttattttattttattttattttattgtatttttatttatttttttatttttttttggagacggagtctcgctctgtcgcccaggctggagtgcagtggcgtgatctcggctcactgcaagctccgcctcctgggttcacgccattctcctgcctcagcctcccgagtagctgggactacaggtgcccgccaccacatctggctaatttttttttttttttttttgtatttttagtagagacggggtttcactgtgttagccaggatggtctcgatctcctgacctcgtgatctgcccgtctcagcctcccaaagtgctgggattacaggtgtgagccaccatgcctggcctatttttaaaatatttgtgtcttttgaatctaaagtatgactcctatagacaacatatagtcacctcatgtttttaaaatttagacagataatttctgcctttttatttgattgtttaattcatttacatttaatgttattgctgacctagttagatttatgcttgccattttattgtttttaattttctatatgtctcatatctttttattcctgcattcctcctttactgctttctttcacattaagtaaatattttccaattatcatattttttatttgataattctttttgctatgtttttaatgtttctttttttttttatggttcctctagggtttaccatgtacagtcagccctccatatatgtgggccccacatccatggatttaaccaactccaggttaaaaatattaaataataaataaaaattaacaatacaacaataaaaataaaacaaaaaataccatataacaactatctacttaatatctacattatattaggcataataaataatttagagataatttaaagtaatgactaggagggccaattatctaacactggatgaggacagtgaagctatgtctgcatttggatgccctagaagcagacctgagacaggactgaagtacagtagttacaactaaacacaagagccaggagcaagacaaaaaaagggaaaccacgggtagaaggtaaactatcaggcaagtccccactgtggattgattactggagcttaatcccgatcccaccgggaaactctgggtgtcagtgtagtacatgcacctcagagttctctcttctcatgggcaaaggaataagactatttagacaccagtttccatcagtcattgattgaatgctgccttccaggacattaatcctctggctctcacagctgccctgtgtgggcagggtggattttggttgtcgagaaacgtccctaggcagttggaagtcccagagcttgcattgcagtggtaaggcaccaggggatggagacgtggatggagacgtggatggagcatcaaaaggatctgctacaagcaaccaggacagatttcagcagaagagtccatgtgttagtggttggtatttcagagggcctgggagtggacagatcaacagctgttctcacaaaagcagcatagagagtcaaggcctgaggaccttggtgaggacaacttataatgggaggatgaagagccatgccagtgtcaatgaaaagagtcaaattctgtaaaatatttgaagagatttattctgagccaaatatgagtgaccatggcccgtgacacaaccctcaggaggtcctgagaagatgtgcccgaggtggttggggtgcagttaggttttttgcattttagggaggaatgagacatcaatcaaatatattaaagaaatgcattggtttggtccagaaagatggggcagctcaaagtggggggttttccaggctataggtaaatgtaaacgttttctgactgacaattggttgagtttgtctgaagacctgggatcaatagaaaggaaatgttcaggttaagataaaagattgtggagaccaaggttctttggaagtcttacagtgactgcctttagagacaatagatgacaaattttcctattcagatctttaaaaggtgtaagacttgtatttaatctctttaagattgagagggcctggaagaaaaagacctagctatgttaatagagattctttacagatgtaaattttctccctttgcatggacatttcaagatatggcgaagaaacatgtttggaggtaaaacattctgattttcttccttgtctaatagtgttatgccggagtcaggttggaaagtaagtcatgatatatagggttaaaaaaaaaaaacccatctgatgagaatctatggtttgtaaagcatgactccccagatcccttagataggaatttggacaagataaaaagaaaaaaatcagagcttagtcttcaacagcctctgtctttgtggttgagattctgtacccagagttggaaatgtctctatcttttcttcctaccacaggtggttgttggatataaaaggcattttgggaatgtttcttctttcagctcttgggctaatcttgttgtcataacagaccatatgctcagtatttaaaattaggtgtgatttacagagaactgtgttgcaacaagagaggaagggagtgcacagaagccagtggctgagtgatcacagtgcaccaaattttcaacatatccaaatcatagtaaattattctaaaaccaaagacctcatccaagaattgccttgtgttcagcagcaaagtgtaagaatcatgtcctcaggtgcagagggaatacctcagatagactcagcagggcagtgatacattggcaggtaaaagggctgctgatagcctgctttcaaaaagtgtgaccatcttcattcattaacaccttaactgtattcccttccattgagacttttactttttctcatagctcctgagagatagcacaggctttcagggaggggctggtttcttcagcaaagtttctttggcagcctggcagtgcctctcctggacaactgccatggctgcctctcagggatgtctgtggcttaggaatccagagagagggagaatagttgtagacattcaaatagtcatggagtccaagactggacagtgaacaaaatatcctaggagatgggaatggggttcatggggctcagaaattgatgggggttccagagcttgttatcaagaatgttattagaagtacttcacaacaaatacggtgcaaacactgaccaataggcagagcttgattcagggtcccagctgtgtgagacactaactctgtggttactaggtcctggagaagggacaagggtaacaggggcagtggagggctcctgtagagcatgtaggtatcccagagcagcctcagtttattaactagtctggtacaggccagagtgaatgagcatccctgcatcaggagttccccttggtgccacagactccaggtcaccagcaacttagatggcatctttgtgtgaattaaagaaagcattctctgttgtcagactgggtgagtaggtggctggcttcattgtgaaaaggaaaggctctcaggaggaagagtttataagaaataaaagattctctggggaaacgaatgagaaaaagacagctcctcagaatgaaaatgtactgtctttaggagaatgaactaaaaaagcccccaccccactctataaaaaatgtttcccccttgtgagaagagaactcagacagaagtgccccaccctgcagacacagcaaggggtgttgatgttggagagggggatatgggctggattttagcaaccccacacctccatgactgggcactttttgcaatgaacaaacctcattgtgtatggtggccttgctgaaccctgactatatgtctcaaggttaccccactctgtcccctaaacttagttcctcttctttcttcatgagcaccatgcccccaccccaaataaataaattaaaagtttagagtttacacctatacacattgatgtagcatatctttttcaatttattttaagctggacacatttaacatagcacagtgatgtagtgagaaactcaactggcgatgtagatggctctgtggtaaacaagataattctttccaatgtcaggtccacaaccttgaatccagggcagcccctctgctcccagagcagaaggagaagcagccaggattggtgtgtgttcttgcaagccattcctctaacatcctgcaggttggcctgcagggatcacttccaagggtaagaggatcattcagtgttcacaggtcattgatttcctggccataggaatagaaactgtcaatatggtgccaattgttgcaaaggttgttttgtgaaccattctttttgctgctgaaactcaatttgtcaaggctgccagacagtccatgatgacatttagtcactatgatctgggctggatttgggtcattgacttggttcctgctttagtcatctagtattctggagtgtaaccattttgcatatttatacaagcatatatatcttagacaactacaatgtctgaagatttaggacctctgctttcatagttttcagtgatatatattagcagagaaacacaagacaggctctgagcaggatggcaggagaattggttttccactatcttggtagtgtctggcaggtcacctcacaccctggaaagcagaccaggctctcagatgaaatgtttaatgacgctgtgactataaatcatggcatcttgaaggcacacttgtaattctcctagggcattatagagtggcactccaattcttgttgactcaggaagcgattgcattgcctgtatcaaatccacctcaggctgcccccaaatagtatagaggcaggaatgctgagtcaggcacagcagtgcattaggtttctgcccagttactccactgcactaatgttgggggccctcttatttgccctgtaattgtcccctgtcaaactggacccctgcaatgatgtctgagggctgctcctctacattgtcacatcctttcccaggttacaccatagccctgatgctctgcacttctgtttgcctcttccttggcttctgtgcagttactcgactgcagtggttgtgcaggttctacctcctcaggccttttacctcccctgtgcagttacgtcattgaattcatgagtcaagtctcatcttctttgccctggttacatgattacaatgatagtatggatatgttcatctctgctctgttttcctcctctggcctagcacagcatacattgacagtgtgaagacctgtttactcctttcaccctctctattcacttacacaatggcctagatgatgtaggttttcccatcctcacagcttcgatttccctttccatttaatgagtcccctgatagggttgggattctcctcttcactctgttcagattctgaacccagtaatacaatagcattgaagagatggggactccctcctgccctttcacccctctcacatgccctgtctgtgcacaccacagtattaatggtgggaggatcctcccttgctcattcagatccactttgcatttacaccatgacaccaatgctgctttccttgatcttgtttacgttgccaacccaagtacaaaccagctacaacactgtgctggtgctttgggcatgctgcttcttgttctgtccaccttgccatataatcacggtgctgatggtgcagggtacctcctctttgccccatctacataatgctgcttagatacagcactgaactgagagtttgggacttcttttctgcctcattcttatgtcctgtccagttatacctcagtactagtgctgtaaagattctcctgttctctttgttcacatcctgtatagagtttcaccactgaacttttgagggaggactttttgcccttttcacatcccacatccagttccatctatgcaatgattagaattttagaatgccaaggaaggccaacagccattgcaaactggaagaagccaggactgtttttttcttctggagcctctagggagagtattagcctagaaatacctaccttgatttcagacttgtagcctctagacatgtgacagagtaaagttttcttgttttcaggcaccacatttgtgataatttgttatagcacctacaggaaacaaatacagccccaagattccaggctatatttcttgaaacctgcgaatattatgagatgtcactcctatgcttgtgttatgttatgtggcataggtcccctttaaaaaagaaatgatctaggttggcctaatgtaattacatgagcctttaaaagcagaggattttcttcagctggtggcaaaagagaaggcaggagaaaaattcagagagagttgaagcatgaagataattcaacaaaccattcttagccttgtaaatggtatgggtcaagagccatgtaatgcaatgggcttctagaatctgagaatgactccctagctgatatccaaacagcaaaagggtacttcagtgctacaaccaaacagaacttaatttctccaacaatctgaatgaggttgaaaagcagattctccctcagactctccagataagatcccaacccagcttgggattttgatttttgacttataagaccctaagcaaataagccatttgagcctcttcagacttctcatctacagaaatataatacattaaaaataaataaatttaagctgctaaatttgtggtaatttgttatacccacagtacaaagtaattcatcccctctctatgtagtcttctcctatgtagagattttacaattatttctacctggtccacaggcttctagaagccccttcccctactgcctcctccagaactatattggacatggtcatctctggtttccattcctgctatgatcttgggggtattgtaaatcctatctctgtcaactggaaactttatgcagttcatcagcgtgggattttgttggacaaacaatgactccacaagaatgtttcagtcttctttcaaaagtggagaaaacacctctcagccttagaattcacgcatggaatgtgaaaagtgctcccattcccccaaatacaaagaggacttacctgatttacctcatagaaactgaaaaaaaactaaaaaggcagtaaaactgttttactcttctctttatgatccttgatgatttttatcttgttacttttagactggctatacaacttcttttttctatttttacgatttatcaagtactatctccttggaatagagacatatgtcaaaattcagctcactgcatcatattgatgagaaattaagcactgttttatgaaggatatgatacactcatgcagatcctcatgtccaaggtcataatatgggatttggtttctgaaaacaaaacacagaattctggcttgaaaccaggcttcactaaggctatatataatcacatacaatacataacatataaaatttcagaaacactcagatcacacacagacacacacatacacacatcttttgaaataactgcaataataaaaggaattagaatggaatggtcataatctatgaatacctcatggcacccaaggcaaatatagtaaactagtaaaaccagtaaaaatcctggaaaaacaatggtaactttctatgggtattgttagttggtgccccacattagtccattttcagactgctataaagatattacctgagactggataatttatcaacaaaataggtttaattgactcatagttctgcatgtctggggaggccttaagaaacttacaatcatggtggaaagcaaaggggaagcaggcaccttcttcacaaggcggcaggagagagagagcatgcaggggaaactgccacttttaataccatcagatcccatgacagctccctcactataatgagaacagcatgggggaaattgcccccatgacacaatcacctcctaccaggtacctccctcagacacagggggattacaattccagatgagattggggtggagacacagagccaagccatatcatgccttataaaaatatctttagaataaagagaaataaaatacagttgaatcatgaacaaatcagagataggggtgccgaccccctgtgctgtaaaaaaaatctcagtatgacttttgactccccaaaattttagctgcttatagcctactgttgaccagatgccttatcaataacatgaggtcaacaggtgttttgtgtgtgatatgattatatactgcattcttaaagtaagctagagaaaagaaaatgttattaaggaaatcataaggaagagaaaatgtatttactattcattaagtggaagtggatcatcacaaaagtcttcatccccattgtctttacgttgaatagactgagggggaggaagagaaggggtggatcttgctgtctcaggagtggcagaggcataaaaaaatctgtgtgtaagtggactcacacagttcaaatctgtatggttcaaaggtcaactttattttcaaaagagagaaattcatttatattttagacattatcaattcattttccaagacacattgataacaatattcattaccataaaaaaattttcattaactatatgtccctgagttttctgtgtttaaaaacataataatgataactaagaggctctgtactctaagaaataagaggaaacaagaacatggcacaaaatcaagtggagttgatagtttcttcacatatagatggagttaaaaaacttttacaatttgtttaatgtcatatttcaagttatatttctatatttaattgtttaatggtcaaatagtagatattaaagagatggtagggaaggaaaagggtcaggggaagaatatgcagagatcagggagactgaggacctagggggactgaatgaattattgaccagagtgtatgaaacactttggctccctagtgactaagtgtcatggctgttgagactcatgcttaaactatttgagatttatacaaatgtccatgatgagaaataattataattttactaaagtaggaatatgaatactgagtacagcagaacaggagctagacacacataaggagcccagaattctgccacatagttatatcttaagagaatgtttcttttgtcctgtactcagcattatttactgaataactcctaattactccttgttactaagatatatacaagtttagagatttgtagacattttacatctcggacagtatctctaggtaatgttaaaattataatgtactttattttttgcccttcatgtgaaaatgcacacattttcagttatctgcttggcgtatcctcctacgtatggcatgaaaccttcaaattatcctctccaaacttgatcctatgcctatttctatttcttaatctcagaggcaaggctgaaactttccctttttttcatgtatcaaattcaatcgagtcaataatgtcctgccaattcaaccagccaaggcatttctacagggtgtatcatattgttatcctgctacaatcctagctgagcattacctataccatcttttataccaacccttcccctttacatggagctggctcactcacactatatgtcaaagatgtgtaaaactccaacattaggagagtgggatttctgaaatgcctgagtgaagaactcagaaaatacccccccagaaataaatataatattaaaccaatttgtaaaaaccaccatataaagaaattggaaatggataaagacacattaaaaattgagaagcaattatgaaaacttattaaaccttggtggctgggcacagtggctcacgcctgtaatcccagcattttgggaggctgaggtgggtggatcatttgaggtcaggtgtttgagactagcctgaccaacatggtgaaatcctgtctttactaaaaatacaaaaaaattagccaaaagtggtggtgcatgaccgtagtcccagctactcgggaggctgaggcaggagaatcgcttgaactcgggaggcagaggttgcagtgagtcaagatcatgccactgcactccagcctgggcatcagagtgagactctgtctgaaaaaaaaaaaaaaagtattaattctcggtaaggacaatgaaaatttgtggtattttagccaggggctgtttgcatcttacccacttcctccatcccatactgccatctatgcccatccactgaagagaaagggatccaatttccctgaaattaaggtatctctgcatgctgtaatgctgcctgaataacttggggttctattttttacctactacctgaatattttgagattcatttgacaggtaataagggtaaggataagccataaataatatgcataacatgtgtaggtatatataatgtttattggacatctactataggcagatcaacaaatgtatctcaatggaaagaatattacataaacattgatatcttctgaaaatacacatacttaaaggtgttttaatttttttaaatttgattttgctcatttagatgccttgctttttttagcgactttagagttcattaaaattatttaaaagcattatgtgtgtttttgaaaaatatgtaaattgactcttagattcgactatttatttatttgttcattcataaatatttattggatacctactgtgtgctacataccattctaggcagtgggagatacatcagtgaggaaaacagacaaatattcctatttctattaatcaaatggagaagatagataacaaataagagaaagatatgtatgttagaggattatataagcttaaattagaattgtgtatttgaaaatacagtatattaatagcaaatttgagctatagtaaggccaacagatcggcaggtgcttatcactgaaaaagatagtttatcccttacagttcccaaaagaaagaggcatgaaatactatgggtgtggggagggagaaataacagggtcagtcaagaggcagaggagagagagaaagaagcatgtgcaagagtctttattgtggctactgcaagaagaaacgggcaaaacacagtaagcagatttaggattggttagtttgaataatttaataagttaggtgttgtaggtgctgtccctacatgtctggtagcggtccctggggtgagtagagaagataagtagcccagagtgtaatagcctgaaaaggtcggtggtaggattgtgggttctggatcacttggcttgtatttgaaaagtgtcctcataggtgagttgtgtactatttctaggaattggcaaaccctgggaggaacagtctttccagggtcagcaaggttccatatatcaaagcatcagaatagagaaaattttaagaaacatggttaatacagtaggaaaaactaggacttctaaggctgatcaggatgcatcttatatgtgagatgatagatatattaatttgccttactatagtaatcattgtactatctatatgtatcccataacatcatgttgtaaacctcaaatatatacaataaaatttatttgaaaaataaaatgaatgaaagaataaataaataaggagcagaatccatgctggcccacaaatgcaaaggcgtgtactggggccatggattctgtacccatgttcctctcagccaggtgctctgttgcaaagcaccaccttcacactgaaaggcagcacctctgccaagaagacagtaaatttagccacacaatacatagaagaaaagcatttcagacagaaggaacagctagtgccaaatcttgacgcaagagcttatctgagttgtttgaagaagacattatagcttgaccaatgagaacagaaaggatgttagtggaaaattgggaaacaaggttagagagggaccagattatatagggccttgttaaacattttaaatgtttgagcttttactctcagagaaatgtggagccattaataggttttatgcaaataaataacatgatccaaaggactttcaatatgatcattctggctgctatgttgtgaccagacagctgaggagcaagagtggaaacaaggagaacagcaggaagtctcctacagtaatgtgagcgagaaacaacagtgatgaaaaatgaagcaattgtgatagaagtaataatttatctgattttggatatatttcataagtagaagaaacagaattttctaaatagattgaaaatggaaataatagaatgagagacattagggataacctcaagtaatgtggtcgaagaaactggaaggatggaattggcattaattaagatgatgaaaaagcaggtttataggtggacactaagaattcagtttcagatatgttacattaaaaatgtctattagctatccaaacagggaatcatcaaataggcaattaacattgagagtctgcaggaaagagaaattgcccatattggagctacgattaaggattcattataatgctgatggtattcagaactcatgttgaaattacatcagcaaagggatgaatgaagtgatgagaaggctctggactgatcccaagggtacttcaatgttaaaaaaaaaagttcagagagaggaagataaaacaacatacacaaaaaaatgaagaaagtatttacacaaaaggcaaataatcagctattttaaaggtgctgatatttcaagtaagatacggattaataatttgccataggatttagtaatatggtgagcagtagcgactggtggggttgttttgatattttagtttattgactggttcctttatgtagaccagaaaaatcatgaatgaatggtgatgtgataaatgtacttagggggtactttgctgaaactactcattttggaagttgggtgtgttttcagaaaatctaggcattctttaatgtactctgaaggttataatatattcagtagtctcataagtaatctgcattttatatctcatatgttaaatataattcattaaaataaactcaaccataacaagctaagcattatattattagaagattcataaaatagctgtttgatttttttgaactatttcctaccttttgcttttatcatgacaaaacttgtcaaaacccaagtccatcaacagctgaatgaacacgctaaatgtgtacatatgtacaatggatattattcagtcataaaaataaatgaatttctgaaacatgctacaggatggctgagccttcaaaacattaggcttagtaaaataatctatacacaaaaggatatcatatgattccacctatatgaaatatccagaataggcaacttcaacgagacagaaagtagactaaagtttaccaggggctggtgagaggagtggggagttattgctgaatgaacagagtttgttttggatgatgaaaaggttttggaagcagatggtggtggtggttgcacaaggtggtgcatgtacataaagccactgaattatatacttaaaaatatctattgaagtccataagtgcattagtagtttaaaaacaagtggcctaaaacccatttaataggtgatcaattttgagaatcaattaattttcctgtatgaaaaactcctgcttagaaaaatagccctcaaaatctttacagcattacttcccaggacctgagctaaaaatgtaaatcagcttcctaaagctggcccggatttttcccatgacctttcagtttgtcttccatcttcaagtgcacagtatcatcataggaatcacctcagcatttgaagcccatgcattcattctttatagaaaatgattcagtaaaggaatgtgatgtattctggtaactacctacctggtgatattcacaccaccacccaacctttttttcttcttaaaaaaatagatcctggctattgtggaaaaacagttctttttttaatagcctaaaggaaataacagtagaagtgtcaatccataataaattatgttattaaaagtattaaaaagtgatttcctgtttgcgtaaaataccattctgtttctcttaatttataactttcaacattgaagttatttatgtagatacaccacagtctaacagtacattactcttactgcaggtatcattaatcatgtaatgagacaagttggagttcaacctgtagaacaatttagcctcaaggctgaggacccagtcagtcttccatttgatgtaaatagaaagtctctatagaccacagagtaaatgccagtttgaatggttccataatgtaatatattttcccttaagaaaacccttccttcataaaaagaaaatcaacttttaaaattcaataatgctctcttttaccaacttagtttttctcagacatatttatgggtttcacttcaaattattactccagaatcactgccatgatcaaacaagcactagtataaaaacaaatacttcagggatttgtttcatcatgaataatatcatcagtgataatgggcataacaactttatgagccattgtatggtcttacaatttggaaattaaatgacaagcaaatgcgcctttcttgggacttagtttatttgatgcatataattacattttcaggcaaattgtcctgttcactatatgaaggttggatatggtgtatgtaattttcataactggatattggaaataattcacttggggttaattatacagaaaactgaacatgtaatttttatttgaggcaataaagatatctaatctaaatattttttcaagatattatagaccatgtcataggccaagaaatattttattagtataatgagcagtaatcataatggaaagggtttggaatcttgatcctttcatagataaactatgagaattaaggcagcatcttccataaacaactcctgctagtctctgtgtgtttcaggaatggagtgtaccactcagtgggggaaaatctaactttaagttagtgaaaactaacagggcatgtagatgcatgtgagagtgagcataatcaagtcttttattcttctacttctaatcagaaaaaaagttcaaattccattatgacataattgttctaataatattgatctctttcccaagtacaaggctgaattagataatattgcttgcaattctggcacataatccaaaaggccatttatagtttcagagtggattaactaagagtcatgcaacatttgagtgccctgagttgtgctttctgacatccacagatccattaaaacaccctgttgccctatgaccactcaccaatgacctgtccactaagaaccaacgaaattaaatccaagcttgctctcatccaagacaaccccacttctccattttcatgagagtattggaaactgaaatgaaacacagggtcttctcatttattctgtgaagagaaggagcaggagcagtgcttttcagaattagaatcagtgtgaatgcaatttggcttggttgtttaaaatagtactttggagggagtggtcaagatggccaactagaagcagctagtgtgcatggctttcagaaagacaaatgggaggcgcgagtaaatacaacaccttcacttgaaacatacaggtactcacactgggactaattaaggaaacaattgacccatggagaacaaataaagcaaaacaggacaatggcccacttgggagaaacatggaaccaggagaacttccctcacccagggaagtgatgagtgaatgtgcgatccccggaaaccactcttgtcccatggatctttgctaccctcagtccaggagatctccttttgaacctagtctaccagggctttcagtctgacagacagagatatatggagtctcagtagagcagccactcaggaatgcatggagaccctgaagccttagatgcttgggctttcccgtaaaagtagctacagctctggcaaagtgggaggttaaacccccatacatacccctaggaaagaagctgaatgcagggggctaagcagcaacaacctttaagccccacttccgaaacacctcacaagataagacccactggcttggaattccactggtagtggcattgaacttccctaggaaggagatcccagtaggaggggtgggttgccatctttgctgtttgggcaccttacccattccagccttcaggttttggagagtccaagccaaccaggggtagaagggatcctccagcatagcacagctgctttaccaaaacgtggccagactgctgctttaagtgggtgcctgatgccttcctcctcactgggtgggaccttccaactggggcctccagccactcctgtctgttgtctcagactgacaaagatttgtaatctccctgggatgatgctcccagaaggaaagacaggctgccatctgtactgttttacagattttgctgatggtacctccaggtactgaaaaatccaacacaactagggaccggagtgggctccaagcatattgcagcagctttatggaaaagtggccagactattacacgggcactcattcccatatctcctcactgggcaaatcctccaggtctgggcctccaaccaccccccaacaaagctatcatgcctgtagcaactcagcaactccttggacagagcctctgggagcaactgaaagcctctctgccactgcctctgcagtgaaactgcccttgccaccctcggactaacaaaggagcaaagaccctaagtgccttatccacacctccaacaagctgcagtccacccaaggagaggaggccaatctatctcccaagagtctcatgcagctcccactgcttgtcactagacagggaatccctgtcttgggcccacagcacagacccttcatcccgtgctgatcgcactgagcaattgctgaccttcatctctcttgggtggagctccaaggagacaaacaaatgacccttagccacaaccactactaagatccctctctctgcagcttccaagttgaggaaataacatatacactgagattgctgcagaactgcagtggacagcccaggagtgccaagtcacaatccacagctagcactcaagtggaagaggaacccacactttcagagcattgagagggaacatggctgcaatggtgaggaaacataggggagccacacaacaaagcaagagtctactaactgaccaataagcctaagtgtcatctgctggatcacatctcaagcttcaacactaaaaatacctcactaatatacccccctctgaaaccagagacaagaagtcagcttcaaataaagaccctacacaaagcaatggctctgtgaaaacatgcagaaatgaagtctactggctgtactcaatctatactgcagttataagaacacccatgggcagagatgggaaagaaccaacacaagaactcttaactcttaactcaaatggccagagtgtcgtatgtcctccaaacaactgcaccagttttccaacaagagttcttaaccaggctgaactgtctgcaatgacagaaatagaattcagaatatagataggaacaaagatagttgagattcaggaggatggtaaaacccaatccaacaaaaattaaaatgacaataaagtgatagaggagctaaacgatgaaataaccagttttttttttaaagagaacgtaatgggtctgatagagctgaataacacaatacaataatttcacaatgtaatcacaagtattaacagcagaataaaccaagtggaggaaaaaatctcagaacttgaagatggtttctctgaaataagagagtcagacagaaataaagcaaaaagagtaaaaaggatgaacaaaacctccaagaagtatgggattatgtaaagaggccaaatctctgaatcattggcatccctgaaagggagggggataaagcaaacgacttgaaaaatgtatttcaggatatcatccatgaaaacttctggatggttgctagaagggccttctagctagaagggcttgctagaagggccttctagctagaagggcttgctagaagggcccacagtaaaattcaggaagtatagagaacttctgcaacattctacccaagaagatcatcctcgagatgcataatcatcagattttcaagggttgaaatgaaagaaagaatgttaaaggcagctagagagaaaagacaggtaacctacaaagggaacctcatcaggctaacagtggacctctcagctgaaatcctacaagccacaagacattagaggcctatgttcaacattcttaaagaaaaaggtcttcaaggaagaatttcatatccagccaaactaagcttcctaagtgaaggagaaataagacccttttcagataagcaaatgttgagaggattcattactaccagaaatgccttacacaaggtcttgaaaataaccctaaatatagaaaggccactaccaacaaataaaaaaacacacttaaacacacagaccagttatcactgtaaagcaaccacacaaacaagccaacacaataaccagctaacagcacaatgacaggatgaaatccatgcctatcaatactaaccatgaatgtaaatgggctaaatgcccccaccttaaaggcacagagtagccagttggataaaaaacaagaccctatggaatcctgtcttcaagagacctatatcatgcataatgacagtcataggctcaaaataaagggatggaggaaatctatcaagcaaacagaaaacagaaaaaaggaggggttataatactaatttcaaacaaaagagattttaaaccaacaaagatgaagaaagacaaagcagggcattatataatggtaaaaagttcaatttaacaagaagacctaactatcctaaatatatatgcacccaaaacaggagcacccagattcataaatcaagttcttaaagacctacaaagagacatagactcccacacaacaatagtgggagacttcaacactccactgacagtattagacagattatggaggcagcaaattaacaaagattttcaggacctcaattcaacattggatctgatagacctttacagaatgctccactgaaaaacaacagaatatacagttttctcatttccacattgcacatactctaaaatcaaccacacagttgaacataaaacaatccttagcaaatgtaaaagaactgaaatcataccaaacacattcttggaccacagcacagtaaaaatagaagtcaagactgtgaaaatcactcaaaatcatgcaattacctgaaaattaaactacactctcctgaatgacttttggggaaataatgaaattaggcagaaaccaagaagttctttgaaaataatgacaacaaagataccacataccagaagctctgggacatagctaaagcagtgttaagggggaaattcatagcaataaatttccacatcaaaaagacagaaagatctcaaattaacaacctaacttcacaactgaaaaaaattagagaagcaagaacaaatcaaccccaaagctagcacatgatgagaaataacgaaaatcagaactgagctgaaggaaatcaagacgtgaaaaaccatcaaaagatcaataaatccaggacttggtttttcgaaaaaaattaataaagtaggtcactagctagatgaataaagaaaagtgagaagctccaaataaacacaattagaagtgacaaagggaatgttactactgattccacagaaataaaaacaactatcggaaactatgaacacctctacacacacaaactagaaaacctagaagagatggatcaattactggacacataccctcccaagactaaggatttgattccctgtatagaccaataatgaactctgaaattgaagtggtaataaatagcctacaaactaaaaaaatgcctgtgacctgacagattcacagctaaattctacaagatgtacaaagaagatctggtatcattcctaaagaaattaatctaaaaaaaatgaggaaaagggacacctcctgaactcattctatgaagtcagaatcatcttgataccaaaatctggcagagacaaaataaaaaaagaaaacttggggacaatattcttgaagaacattgatgcaaaaattctcaagaaaatacttgcaaactgaatgcagtggcacatcagaaagctaatccaccacaattaagtaggcttcatccctaggatatgactcatcacatacacagaactaaagacgaaaaccacatgattatctcaatagatgcagaaaaagtttttgataaaattcagcatccttcatgttaaaaactctcaataaactaggtattgaaaaaacatacctcaaaataataagaaacatctgtgacaaacccacagccaacattatactgaatgggcaaaagatggaagcagtccccttgaaaacttgcaccaagtatgccctctctcaccaattctattctacatagtattggaagtcctgaccagagcaatcaggcaacagaaagaaataaagtgcacacaaataggaagataggaagtcaaactatctctgtttgcagacaacatgatgctgtatctagaaaaccccatagtctcagctcaaaagctcctctagctgatgaacaacttcagccaagttgcaggatacaaaatcaatatacaaaaattactagcattcctataccccaacaacagctgaaccaagagccaaatcagaaaggcaatttcattcacaattttcacaaaaagaataaaatacttagcaatatagctaaccagagaggtgcaagatgatctctacaaagagaattataaaacactgctcaaaaaaattagaaaagacacaagcaaatgaaaaaacatcccatgctcataaatagaaagaattaatatcattaaaatggctatatttcctaaagcaatttagagattcaatgctattcctatcaaattaccaacgacatactttacagaactagaaaaaattatcttaaaattcatgtggaaccaaaaaaaaagctcaaagagccagggcaattctaagcaaaaagaacaaagctggagacatcatgttacccaacgtcaaactattctgaaaaactatagtaatcaaaatagcatgatactggcacacaaacaggcacataggccagtggaacagaatagaaaggccagaaatgaggctgtaaatctatgatcatctgatctttgacaatagtaaagacatggaatcaacctaaatgcccatcaatgacagattagaaaaagaaaatgtggtacatatacaccatggaatactatgcagctataaacaagaactagatcacgtcttttgtgggaacatggatggagctggaggctattatccttagcaaaattaacacaggaacagaaaaccaaatattgcatgttcttacttataagtggtagctaaatggtaagaacttacgaacacaaagaaggaaacaagagacactggggtctacttgggtgggaaggtaaagagctgggagaagaacagaaaagataactattgggtactgggcttaatacctgggtgatgtcaataataatatgtacaactaacccccattacatgcgcttacctatgtaacgaaccttcacatgtgcccccaaacctaaaataaaaatttttttaaactaaataaaataatgcctctttaccttaaaaccattcatttggattttggaatagtttcataactgagaaaaaacttttagaaaggagaaactattaagtaaactagttctccatgatatccccttttattgggtagacttctttgtatataaaactaaaaatgtgtctgagtttttcagggccaaataatatcacaaaaagaatctttcaaatcatgaaacaataatatttgaagtaattcttcttctttctttcttttttggttttaattgctttttaggtaggtgattgaaatcactaagtatgcctggattttccagtgtaaataaatattaattttgaacttacagaaaaacaaatttcactttttcgtctaaatattcagttattgtatttactgggaaatttccaggaatgttgctataacagaaggcttttagcaaaaagatttatttctttgaagtaagtattaaggaaaatattctgtattgctatctttaatacaagcatgtttaaaggcttatctaaattcttcttcgacttcactaatatatgaagtagagctctcctattcactattccagagtatggtattataaagacagattttactcctcattcttataataatgataatatttaatatgtcaggcattttgctaaacatttcacatgtgtttcacctagcattatgggatacttactattctagccccgtttaacatataagtaccttgaaagttggaaatggtatgtaacttcccaaagacacaggcagggaaaggcagagcagagccttgctcttcacttctctgggactcggtttcttcgtctgaaaaataaggttgttggactggatttctttttattataaaatgtcattattctgggattttcagagacccttcaaaataactcagagccatctacataaagtagtttggcttacataaaactgagatgttatggataactctagattttcatcattctaagcatcttaaaggtcttgataaatttgttgttaaagtctcattacagatatttgaggtcaggcatggtgcctcaagcctgtattcccagaactttgggagaccaatggggaagaactgcttgagcccagaagttcaagatcagtctggacaatggagcaagatcctcgtctctcaaaaaaaaaaaaaaaaaaaaacccgccaggtgtggtggtgcatgcctgtggtactagctatttgggagactgaggtgggagaggatcccttgagaccaggagttaggctgcagtgagcaatgatcaccccactgcactctagcctgtcccccagcctgtgtcaaaacaaaaatatttgataaaggatttctgctctcatgcttttttattgatttttatttttttttgttctatctttaatgaattgtcagggcccagtgaggaaacagaacagattgatgaatctacaaattaagatcaggttggctgggtgtggtggctcacgcctgtaatcccagcactgtgggaggccgaggtgggcggatcacgagatcaggagttcaagatcagcttgaccaacatggtgaaaccccatctctactaaaaatacaaaaattagccaggcatggtggtgtgtgcctgtaatcacagctactcaggaggctgaggcaggagaattgcttgaaaccagaaggcagaggttgcagtgagccgagatcgtgccattgcactccagcctgggcaacagagcgagactccatctaaaaaagaacaaaaaaaattaagatcaggctgaagaagtggtctttctagctgtgttcaggccccaagctctagcctttcggcaggtcgtctacctttcaatccagaaattaaatttcacatggtatccacagctcttacatttgatctaaatatctcctcagatcctggtatgaggaaatagattcagatcttatttgattgattaatatacaaagggttaatcaggagtactaaaaacaaatgtcaagtcaaggcaataatcaggaagcagtaaatatcatggtttagaagtaagcaaggctagggctgctaagtttcatatgaatccgtttgttgcaaaacatctaagatgtctattatgtataaattgttcatttcattcagtgttttttttttacgttgcattcttatatgtctctcttttttgcacagatcctctcttcacacttggagtgtaagtaattttaacaaaggcaaaaaagatcagccactgttgtttattgaactaccatgtattacatacttttctatttattctgatttaaatctttagacaatgttgtgaggacaggagtattgtactcattcaccaaatctcttagaccattcagagtgctataacaaaatgtcttagactgagtaatttataaaaaatagaaatatattgcttacagttttggaggctggaaagtacaaaaataaagtgccaacagatttagtatctggtgagggcttactctctgcttcaaagctgttgccttaatgctgtgtcttcacatagtgaaagggacaaacaagctctctcaggcctctttatttatttatttattttgaaacgtagtcttgctctgtcgcccaggctggagtgcagtggcgcaatctctgctcactgcaagctccgcctcccgggttcacgccattctcctgcctcagtctcccgagtagctgggactacaggcgcctgccgccgcgcccggctaattttttgtattttttagtagagacggtgtttcaccgtgttagccgggatggtctcgatctcctgacctcgtgatccacccgcctcggcctcccaaagtgctgggattacaggcgtgagccaccgctccccgcctctcaggcctctttataagggtactaatctcacccgtgagggtgaagcccttgtgacctaatcaccttgtaaaggccccacctcctaatagtattttaatatgtaaatattgaagggacacacacatacagaccatagcactaagtgacaaaactgtggctcacagaagtccattatctttccattgtgtcatgatatgtattcctatatataattgttttcagtttttagaacttacctaagcctatagcaaaattataaatgtaacattagagttcacaatatcttagacattatcttgcctaataccttcctttagaaatagagtctgaggcatgaggacgttaagtgagttgctcaaaatggatatttaacaaacacttgttgagtgactgaagaacagaaagcaaaaggagaatttactttatctgcaatgagatctgattctatgaaacatagatacaagcctattgggggcaaaaatgtatgggacatactttgatgaaaacatccttggaggttactgaataccgggattatttcaatttaagttgtgacataaatggatttaaaactgcatttccattcacttttgacaataagtcagacagccttgattaaagtgaaatgctacacaaatgaactcaaatgtaagtgaaaattttctgtaaactataggagagcaagagcaacattaaacacagcagtttgagtttacaggactttttgtaaaatccctgggctataaaacaaaataagcaatgataataaatagtaatagtaaaactaatagatctattattgacataatttaatatttctccctcagacaaagataaataaaacatattcattgttgctctttgcttcacacactgtgctaaagaaaatacactttcctggatagagtttcttgtttttcctttttgtttatgtgttaagttgcagacaatggaaatgttttggctcagctaaaattttcaatctagccatttccattggtgaacaacacaggatacagccaggcagttaagattgctgacagcgtccgtgtgctttcttccaaagatcctgttcataaccaaacctcaaagttgggcaaaaataagtgaagtctgggcccttgaaatttcattttttccattagggaaaaaaaatgtcacatacaacctctattggaaagcatttgaagcactctgggacaagcttttgtgaaatcggttcttgctaaaattcataagcagaactggagctagattgtataaaatactaagggtggggaaagataaatgcaaccagaatacccagtcacggctttgggttgcagatttgggaaccactgtgtctttccactggaagtaaaatgcctgtgctattactattgtgagagaaactgactaacgacatctctgagttagcagggcatatgactgggaccacagaattatagtgtagtgggcctgccttgcctcagggttttcagctcttgtgttcgaagtgttcttgtaaaataaaaacatcctgcactgaagctaaaataaataaagatgtattttgaatggaacactcactcttcttgccttcctttccaacttccctgcctgtctaaaagaaaaatattttttatttgttggtgacatagaaccatgattaattgcttctaacaccaaaaatagaacagtaatcctgcgactctcagacactgcaaagctggtcttgttcataaactcagaagaggctcagaaaatgtctcagaataacccatgatcctggcagcaacaattttccaacataaatctcagtaggaaatatggctttctgctctgttccttttactattcctgtagcttgttgcctgaactggtagaattcttctgtgcaatcgccctaccatggctgtgaaaataatgtttctacttcccaattttgtgtgtatgagaactagagaacaaggtgattgatgctaattctcatcaccattcctacctcacctgtttttatttagttttcatgaccagagaaaagatggtagacagacctaggaacaccataaacatggagcattgtgcttggagcattaggaattagattgccttcactaacttaattatagcatggtatacagcacagggaagaatggagcccagtttagataaatgactgccttttccatctaaagttggtctatgaatatgggttattagcaataaagaaccagtcttgggatagatgtaattcacagattccactaataatgcaacatccataatggggtttcgatacaaaattctcctcattctctcagctgccactgcaggttgtgtttaccccaaatccacatgtccccaggatcaccacaattagtatttacatagaaaaacaaaacttcctacttgacttggactaacgcttccaatgtgagggtctgttttcgtgcaagatttgtgatccttcctagtgtaagcctggcattttggatgaagtgtaggatttccagttcactagcaagtctttctgtaatgtgagctgtcagagattttagtctctactttagtgcacagaggcgtaagtctgatttgatgatgtgcctcttctgtgaagctttcaaattctcattgatggttgctgctctgctggcttctttgccctcccctcacttgatggcacttcctttaataattcaggaagcttcttggtcaataattgcatgttcatatcacaggtagtaaaattgttctaaattttcttcgttagtgaaaatggcatgattaagacttgtctagcactctacttttattgaaaagagacatatacgctaaaatggagttgttataatctgtcttttaaaaagtaagcaaaaaactttcttaaaacttttggctttaaaatgagagaatacagcaaattcaacaatccattcagattaagttaactgcttttttgtgtttaagtagtccaaatggaactttcacatgttttcattattcaaacccctgtgacattatttcccagcaattatgtacactgcagttacgagtgaagaataggtcaacaggataccctgacaaagtaatggagaatgaaaaataatctgatttgtctcactggggatgctagttatattaattagaggaggagagtcttctctctgtagtttcattttatcacgctttaaagcagactgggctccccagattcaaatatagaattgcaaactttttcttcattttggttcctgaagctgagtctttggtttcagatcacttgtgtgtgaatcctggtttttccttgttctagctacatgcccaagttacttaacctcttttaatccttaagaggtcaagttatttcacctcttttaatctccatctattcatttgtgaaatggagatgactgtagttcctaatacatagggctgtactggggattaaatgagaaatgagatgagatcatctttatcatgatacagggaacaagtaagtgctcaataaatgttacctgtggttatagtgtatttctgcacatatgggtttgtgaatttcaccactcaggtagctgaatcagtttgaaaaggactgtcttaaaatcatcaatgcataaagagagacgaatgatgaagtgaaaaaaataatcaaagatattttagagcaacctagtaacagtgttttataataagttttgctgtggcctcccagagtgaatgtaatttaaattttctctcatcttttttggcaatgaacaataagttcataatttctattttccgtggcttctccatttaagtctgacttggtaggtcaacattgattatttaaaaaatggttgagcaaatttatttctatttttttgttaataaccttatagagaatttaaatctatggtccatacttcaaatttgctttctaggatctggctgattagagcaggaaaacaatcttaagctctttcttgactagtgacagattgctgctaatcttctcattatatatagcacatacaaatttgctgctaagcattcatatatacatatatatacacatacacaacaataaatattcatatgtacacacacatttatgatgtgaaaactaatcccagagtcagttttggggtaaagatagtgtttcagtaagatgtgaattaaaaccatggaagcaaagttctgtgttaaaaaaaaaggggagacttttttttaagtagcacagaacaataacaataaaaacaactgaatctcactagagctaaaaataggtttagcggtttcattcattcaacatttttttcctgaatgccatctatgtgccaggcattatgctaggatttgggagtaaaaaatgaaaaggatctattcacaaacatctgtgtaagagacttcccaagtaatgtgcccaagtttatgcctgatgaataaggccagaacataagttctctgtctccagagtccatgtttttcccacaataccaggttgcttattttagcagacactgttgatgccctgtaccgatcctctcagatcccttttcccaactctatgtgctcatctcctaacttctgcatgttgtgctagtaaaagtttgcacctttgacctgaaaagattgctcttggacactgcagtctccttgcctgaacagagtaagaaatgtctacaactggccttcctcacgtttccctaacacccaaaaaacctggagtggcacatagccaatgattggtgtggtattataaaagtccatttcctttgccacgaggtaaagcaaactctaaagtgtaactcatgctccaaaactctccataggatgaggttgagccctcacctgaaatttcttggttaattttccttgtctatcttgctgtccctactttattactgattttttcctgggcatattctcaccacacaaattttctcttagggagtgctcctggaagattctgagtaaagacatctatattttgagctttttgtttgtttgatattttactgtgggtttgtctaagttttaactgaaagatcatggaaataagtttttatgagatttttagatcacattgtgaaaattaaatcaaaattcatcatttgacatgataatttaattaataaaatatgagtgtagtttatttagtgaccttgaccaagtcattttatctattcaggtatcaacttgctatagatcgaatgtttgtatccccgtaaaattcatgtcgaaatccttaccctcaataagatggtatctgagagtggggcctttaggaagtatttaggtcatgaaggggagccctcatgaaaaacatctttacccttactaaagagggcccagaaagctgccttgcccattcaataatgtaaaggcacagtgaaaagatggacatctatgaagcacgaagtggaccatcactacacattgaatctgccaatatcttgatcaaagacttacagtctccagaattgtaagaaataaatttctgttgaatgtaagtcacccagtctatgctgtttttgttatagcagcccatctggactaaggcaagattttccttgtaaatatgagtgttatttagtcaagtagtcatcaaggtcctataagcctctaaaattcagtgagctactaaatctttcttaacctataatcatgtcaattcaccattttgatggaacctatatacttgaggcagataattttgtgctacccagtcacagtcagtttattagcagttgatagttaaggtagactacctctgtgtgaatatacaacctgtgtaatgtaacatttaataacctttctgctttagaagatattatggtttttataaatacacatgtgtggcataggatataaataacctagtgaatgtaaatacgatactaagttctttaacataaagtggcatgtgaacattaaatataatatgtaccatgtcattcatgacacacaaaaatgatagtttaaataacaggctatatgaacagtattcacatttgttttgttgtgttttgttttttgagacagagttttgctctcgttgcccaagctggagtgcgatggcacgatctcagctcactgcaacctctgcctcctgggttcaagtgattctcctgcctcagcctcccaagtagctgggattacaggcccctgccaccacgcctagctaattttttgtatttttagtagagatggggtttcaccatgctagccaggctggtctcaaactcctgacctcaagtaatacacccgcctcagcctcccaaagtgctgggattacaggtgtgagccactgctcccggcccagtattcacattttgacattttattttcatctgagtaacaaggaaaaagtaatttaatgctttaatttaccttttttaatagagcagatttccagtaacaatcatcaagttatacttttatagaacagtaaacacattaaaagaactgttgttaaaattcatgtgctacatttgcaaaaaaaaaagtttctatttcagctttttcaattaatgtagcatggtcattgtcaattttaagtgtttaatatgttattgaacatgtcatatgaaacagtataattcagaattttacccattgtaaagtacctttgcttcaaaacgaggcatagtgcagaatcaaatagtggaaacagtgaataataaaacattaaatttctggctgacattaatttcacctattccttgaataatctatttattcaatccacaaatacttaagaaataaagcaacaaaatatattttacattaataatatagtccatgagagaggataaagggaatgaaatgaatgcataaaagatatactctaccttactctcatattccactctcagaaaaataatataaataaaataaacctaaaaggctgtaaaataattccatgaaaaaattgattaggtgatgagcttgttttatctgaaggcagcataggaataaaataaaaaaagttctcaaaggacaaatggaaaatctctcactggacgtttttttggaggctttgactattggccatcaagaccacattatcatattttgtgtatgcttcacaacacacaattaggcaatttttaaggcaattttttaggtcaccacaactagaaatcacatgaactctgctcagcaataaggtgttcccagaacagattttcaatgcactactggatttctccattcagctggatgaccctgaggactgaccactgttagccagcaggttgtccagctttttattccagtcgcaataaggtgatagtgttaaccatgaaaacttgagaggcaccccatcctccttccaattacagcctgtaccaccttgctcgggacctctgctcctagttagcaaggagggctgcaacagttgttattgcttattctgaaagaaatgtagaacttgacagcagccgtctgagtttgggtcaggaagatgctcttaggaccaaagcagacttctttacacacagctcagtttccaggaagtcgccacagatgtgcccaatatcccaggttcctgtcactcaatcagcagaagctaccattatgccttttgttcctactggcagagggaggagtatatttcatcactatgatcagtaatgacttgtggaccatccttgaagagcaagaaatgcaatgtagaggcaagtctataatagaaagatacagtatagcagtactcaaccattttatttatgtgcttctcacatttcttatgacccatggaaagaatggtccactgactctcacaaacaatacttagcaaactaatcagatatctcaacactcttggtattcatgaaaatgtctgaggacaaatatgcgtgagagttttaactagagaagtaaccatatgctatggttggatatttaactgctccaaaactcatgttgaaatgtgatccccaatagtggaggcaagttcttttttttttttttttttttgagacagagtctcactgtgtcagccaggctggagtgcagtggcccctgatctcggctcactgcaaactccacctcccgggttcacgccattctcccgcctcagcctcccaagtagctgggactacaggcacccgccaccacgcccggctaattttttgtatttttgtagaagagacggggtttcaccgtgttagccaggatggtctcgatctcctgacctcgtgatccacccaccttggcctcccaaagtgctgggattacaggcgtgagccaccacgcccagcctggaggcaggttctaatgggaagtgcgtgggtcatgggggtgaagccctcatgaatagattaatgccttccagggggtgcgggcagaaggtgaggcagaaaatgatgatgtagaagctgcagcaagttatccacaaaatccaactaagataattgatggaggtggctacactaaataacacattttcagtctagaccaaacagccgtctattggaggaacatatcatctaggactttcatagctagagagaagtcaataccctttgttcctgatggaagagggaagagtatatttcattgttctattagtttccacaagagctggttgtcagcaagagcttggcatctgccctttttcgtgcttcctctttccacgtgctctctgtaggcactgactccctttgccttctgccataagtggaagcagcttaaggatttcaccagatgcccagtcttccagtcagcagaatcatgagccaaataaacttttgtttttataaattacccagcctcgggtattcctttttagcaatgcaaatgaactaaagtaccatctattttacttttttaaaaaggtagatctctactgtcataccacaaagatattatgggtttagttacagaccctgcaataaagtgaacaatgaaattaaaaatttccaaaaatttttgttttcccagtggatatgcaagctatgtttgcactatactgtgctctattaagtgtgcaatagcattatgtctaagaaaaaaatgtacatacattaattaaaaatactttattgagaaaaaatgctaatgattatctcagccttcaggtgagaatctttttgctggtggaagattttccctcagtgttgatggctgctgactgacaagggtggtgtttgctgagggctggggtagctgtggcaattaattaaaacaagacaaccatgaaagttgccacattgatggactcttccttttgtaaaagatttctctgtagcacctgatgctgttcgatagcattttacccataacagaaattctttcaaaaattggaatcaatcctctcaaaccttgccactattttataaatgaaatttataaaatattctaaatcttttttgtgtgtgtgtggtttcaacaacattcacagaatcttcaccaggagtagatttcatcttaagaaactgctttctttgctcatccataagaagcaatcttcatttgttcatatcttctcaagacattgtagtaattcagccacatcttcaggcttcacttctcattctaattctcttgccatttcccgcacatctgaagtaacttcctccactaaagtcttcaacccctccagtcatccatgagagctggaatcaacttctaaacccttcttaatactgataatttgacttcttcccatgaatcaaaagtgttctaaagggaatctagaatggttaattctttccagaaagttttccgtttgctttgcccagattcatcagaagattcactatctatggcagctaaagccttatggaatgtattttttaaataataagaattgaaagtcaaaattactccctgattcatgggctatggaatggatgatctccatcagagttcttgggtgactaggcacaatgtcaataagcagtaatattttgaaaagaatctttttgttttgagcagtaggtctcaatagttagcttaaaacattccgtaaaccatgatgtaaacagaaatgctatcatccagctttggttttctatttatagatcacaggcagagtagagttatcatcattattgaaagcccttgaattttcaggattataaatgggcattgacttcaacttaaaatcaccagcttctttagttgctaacaagagagttagcctgtcctttaagctttgaagcaggggattgacttttctctagctgtgaaagtcctagatgatatgttccttcaatagacggctgtttgtcaacactgaaaatatgccgtttagtgtagccacctccatcaattatctaagctagatcttgtggataatttgctgcagcttctacatcagcattttctgcctcaccttgcacttttatgttatggagatggcttctttctataaagttcctgaacctctgccagggttcaacttgtcttctgaaacatcctcacctttttcagcctttattagaattaaagatagttagggccttgctctggattaggccttggtttaagagaatgttgtgggtggttttatcttctgtacagaccattcaagctttctccatattacaaatgagactgtttcactttcttactatttgtgtgtatattggagtggcacttttaattttgttcaagaacgttttctttgcattcacaccttgtctgactggcacaagaggcctagttttgtcttatcttggcttttgacatggcttcgtcactaagctcaataatttctagctttttatttaaagtgagagaggtatgactccctttcatttgagcaccgagaggccattttggggttatttagtgacctaattgcaatactgtcatgtctcagggaaggaggcccaaggagagagagaaagagataagagaagggctggtcaatggagcagtcagaactcacacatttattgattaaatttgtcctcttatatgggtactgtttttggtgtctcaaaacaattactaggttggcgcagaagtaattgccattacttttaattacttttaatggcaaaaaccgcaattacttctgtgccaacctaatacaataataacatcaaaggtcactgaacacagattatcatagcagatataatattaatgaaaaagcttgagatattgtgagaattgccaaaatgtgataccgaaacaagaagtgagcacaggccgttggaaaaatggtgccacagacttcctcaaagtagggttgccccaaacattcaatttgtaaaacatgcagtatctgcaaagtgcaataaagtgaagtgcaataaaacaacgtgtgcctgtatatagactgctcataaaatctagaaatatcaacaatatatagaatgccaccaagggcacctcaatgcaaataatgatgaaataatacctttttttcagactctaaggttagtctgaagattgatatggaatgcttttctaaatggattattaattggcagacaaagcaaatagcaaaacaatatgtactttactattgcatttacataagtcaagttcacatttacattcatacaaaattaacttacaattaggttatataatagtgggcatgatggagaggattgaagagaaggcacaagagaatgccattttgacgacattgtttgaaatgttcacagtgagaacatagtcatagagcaccagtttagtattttgattctgatcactaacaaaattttaattctgaccagtaacaacatttttgcaaaattcttcagaacttccctatgctccaggctctccatccagaaaataacgatttctgaggttctgtcctactttagtattttaattgtttatggagtgatcaggagttaggaggcacacgtcaacccagctggcccatgctgtctcttagaactctgcatttggtaattatataaaatgacacaatgttttcaacaggagaaaacattgctaagaaaactccttaataatatgtccacacatgacacttccctctagcagagggatgaggccccagcactactgagtttcaagactttcaagataagacacagagtgaaaaatgaggctaccaccaacgtggagcatgggggtttcacagataagatccctgaccctcctccagtcccaggagaccccagaatgattgagactgagttgccccctgacttctgccttgtgtttgcagggaggtgtgagacttgttctgaggagtgctggttcaggtcagcagagggaggagtcccagactctgccaggagttaaggtaagattctgagtgagaactgaggtgaccacccatttcagaagggaaggggttactcagaactctgttgtgacctctgggagggtgagagtttgtgggtagtgtctttccttgacttttgcttcactagtctgacaatggcgaatgcctttatctgagaggggaggccttattcagcagagagaggaatctcagacacttccaagagtcaaggtaagatgctgagtgagatctgagtggacctctacccccaaatgaagaaggcccctcacaactctgtcgttctccctgcagaaaggaggaatggccttaagtggtttttcttgtcttttgcttggagagtgagagaatggtgagtaccatagtctaagaagtgtgaccttcagtctgcagaggcaagaatttcagcccctgccaaacatcaaggcaagacactgagtgatgactggggaaccacacactccagaagatccaaagagccctgtccctgctatcagatctggtatctggtagggcatagaatagctatcagactttagtgctttctggttttgtctttagtagtctgagggttgccgtgtcaagtcagcagagggaggcatcctagcccctttaaggggcaaagtgataaccctgagtgatgaccgagagaatcacatacctcagaacagcaaaatctgtacagacaactgccacttgctgtcacctctgggaggcccaaacaggtatggcctaatgagaagccctctcacttccttcctgtagaatctgttgcccctctggctttcctggcttaaaggttctagaaaaagctgttgagagtctggggtactccctcaattccatctaccttaaatatctcagggaaattaagagctctttctgaggtgatagctcttgggtcagtagaggtgggagtcccagatactcccttgggtcacagtgaggattctgaacaaggacagagggaaccactgactgcaaaacgaagggattccacagagcctcatatgtcctgtggtcagctctgggaatctttgtgctgagttgaccagcggcaccctgaaaagcatcctcatttcctcctttagcttcttacaggtcagaacaggagacctgtgaggctctagagcactgccctcaagaaaaaaactgctggaggcagcatttattggagccaccaaccgttgagtttaccagatgaggccattcacatcttccctctatccccaagttgggcttcactgtcatctagcttcctgcccacattcctgcctgctaccaccttcaagagtaaccatgtctcagagtcaggagaatctgcattgaacacgtgaacaccaccatgcctgaagtgagacccagggcctagaggttgtgcaggtatccaagattatggaggatacatttccctcctcctcccattttctaatgcctcgcaacctggaggtgttctctgctgctgagacaccctgtacactccagggtcttcgaaatgcctgttcatcttccactgtcaacactgccacttcaacaagccagtcaaatgagagctccagcagccaagaagaggaggatagtacagcttctttagagtcttcacaagacactgagaacctgcctattgaccctgtagatgagaagtgactgtgctgatgcagttccttctgcaaaaatatcaaacgaaagaactgatcacaaaggcagacatgctggatattgtcatcaacgagtacaaggatgaatttcttgagatcttcaagagagcttctgagtgcatggagctggtctttgctgttgatgtgaaggaggttgatcccaccagccacagttactcccttgtcaacaaactgggcctcacctatgatgcaaggctcagtggtgatgaggacatgcctaagattggcctcctgattatcaccccgagtgtgatcttcatgaagggcaactgtgcctctgaggaggagatctgggaagtgctgaatatggtgaacttatattccaaggggagatacttaatctttggtgagccaaggaagtctatcaccaaagatctggtgcaggaaaagtacttggagtactgccaggtgcccaacagtgatcctccatgctatgaattcctgtggggtccaagagcccattctgaaatcagcaagatgagattgctggagttttttttttaccaggattcatgagtctgaccccaagtgcttcccatctcagtatcaggaggctctgagagatgaatcagacagagcccaagccacagctgcagctagggctagccctactgccatggccaaggcaagttccaggaccaggttcagcaccttctcccacccctagtgtagtctgaagcagattctttattttttctttgaagagagtcatcagccttctaagtagtggaggcttgaggtggggctgtaggggagatagtatataacatcttcatatccctgttctagatggtgaacttggaggcttttcttttggaggggggcagtagatttcaaatgctgttacttttaatatgacatttcattagcttcagaatctacatttatgaatgacattgttcatatatttattaccatttttgaagtttaagaatacaagttttgctggtttgtaaaataaactatgaaacagatcattttatttttttatttgggaaaagataatgcagcattataatagacatttccttgcaactgtgaactcagcagcaaagtagttgggacaaagaaaaaaaaacctaaaagatggtcaattcttgtttttgcctatctcttttagtttttctgtgaaactacatgatacatatatgcatttgcttagcttatttaagaatgtataagacataaatcttaataaatcagaccctgtgtacattggttcatttatttcccaaacattaagtgaacatgtcttttttgtaaagcactttactggggatgctaagagaagcaagatgcactacctgcccatagaactttagagtgcaagagcagcagtcatatgaagatgatggtgagtatcctttattcaatacaaaataaaaattaaaaaagagtcaggaggtgtggcagggtagggggatctatatgagagcgctaaaatttaaataccctgagtcaaggcaggcagaggcctttggaaactgcaagtctttcattgggggtaattttaaattaaccggggtagtacactagatgaggctgtgggagtgacgagcaggggccggaccctcagtgttgagataattaagcctagaatggaaaactgttgttagcagtagttactttgagattatgcataaaccagatagcacctgaaacaagaatggtaggtgtcctgtgtgtttgtcccagtgctgttgaagacaagacagtgcacaaattagatattttatgcacatcgtgttcaaagagtttacgcaaaataagggtgatactttcttgaggtgagatacgcagaagtcactggactggaagtctgccaagggctgggagatccagagtccactccattcaaagaacattttaaataggttatgttgaatataatttggcaactgtaagcatggcctacatttttttgtttgagagaatggatgaaatcagagatgggttgctggaagggcaactggagggaggaaagggcttggtttttgacacaatttctaggggatttcaagtgcacttatttgggaaatactcccccaaagccaaattaaataatatatactgtaatggtgaagatttactgaagatttcatgctaggtaaagtttttggctgatttggtgtgccatgtcctagagtattgaatatcttctgacatctcctggataaacaaatcccagatgagaaagtggttgtgtctgtggtcaaaaataatcatagtactaactgccagtcagtgaagacccaatacattccagatgctttggcagatgctttacctacagtatgtgcattccaacagtcttatatacaagccaggatttatcaagactatctaacagaggaagatggtaagacaccgagagcttggtagtatgtcctatttcacatggtatgtgaaagagctagcactggacctctggtctgaatttttctaaagccagcactgttacactcctcccagcctgaaggtgacattctgtctgttaattcattccttttctcctgactctataatgcctctcagaggataaaaagaaggaccacaaggtactactaagccaaagcactaaaagcaggtgtagagaaagaatgtgaaaatgagaatcaaaaacaactgggaattgtttataggattcatttacctaaagtactgctgctcctagccccagagtgtcttgagaactgactctgctcaggagctggcacaggtttgcagtcccactacttttgcacattacagcaccctttccctagatcttaccctgtattctttcctttccaaatctggaacctgtcctgccgaccagctttttgctgtgcgctcgtgtaaaggttgtacctgcttccagtggaacaggcggcccaaaatcaccttccttctttctaacataactacaataaccaaaacttcgtgcagacatctcctggtgtaccctcactcatgcaatccctcagatggcaacagtccccttctatatgaagttttcttgaacagtgatgtttaggcacatagtcatccccatggacatcatcaccacattctcaaagcattttatagttgggctggttagtagagtcaaatttggcaaagaatatactggttcttgggatgcaaatgtaaagttagagaagtttctaaaaccatcttgatatttgcagtaggattttaatgcagtattgcatttgagactggtcactgaacatacacaacaataagtgagcttttctaggtggtcaaaatccaaagactcccccttaagtggtagaataggaaagaccatagaaaatactgtataaacaaaactctgtaaatcctgagtctgaattttggtaaactctggagttcctctagggggtagaagaaatggagatgtcaagaattgatttttttgtcctatatgttagctttaatttaaaaaaaaggaaaaaaaaaaacctcactatccttttattacctcttgtctgtgtactttccccagaaaaaaaatcctggttttccatatgtctaatggcacctgtacagatgttcaggcaggagcattagggtgatatgcagcaggggcttccacgttaagagtatgaccatgcaacaaatgcaaggagaaaatactcagtctactgatattatagaagttattagacagggaagtgcaggaaggtactattgaatgaagaaggatgaaccctttcttcagagatttaaagcattcttttgaaaaatatatgtaattctctatttgaaagcatctgtcacataataaaatcttaagaaagttggcaaaatgcaaggccaatttggccttctcagaaacccctccaggaaacaaagagggttgttgtcctaacaaagtgtaataattgctcttttttgagcacctgctatgtaacaggtaatgagagatcctgcaagtgctcatccacatactgtcttgatttatttcctgggtgcatggaaaaactacattgcctagttcacttgtagttaggaagggtcatgtgactatctttgccactgatatatgagcagaagcaatatttgccatttataggccaagacatgtgaaatccaggtggctgcctctatttttttaccagtcagtagcaaatatggagagctcatgtcgagatatggaactactgatggaaacagcttggatttgtgagtcacctggtggcaaagacccactgccaaattacgtaagattttatgtgaacaaacaaataaacttctgttgtgttaagccattcagatttcaggtttttgttttgcatcagctagcagttccttcatctaatactgacatactgtttatgttgataagcttatttaaatcttttaacagcaaagctaatagtaatgcatatattcttgttccaagtatttcttacagcatacataaatcaattccctccctctataatgttccctcaaaattcaactttctcctcagagggaattacaattaaaaaacctagtatgtataattttaaaaataatgttaagctttttaatatatagatttgctataaaatatattgtaatgttttaacgtaatgggtagtgatatacatattgttcttccacttgcctttgtcagttaacaaagtgaccacaacatcattccgtgccagcatgtgtaaatctatctcactattttatctactttcttgaaattctaaagtaagttcccaatataatttaacaattctctttctgatggacacataagtagtttcccattagttgatataattaatagaactgaaataaacatcttcaaacatcaatattttggcaagtgtgaataagaaaaacatagcaaagcagaagctgagatagagcaaatttattttttaatattgccaaaatgtcatcccacaaatattctaccaattcatattctcacaaattaatttatgcaaatactgtgcactctcacagacattattttttctttttcaatttcattttattttagattcaggaggtacctgtgtaggtttgttacatggatatattgtgtagtgatgggatttgggcttctagtgtacccatcacccaaatagtgtacactgtacccagtaggtaaatttttaatgctcagtctcctcccagacattgttttcaatcctttaacctttagttaaacttatatgttgaaagataatgtcttacaattatgttaatttaattttaatatcattattttaatttgtttaatgttttctaattagacttagcagaaaattgcctactacttcacacatgtaaagctggatttctgcagtaatattctgaatcacaagattcctcaggccattctttaaaattctaatgtctcagccaaggccacaggagacaaaaaaaattatgatgcctaaaagatatttcccctttgtactggaaagcaagcatttgtcagtatgactgaatgccagggaaggaggccacacatgacactctcagctagtgaggagtatcaagaagaaaggggatagaagaatttccagagtccatgagagagacaccatgcacaaccaagtccagagaggtctgggcaggctagtagtcagggttctgaatcaagaattcagccttgtgtggaggagctataaagagacaaagtggaggatctgggtggtgcatccaggacaacatatatgaatagccttcagatatctcttactcaccactgcctgatgaaaattactggataatttgagtgaacaggtctacggggtgaaagaaccagagcatatcagacaccccatcctaccttagactgcttgctacatattgtcaagcagactgactattgttggctcctatatatcaagtaatactacttatggctcctgagggagcaacatttcttgatgaccctgggacccaatgcattcttgccaatgtacctgagctgaaggctatctttatgtctcctgaacagaggcatttcttcccctatgaacagtggatcctgtcccctgaggttggcactgtgcaaataaatggggttagtgaataatgatacatagttgagacaggccaggaatagcatgagtagtggacgaggacacgtagctggaaggagggagaaattgatgtcccaagcttagacggacttttcatgcttcttgaatttttgcactacagagggtggatatctgtatttgctggtctatgtttgccaccagatactgcacggggtaagggtgtcttagttatttcaggtggctacaacaaaaatgccgtaaacttagtggcttataaacaatagaaaattatctctcacagttctggaggttgggaaacccaaaatcaaagcccaacaaatttgggtttctggtgaggacctaatttctagttcatggataactgtctttttgctgtgtccttccaccgtgaaaagggcaaggaatctcttttgagtttattttacacgggcaataatcacaataatgaatccccaccccccacccccgcagaacctaatcacctcccaaaggcctcacctccaaataccattaccatgagaggttaggatttcaaaatgtaaatttggggaaaacataaacattcagtccattccaagtgcattggcctacagtatagacagttgcagagtggatggtgagcttatggagatggcacactaccctgttaaactgatggtggctgatgaaaatatgtgagatctaatgcagcaagcatcatataacatcttattgccagcatctccacctttaagatgagagtgttagggcctgggaaggagacatttccaatcacacactgtgatagattttaatgataattctcaggttaggtgaacagttgtagcactttgggattcttccatgaaggcagaagaacctaccaggaggcaggcttcatatttcagtacttcttaattataatttttgtgggtacataataggtgtatatatttattgggtacatgaaatgttttgacacagacctgcaaagcataacaactgcatcatggagaatggggtatccataccctcaggcatttatctcttgtgttacaaacaattcagttataatattttcattattttaatatgtacaattattatttactatagtaactctgttgtgctatcaaatagtaggtcttattcattctttctaacaaatttttttgtacccattaaccatcctcatatagccccactacccttcccagcctctggtaaccatccttctacttctctatgtccatgagttcaattgttttgattttcaaatcccacaaataagtgagaacatttgatgtttgtctttctgttcctggcttatttcacttaaaataatgatctccagttccatccatgttgttgcaagtgactggatctcattctttatgactgaatagtactccattgcgtgtatgtagcatatattatttttccattcatctgttgatgaacacttaggttgcttccaaatcttagctgttgagaacagtgctggaacaaacgtgtgagtacagatgtctctctcatatactgatttcctattttttgggtctatatccagcagtgggatttctggatttgatgacagctttatttttcattttttgaggaacctccaaactgctctccatagtggttgtactaacatttccatcaacagtatacaagggttccctcttttctccacgtcctcatcagtatttgctattgcccctcttttgatataagccattttaactggggtgagatgatatctcactgaagttttgatttacatttttcttataatcaatgatgttgagcatcttttcatatgccagcttgtcatttgtaggtcttcttttgagaaatgtctattcacagtttttgaccattatttaattggattattaattttttccttagaattgcttgagctgcttatgtattctagttattaatcccttgtcagatgggtagtttgttaatattttctcctgttctgtgggttgtctcttcacttcgttggttgtttcctttgctgagcagaagctttttaacctgatgtgatcccatttgtccatatttgtttcggttgcctgtgcttgtggggtattactcaagaaatttttgcccagacccatgtcctggagatattcttcaatgttttcttgtaacagttaaatagtttgaggtcttaaatttaagtatttaatccattttgatctgatttttgtatatggcaagagataggggtctagcatcattcttctgcatatggacatccagttaacccagcaccatttattgaggagactatcttttctgcagagtatattcttggcacctttgtctaaaatgagttcactgaaggtatgtggatttttttctgggttctctattctgttccattggtctatgtgtctgtttttatgctagttccatgctgttttagttattacagttctgtagtatagcttgaagtcaggtaatatgattccttccttcagttttgttctttttaggctattctgggtcttttgtggttcaatataaactttagaattttttttttctatttctgtgaagaatgtaattggtattttgatagactgcattgaatctgtagattgcttttggtagtatgggcattttaacaatattgattattccaatccatgaacacgaaatatttttcagtattttgggcatccctttcaatttcttgcatcagtgttttatagttttatttacagagacctttcattcacctctttagttaattcctatgggtttaattttatgtgtggctattgcaaatggaattattactatcattattattttttattatactttaagttttagggtacatgtgcacaacgtgcaggtttgttacgtaagtatacatgtgccatgttggtgtgctgcacccattaactcgtcatttatattaggtatatctcctaatgctatccctccccactccccctaccccacaacaggccccagtgtgtgatgttccccttcctgtgtccaagtgttctcatggttcagttcccacctatgagtgagaacatgcggtgcttggtttttttgtccttgcaatagtttgctgagaatgacagtttccagcttcagccatgtccctacaaaggacatgaactcatccgtttttatggttgcatagtattccatggtgtacatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaataggatggctgggtcaaatggtatttctagttctagatccctgaggaatcaccacattgactttcacaatggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatgatgagcattttttcatgtgtcttttgactgcataaatgtcttcttttgagaagtgtctgttcatatcctttgcccacttgttgatggggttcaaaagctggaggcatcacactacctgacttcaaactatactacaaggctacagtaaccaaaacagcatggtactggtaccaaaacagagatatagaccaatggaacagaacagagccctcagaaataatgccacacatgtacaactatctgatctttgacaaacctgacaaaaacaagaagtagtgaaaggattccctatttaataaacggtgctgggaaaactggctagccatatgtagaaagctgaaactggatcccttccttacaccttatacaaaaattaattcaagatggattaaagacttacatgttagacctaaaaccataaaaaccctagaagaaaacctagccaaaaccattcaggacataggtatgggcaaggacttcatgtctaaagcacaaaaagcaatggcaacaaaagccaaaattgacaaatgagatctaattaaactaaagagcttctgcagagcaaaagaaactactatcagagtgaacaggcaacctatagaatgggagaaaatttttgcaatctactcatctgacaaaatgctaatatccagaatctacaaagaactcaaacaaatttacaagaaaaaacaaacaaccccatctgcaaatggaattatttttaaaatttatttttcacattattcactgttggcatatagaaatgctactgaattttgtatgtttatttttatcccacgactttattgaacttgtttaacaattctaatagtttctttggaacgtctttagaattttttcaaatatgagatcatatcatctgcaaacaagggtaatttgacttctttaattccaatttcagtgcctttatttctttattttgcctgattgctctagctagaagttccagtactatcttaaataacagtagtgaaaataagaatccttattttgttccaggtcttagtggaatggctttcagtttttttccattccatatgatattaactgtgggcctgttttatatagcttttattattttgaggtatgttccttacatatctagttttttgagagattttatcatgaagagatgttaaatcttatcaaatacctttttagcatcagtggaaattatcatgtggtgtttgtccttcattctgttgacgtgatgtaacacgttaattggtttacatatgttgaaccatccttgtgtctcagagataaatcccacttggtcgtgataaatgatatttttaacatattgttgaattcagttcactagtattttttttttaaccttaagttctgggatacatgtgtagaatgtgcaggtttgttacataggtatacgtgtgccatggtggtttgctgcaccaattgacctgttatctacgttccctcccatcactcccacccccaacaggccccagtgtgtgttgttcccctctctgtgagcatgtgttctccttgttcaactcccacgtatgaatgagaacatgtggtgtttggttttctgttcctacgttagtttgctgaggacaatggctttcagcttcatccatgtctctgcaaaagacacgatctcattcctttttatggctgcagtactccatggtgtatatgtaccacatcttctttatctagtttatcattgataagcatttggtttggttccatatatttgctattgtgaatagggctgcaataaacatacatgtgcatgtgtctttatagtagaatgatttatattcttttgggtatatacccagtaatgggattgctggatcaaatgacatttctggttctagatccttgaggaattgctacactgtctttcacaatggtggaactaatttacattcccaccaacagtgtaaaagcgttcctatttctccacagcctcatcagcatctattgtttcttgactttttaataatcaccattctgactggcataagatggtatccaactgtggttctgatttgcatttctctaatgatcagggatgttgagcttcttttcatatgtttgttggccacataaatgtcttcttttgagaagtgtctggtcatatcctttgcccactttttgatggggttactttttcttgtaaatttgttaatttccttgtagattttggatattagacctttgtcagatgggtaaattgccaaaattttctcccattctgtaggttacctgttcactcggatgatagtttcttaagcaggtacaagacaaggatgccctctgtcaccactcctattcaatgtagtattgaaagttctggccagggctatcggacaagagaaagaaataaaacgtatttatataggaagagatgaagtcaaattgtccctgtttgcagatgacataattctatatttagcaaaccccattgtctcagcccaaaaaactccttaagctgataagaaacttcatcaatgtcgcaggatacaaaatcagtgtgcaagaatcacaagggttcctatacaccaacaatagacaagtagacaaatcatgaataaactcccattcacaaatgctacaaagtgaataaaatacctgagaatacagctaacaagggatgtgaaggaccctttcaaggagaactacaagccactgctcaaggaaataagagaggacacaaacaaatggaaaaaacattccatcatcatggatagaaagaatcaatatagtgaaaatggccatactgctgaaaataatttatagattcaatgctatccccatcaagctaccattgacattattcacagaattagaaaaaactactttaaatttcatatggaatcaaagaatagcccatatatccaagacaatcctaaacaaaaggacaaagctggaggcatcatgctacctgacttcaaactatactacaaggctacagtaaccaaaacagcatggtactggtactaaaacagacatatagaccaatggaacacaacagaggcctcagaaataacatcacacatctacaaccatctgatctttgacaaacctgacaaaaacaagcaatgggaaaaggatctcctatttagtaaatggtgcttggaaaactggctagccatatgcagaaaactgaaactggaccccttccttacaccttatacataaattaactcaagatagattaaatacttaaatgtaaaaccctagtattttgttgagaatttttgcatcaacattactcagagatactcgtctgtagttttcttttttgatatgtctttgtctggttttagtattggggtaacacttgccttgtagaatgtgtttggaattattctctcctctgtttttcagaatagcttaagtagcgtttctattagttcttttttaaatgtttgatagaattctgcaatgaagtcattgtggcctggacctttccttactggaagatcttttgttacaactttgattttgttacttattattgctctattcaggttttggatttctttctgggtcaattttcccaggttgtatgtgtctaggaatttgtcaatttattctaaattttccaattctttggcatatagttgcttacagtagccagtaataatgctttgaatttctgcagtatcagttgtaatgtctcattttttatatctgattttatttattttgatattctttcctagtttgtctggctaatgttttgtcaaatttgtttaacttttcagaaaccaactttttgtttaaatgggcttttgtattgctttttaaatttcaaattcatttatttcagcttcgttctttattacatcttttcttttacaaatttttggttttgtttgctcttgcttttctagttctttaacatacaattagatcgtttatttaaatttctctttttatgatgtaggcagttatacctataaacttcccgcttagtactgcttttgctgtatcccataggttttgaaatattgtgtttacattatcattccttttaagaaatttttcattttccttcttaatattgttattgaccaactggtcatttaggagtatattgttcattttttctgtatttgtatagtttccaaaatttcttttgttattgatttatagctttattccactgtggtcagagaagatgcttgatattatttcaattacttttgaatattttaatacttttttctgacataacatatggttgcctatccttgagaatgatccatgtgttgagtaaaagaatgtgtattctgggccgggctcggtggcttacgcctgtaatcccagcacttcgggaggctaaggcgggtggatcatgaggtcaggagatggagaccatcctggctgacacggtgaaatcccgtctctactaaaaaaatacaaaaaatttgccaggcgtggtggcgggcatctgtagtcccagctacttgggagactgaggcgggagaatgttgtgaccctgggaggcagagtttgcagtgagccaagatagtgccactgcactccaggctgggcgacagagcgagactccgtctcaaaaaaaaaaaaaaattaaaataaaaaaatttaaaaaaatgtgtattctgtagctattggataaaatgttctacgaatatcttagatccgtttggtctacagggcagattaagtccaaagatttttttgttgactttctgtctgaaaactctgatcaatgctgaaagtgaggtgttaagagtccccagctattattgtattgaggcctatctctctctttagttctaataatatttgctttatatatctgaatgcttcagtgttgggtgcatatatttttaaaattgttatatccttttgctgaattgacccctttttcattatgtagtgactttctttgtctcttatagatttttcataaaatctgttttgtcttatgtaggtatctactcctgctaatttttagtttccattggcatggagtatatttttccatccctttatttttagtctatgtgtgtctttatacatgaagtgtctttctcataggcaacagatgaaagggtctgaattctttacccatttagccactgtatgtcttttgattggacagtttagtccacttgcattcaacattattattggtaagtaagaacttactcctgtcatttttttttttttttttttttttttggttaactggttgttttgttcattctttcttttctctcttcctttagtgcaggtgattttctctgttgcatgttttttggttttaggttaccatgaggcttgcaaatactatcttacaacccagtattttacattggtaacaattctgtttgcgtaaacaaacaagcatgcaatgattaaaaaaaaaaaaactaataacaatgctataccttaactttttcctctgttttttttttttttgccttttggctgtctttatttatattttattatactatgtcttgaaaagttgttgtagttattatttttgattagttcattatttagtctttctacttaggataagagtagtttatacaccaaagtaaagtgttacagtaatctgtgtttttctgtgtacttactattaccggtgagttttgtaccttcagatgattacttattactcattaacatcatcttctttctgattcacatactctcttcagcatttcttgtaggacaggtctactgttgatgaaatccctcagcttttgtttgtctgggaaagtctttatttctccttcatttttgaaggaccatttttctggatatactcttctagggttaaagttattttccttcagcactttcaacatgtcatgtcactctctcctggcctgtaaggtttctactgaaaagtcagctgccagacatattggagtttcattgtgtgttatttgttttatcttgttacttttaggatcctatcttaatcttcattttggggagtttgcttattaaatgccttgaggtagtcttctttgggttaaatctgctgcgtgtcctgtaactttcttgtacttcaatattgatatttttctctagctttgggaagttctctgttactatctcttttaataaaccttctacccccacttctttctctaccttctctttaaggccaataacccttagatttgccatttgaggttatttgaggttttgaggcctagattttgtatgtctgcttaattttttttcttttgtctcctctgagtgtatattttcaaatagcccgtgttcaagctcactaattatttcttccgcttgatcaattatgctattcaaagtctctgatgcagtcttcagtatgccaattgcatttttcagttctagaatttctgcttgattatttttaattatttcagtctctgttaaatatatctaatatgattctgaattccttctgttttatcttgaatttctttgagttttcgtggcacggctattttgaattttctgtctgaaaagtcatacatctctatttctccaaaactggtccttggtgcattatttagttcatttgataaggtcatgttttcctggaatgtcttgatacttgtaaatattcatcagtatcttggcactgaaaagttaggtatttatagtagtcatcactgcatgggctggtttgtatgtgtcctttttgagaagactttctacatattcaaaaggacttgggtgttgtaatctaagctatatctgttttagggggcacctcaagtccagtaatgcagtggtttttgcagacttgtatagacatcaccttgacggccttggagatgatccaggagaattctctgtattaccggggaatgagttttgttcttttcccttactttctcccaaaccgagtctctctctgttcagaaccacctgaagctgggggtggttgtgttctgttcccttactttctcccaaacagagtctctctctctgttcagagctacctgaagctatgggttgtgtaacataagcactcctgtgtcaaccgccactatgactatgctgggtcagccctgaaaccagcacagcactgggtcacccaaggcctggtgtaaccattccatggctactgcctatgttcacttagggccctggagaactacaatcagccagtggcaaagccaggcaggcctgtgttcttcccttcagggtggcaagttccctcatgcccaggtgggtctaaaggttccatccaggagccaggaactagagtcaaaaatctgagtaatctacttgctgttctattgtactgcagctgaactgacattcagaccacaagacacagtccttcccacttttccctcccttttcaaaaggcagaggagcctcaccctatgtcaactgccaccactggccacaagaagtactaccagcctactgccaatgttcccttaagttccaagggctcttgagtcaacttgcagtgaatgctgcctagactgagattcacccgtcagggcagtgggctcccctctggctcaaggcaggtccagaaatgccacccaagagccaagttctggaatcggggacctcaagaccccacttggtactctatcctgttgtagccaagctggtacctaaagtacaagacaaagtcacctttactttttcctcttttctcaagcagaaggagccttgccaaatagccaccacagctgggaatgtgcttagtctcacctgaggccagcaagtctcatgatctcacccaaggccctctgtgtagtaccttggtatcactgctggttattcaaggcacaaggtctcttcagttagcaattgacaaatcttgccaggaatgggttcttcccttcaaggcagcaggttaccttctggctcggagcatatccaggaatgtcatccaggagctagggcttattaagagggcctcgtgactctgacttgtctcctattctgctgcagctgagctggtatccaagatgcaagacaaagtcttccctagtctctcccctccacttctcaaatggaaagaaggggtctcttttggagtcacaactttttcagcctggagttggggaaggaatgatgtcagaactcccttagccaccctggctgatgtctcagtaggccatgtgccccccgacccaaccatctgtgtccttagttccgggcccagttcagcacaaggatccacctaaaagttggagtacttgtagtctttacagcttattagggccccagggcactttagactgtggtgatgaggtttgtgggaactcaagtttggaccactaaaatcacaattcccctcttgctaggactgacttaaatgcttccttcatggacaagcatcaactgagtttggtccaattttcatgtcttttataactagacagcactgtgatcaatgcttcacaactgctgtgatctttctcccctaacagccagagatgccatctgcaccacgctgcctctgctgggagatgggaaaggggtagcactggtgattcaaggctgtttttcttgccttttcagtgcttcgttcagtgatattaaattaaaatcacttgatttttagttcttatgaacatgtttttcttgtatagatagttgttaaatttatgtctttgtgtgggggaagatcggtgcagccttcttttccaccatcttgctctcctgtcacatttcatatgttggctcattcattcattcttccaaaatttattgaacatatactaagagaaaccctaagtaaacaaaataaaaggaagtaccaagccacttgatttaggctgtgggtatgatgatgaggaaggggagacaggtttgagtttttgaaagttattgactatgtgagagggtaagggagagtctataatgactaagtcctgaggttggatggctaggtagaagccattcctcttagctgagattgaggataaaagaaaaggaagagttggtggcaattaattcaactctccagaagtaaggaagtgtgtggcagatgagatcagtgtgggccacatagatggcaagattgtactggctgtctaggtgaagatgttcagtgggaaatagaaaatgtgaattttgctatcaggaaaggggcctgggctggagatgaggatttgctaagtcaggaaaggtcctgtgaggccataagttaggtgaaatcaagtgttatgcatatgctggcatataatttgtctactctcctgcaaataccactggaaactcaaattacacaaagtctaataaatccagggaagagattaaaggaataaatgaagtaatcacccagaaattctccaatcagaaaaaaattttgtgttgccttaaactctctttttaaagcatatatttatacctttgcttatgtattacctatacttgtgtatttgtgacatatataaagttatatatcctaacttttcaatctcacatctgctatcatacatctcttttaggattccactcttcatcacttttgtgtaaacttgagtttaccccaatacccagactcttatctgttctaactactatgtttgttctaagaagctggtaactccacagtaactccagagtaactcgagtttctcatgatatacagagcaagggactggaagaaatcatgggccctggaggctggacctccatgatgcattttgtgtctaactaagagacaatgattgccaaatatttagacatgagaccgtttatcccaattgaagccttccttacaaatctaatttataagcatgaagaagtctgagcactcagtgaagcagggactgcaagcccagagtcctttccactcatttccccttcttccccctcaggtcagtgggccctgttactcacagaaatcgagggagtatcctaagcactactgggaaagttcagtgctaaaagacacttcctcagacacggacttcatctagagttgctagatatcctgaatacacaggatatgtactctatatgattttgtcatgcatcttgtgttgactttatcaggaaaccccaaatgtcctgtatttggcttttttaatttaacaagttgcaaacattcaacacttagagttactttttcaccacagtaatcagcaattaaattacttaagacaacattagctgaaattatacctcgacaaataaagatctgggttctcattcaggtttagttgaaggaaaatcagaatcagtgacttagaattaaaggaaatattgatggaaggaaacgtctgttctttgccaaagtcccaagtcacgaacaagtaaccaccattaaatgaaattactaatcagtatcatgagcctgtcaatgacagcctcactccagtaactaagtttctgaaagtgagcagatcagtgactgccccaagacttctgaaaagcagccaatcactgacaaagctctggtcccaaaaggtagccaatcagtgacagctgctcacttcttgacagaagcagtcagaaagtctatctgttcactggctttgcttctgaaagtccaccagaacacagcagccttagtctagtgaccatggaaacacagctgaaagtccgtcagtccctaaacactaccacttctgtacgtctgccaacccctgacaccccagactaaccaaaaccttatataggattagctctggctttgtttatgaagtccgtgcctaacaagttcagttctctctacgggaaaaagggtagttcaccttttattgcatcagatattcaattcgttagttaagcttacagcctttccaccagtcaatccctatttacaaacttgttcagacttgtgagtgacagacacactggccagctgtgagatatttatttatttatttattttgagacagagtcatgctctgtcacccaagctggagtgcagtggcgccatctcagctcactgcaacctccacctcctaggttcaagcgattctcgtgcctcagcctcccaagtagctgggattacagatgtgcaccaccgctcccagctaatttttgtatttttagtagagacaacatgtttcaccatgttgaccaggctggtcttgaactcctggcctcaagtgatctgcctgcctcggcctcccaaagtgttggggactacaggcgtgagccactgcacctggcctggctgtgagattttcaaattcagtctttcattcttgcaatttttggtatcatctctctttatttcatgtctatttgaaccttgcgatgcccaaacacaagtgcaaaaatgatgaaatttatgaaaagttgacatctattaaataaggaaaaagtcctttaaaagctttttgtgcaatacccaattgttcattcaatacagaaaattgtggaaattcaaacaatcatatattatcagctgtgcatgaattcctcagctagttccaaagacaatgataaaatagcaaatttttaaataacacaatgataaaataacacatttaaattaagaagactatcacaatagaagttgtaatgacttttcacactgtatataaccatcagtctttcaactcaaactggaagcaaattttcaagtgccaagaccaaatctactgcaataataataatgacaaaaaataatagttttatttactgttacaacaattatcaaacatctaaatgcctcacctttttataccatggccacagatgcatataatgacattacagaatacatttttcctctgtgaaattgttttttcataaaaaatactttctcatcaggctgctgtgagtaaagtttttgacagatgctattttagaaacaatagctaatttccagccctatctaaaaagctaagtgttaatgataacatggttaaagttgaagcaaagcatgcatgattctttgatgaatgttggctgtgttgcccatattctgcttaatgcctctcaaagagcatctgatgtcctatatattggtattgaagtaatagtcataaaacagctctcttacttcagtccttacattttttaacctgagagattataggatttttgtgattttgttagaatgcaaactttttcaattcctattaaaaaatccattgactttcttgtacaaatgcatttgagagaatatttaatttatttgaagctctgatgccatattaaccatattttgattctaaagaaaaggccctcaaaattcgtgtcggcttttaagattagctgctgagcaaagcctacttatttattcttcatcattttcagtatctctctagcaataacattatatgcaatgaaaaaaaagtattattgatgtagtccattgattaagagaacttgttgaatgtgttaaagaattgatgaaaaatgaattgctttaagtatcaaggctgttttttcaaatggacaacattacttgtgaataaaaaaagaaattttgacctgaagttgataattattatggcatttgtcaagcctatcattttaattggatttcaccactttaagaatttcatttagtaacatgtatgtcactaagtattcttgcagcatgggaccaagaagacggggataacaattgataaccatgttttcttttgatagagaacattttttttaaaagttaagagatacaacacaattctgaagaatggaaaagtaagctgtgccatgaaagaattatttgcttcatcaaagcaaatttgaagaacagttcttagaactgttaactttgggccagtacatattcagtataccagctcataatgctaatgttgagcatattttctcattaatgaatcttcaaagggcaaaatagtgaaataagttggaagggacctctgtagaagctactatacaatgtaaatggaacaaagactaactgcaagaaatgttataagcaaattctgcaaaacaagaaagtgttaaagagaggtaaatcctgaagaaaatataattaaagagaaaggtagatagtttagaaatttataatttattttagataaacatcaaataatgttttagtataagaatatcacatacatttttcctttatcttgatgtgaatatgcacagacaatgttatgggctgaaatatctttctcaaaaattcatgttaaagttctaacccccagtacctcatattgttacttatttggagatacggtcttaatttcctaaagaggtaattaaattaaaataaggtcattaggttgggccccgatcttttatgaccagaatactaataataaaaggagattaagacatctacacaagagtaaagacacagggagaagatggcatctaccagccaaggagagaggcctcagaagtaatcaaccttgttgactccttgatcttggactgctagcctccagaattgtaagaaaattaatttatgatattaaagacacccagtctgtgatactttgttatgggagccctagcaaactaatagagacaatgggaaataattcaaatttaactaggcaccttgcattttcatttgctattttttgtagccctagctgagggagaatgaaaggcaaagctgcctcacactcttctcaggaaatgcagcctggatgatgaacaaagatggcttcataaaaagtggtctcaaatgtacaagaaaaagtgattataatctcacacacacttttccagaggataaaatttaaaaaaaaaacttcctgattcagttttatgctacaagcatcctgataaagaaactcgaggataaaagcacaaaaagagcaatttataagccaatttatcactcatgaacatagatgtaaaaaccctggacacataataatagtaaagagaatctgcaatatatttatatatattgcagatacacaaacacacttagaacaatctaatttatcattagaaagtcagctaatataaattattgcattaccataagagaaaaaattcacgtaattatatgaaagaaagcctttgtaaaattgaacatacattaagcattgaaaaaaacgacaaactttttaacaatctagtaatagaaagttcttcaacctgctagagattattagtcaatgttaaaattttaaaagatatcaattgaaccaatgatgttttttatggtcattcaacattgtactgcaggtccttactgccaccgtaaggcaaataccataaacaaaatatattgaacttgtacaggatgaaacaaaattgttattattcacaaatgatataattgtacacatggataatctaaaataatctgaggaaatagatgaaaaacaattagttttccagatactaattaataaaacaaaattaattatgtctacatatcaggaaagaagcttaaatataaaattaagaagtatcatctgccatgggagtaaaaatgtcaagtacttggaaaatatctaatgcaaaatgttcaaaacttttacagagaaattttgtatcctttatgagggacattttagaaaacctaaacaaataggaagatataagttttcatgaattgaaatgcacaataacaatacctcgttatatggtctccatattgtgtttgttaaataacttaattcttacaaagttggatgaaattggttaggtatctttgccttaagtttgaagatatagaaactatgggtcaaaaattcaagtaacttgcctaaaagcatatcgttaagcagcaaggccagaacttgaatatatatgtctgtctcaaaagtccctgcttttttcacaaggccagtgaagtagacactgtcagtgacctgcccaataaccctcatatacctcttaccagctttgtgtgtccctttccaagtttctgcatgctttgctgctgaggcgtcatacatttaaccctcagaggattccctttgggcactggaatcttcttgcccacagagatagaaatgtttagtaatttggtacacttccctccaagtctccaggtaatccattgtctcctttcagtacagaaaactggaagtgcctaggaattttctattaccacatccaatcccatagtagtccatagccagtgactgaatgatttgacattatagaagcctgaaagccaaaatacttttaatgagtactttttttttttttgaaatggagtctcgctctgtcacccaggctggagtgcagtggtgcgatcttggctcactgcagcctctgcctccttggttgaagcaattctcctgcctcagcctctggagtaactggaattacaggcgcacaccaccacccctggctaattttgtattttaagtagagacggggtttcaccatgttggccaggctggtctcaaactcctgacttcaagtgatccacccgcctcggcctcccaaagtgctaggattacaggcataagccaccgcgcccagcctgatgagtaatttatgatcttgagctccctgagggatagtgttgagtctgagacctcacctgaaattatacagttacctagtttcttccccttttctatcatcaatccttcaatcccttgataatttctctagggagcaaattcttactaaaacacttgcatctgaaaccttggcttatctgggaaaacatcacttactaagctgtaagatatatttacttcaaattcacaatctagatatacacccccaaattatgtggatgtgctcattatatgagctttattaaatttattatgaatgtggaatttgacatagtaaagtgattattcaattcagataatgtttatataattattatagtgatttttacctggtaattttatctacctggctttcagttttctcctttgataaatgaatgtattgagtcagatattctctaaggcagtaggttttaactgggggtattttgtcccccagaagacatttggtaatagctgaagacatttcaggttgtcacagctgaggagaagtgctactggtacttctagtgggtaaaagccagggaggattctaatcagcctacagtgcccaggacagcccgtcacaaccacaacaaaaaatccaaccccaaaatatcagtagtgctgaagttgagaatacctgatataagattttatcttcctctaagattcaatgaactattaattctagttcagtctacaattatgtcaattaacgtattttaattctataagaaacaagtcagcttagtgagataacttagtactaaccagttacttattggtttgtttataagcaggtgatggtcagttaaggtagagtatctttgaatggacatgcaaatttcgtaacttaacattcaatgacctgcttactgctctagaaaatagtttttagaaaatgtggagcaggcagggcgtggtggctcacacctgtaatcccagcactttgggaggccgaggtgggcagattatgaggtcaggagatcgagaccatcctggccaacatggtgaaaccctgtctctactaaaaaaaaaaatacaaaaaattagccgggtgtggtggtgggcacctgcagtcccagctactcgggaggctgaggcaggagaatggcgtgaacccaggaggtggagcttgcagtgagccgagatcgcaccactgcactccagcctgggcgacagagtgacactctgtctcaaaaaataaaaataaaaataaaagaaagaaaaaaatgtggagcagaggacagagattacataataaaagtaaataaaatgttattttgtaacatgaagtggcatgggcaaattaaacaccacatgtaatgtgctgacgtgctgtcttagtccactttgcactgctataacagaataacacaaactacataatttgtagtgaagagaaatttatttttcacaattctgaagactagaatgcctaagattgaggagcctccatctggtgagggtcttcttgctgtgtcagaaggcaacaggtcaagagagggacagagatcaagagactaaactcacagcctcaagcctgtttgtaatcagcattaatccattcatgagggtagaactgtcatgacctaaacacttcccattaaattctacctcctaacactgttgcattgggaattaagtttccaacacatacattttcaggaaaatattcaaaccacagcacattaccatcttataacacacaataatcataggcagtttaattaaaacgccatatgaagattgtgcactttttgacttcttaatctcagtaactcagagaaactaatttaatattctaatttactgttcttaatagaggaggtttccagtgacagttgccatgtaaaggttttatggaacggtgaacacattaaaagtcgttcttgttaggagtccttttgctatatttaccaaaaaagttcctaatgcattttgttacttatcgtatatcataatcctcatgaatcacatgtgtttaatgtgccattaaaacaccctaaattaaatgatgaaatgctatcctgtctagttctgtattttacccattttaaaactcattttctttgtaatgaagcataatttagagccaaatatgggaggaaataaagaaaaattattgacatcccataatggaattaattctacatactgtataaataatctatttctacaaaaccctcattttataagaaatagggaagcataaggaaggacaaattatttggggttaataaaaaaaagtatatgaaggtgaataaagaaaatgaaatgaagacatagaaactgaatttcacaggtagaagcttggttctacaggctggctttactcttgtctccaagttcaaaaaagaatgcataagcctaaaggtctataaaatgattccatgacaaatggattagtttaagaaactgctttatccaaaaacaacataatgatgatataataggctctcaaggggcaaatgaaaaatgtctcactggccttgtgtttaatattggagcattcaggccgttggaaatcaagataagaatatcatgttttgtgtctttcccaatctgctacttgctatttcatcattatatttatgatcagcaggattttgtgaattgtaccttgatgatcaaaaactgaaaatgcaaagatatgtttatatgttatagaaagatacagtatagcagtattcaaactatttatttatttaaaatatttcttatgatccacagaaagaatggcctaccatctctcataagcagtacgtagctcatttattgtgcatctcaataaccttactactcaagataatttttgaataaaaatatttgtgagtattttaaataaatggttaataacgttaattttaataaaaaagttctatctacaaaatgtacatagtctgtaaatgtagaaaagtatattgaatatcattaaggacatcttcaccttgtaaaataataaaataatgttatctatgtttacagattttattgacactgacacagaacagtatccaaagtgtgttattaattgggaaaagccaacagcaaaacaatatgtactactatatcattactttaatataatagtcagatacacatatttatccatatggagatgagaaaggagattgaagtaaagagataactttattatgattgtatgcttgaaatttttacagtgagaaaacagtaatagagaatcactccagtattttcactcttattagtagtaaatcacttgcaaaatactttacccctgaaattggtacaggtgtgtgtgtgtgtaccaggatgaaaatagatgtcctgtgaaggatccttgtctaattgtcagagatctgggtcctaatccttcttttggcacaaactgcttggcagaccctgggaatgtgctccaggctctccatacatataatgacaatttctaaggtcctgtcccgctgtactattttaattgtttataaaatgatcagaagtcaggtaaaaacatgcatcaactcagtgagactatgttggatcttagaactcttcacttcatggttgtgtcacaatattctttttgagaaagtgaaaaggtcaggagttcgagaccagcctggccaacatggtaaaatcctgtctctaccaaaaatacaaaaaaattacctgggcccggtggtgcacacctgtagtcccagctactcgggaggctgaggcaggagaatcgcttgaccccaggaggaggaggttgcagtgagccgagatcgtgccactgcactctagcctgagttacagagtgagactccttctcaaaaaaaaaaaaaaatgcttccaatgggatatagcatttttgtatacagtgcttatacaaaaggccacactatagctgaaaatatgactaatcatttttttctctgagtgattatcactttcttataaatgatgtccccaagcccgtgttgttttcccgatgtctgtcttagtttattgtcttctgctataacagaatagcacagactaggtgatgtataaaagaaagaaattattcttcacagttttgagggctgagaagttaaaaaaatgttatcagcatctggtgagggccctcctgctgcatcataatatggtggaagggcaagtgagcatgcgagagagggaaagaggagatcaggcagaaaccactcttttatcaggagcccattcccatgataacaatcccactcccacgataatgacattaatctattcatgagggtggagcttcaatgagccaaacccctcttaaaggtcctacctcacaatacaattatattggcaattaaatttcaacatgcttttggaggggacatacagcaccacctgaacaatgaataccgagaatctgattgctaacctgctcctccttgttgacaagaaccaatccaagccaggattcattccatatctgccttgggaatatcaagcacaagcacaaacatataaacaactcctgtgaaatctccattactgaggtgccccaagttcctatttgggggtgttcttatttgatgcagtccactaaataaacctgaccttgtttgactacagatgcgttcctgcttgtctttgactctcaggctatcacaggtccttttggccatcagaaatatcattcatataacataaattgcatcttctgtcaaaaggcacttccttcagtcaagcaaacagcctctctttgaaatcctattgaaataaaacacacaaacaatagcagagagtgattaatccatatccttgaagacagtttgtttatattctcaaattctcttcccattacccatacctacaacacttcattaattgcttaggaatttttttcttttacagataatgttaaagacatccacaaattgtaggcaattatatttgaaatgttaggcatatccctcaagagatttttattcattatctattgctatgcaacaaattactccaaaatttagtgatttaaagcaacaaacatttattatctcacagtgtccataggtcaggaattagacagcatgttagatgggtagtcatggctggtcaaggtctttcatgaggttgcaagaaatctttccttgattgaaaccaaaataaatgatttaatgtaaattaattgtttagaagtttattttcttattgacgaatgtgccattgaataattgtaatcaagtcgcagacatttaaaaagtatttttcctatgtacagcacaatatgaaagcctcataaaagtactatgaattcatttttttaagatgaaaaaactgaggcttacacagtttagatattttgtctttcataatatcaggatataaacataatttcataatatcaggatataaacacaattttttttatcaggatgtaaacacaaatttaactaaagacccaaacagtactttctgtacaagatcagaactttcagagaaaataaaataattgtaaagaataaaggcatagagaaggggcagagagagagagagagacaataaattgatgtttattaactggacacttaatatgtagcataaatattttatacatgatctaacttaattaagtctactgtcttatttaacaaagtctatttacaattcatagtccagaaatatctcccttactggtgaaaattacaataaaaggtttttcaaataaacagaaaactcaagtcaaaattatcttctccatgtacaagcactgaggtccaaaggggaagtcattatattttgtcttggtatctttatcctcactttcctatgacctttttcttcagaatacttttgtttctcattttctttccttctgtagaacaaaaatgaagtatctgttatttatacctttttataaaatgcctacagggaaaagaagttttgctgggggtaagtccccaaatctggccataaactggccccaaaactggccacaaacaaaatctctgcagcactgtgacaggttcgtgatggccatgacgcccacgctggaaggttgtgggtttaccggaatgagggcaaggaacacctggcccacccagggcggaaaactgcttaaaggctttcctgaaccacaaacaatagcatgggtgatctgtgccttaaggacatgttcctgctgcagataactagccagcaccccttcctttgttttggcccatccctttgtttcccataaggaatagttttagtaaatctataatctatggaaataatgcttatcactgacttgctgtcaataaatatgtgggtaaatctctgtttggggttctcacctctaaaggcctgatttccaactccacaccctatatttctgtgcgtatgtctttaatttctctagcaccgctgggttagggtctccacaaccgagctggtctcagcagagtttcagtcaaattttttttaatttcttctcaacattaggtttgtgagacccttatttctaaatgtggctattcagaaagcaagaagttaaatatttaaagaatgatacatcaagtaggacctaagacttttaagtatttaatgtgaaaaataaaattaaagtatacttaatttcaagtattactttcaacattgaaagttataaatattagagaaagaaaaaacactggaagtatagtttatgtgaaactatactagaaagggttgcttgtgtgactcacatatgcagttttaaataggtgtcaagtgaagctgtgcacattttgtttgcccacagcagtaaacattaggctaacagtatagtcaaaggaattcaagatttggactcagaaagaaatggcttcagattctagttttaccactaccagttatgtaaccttgggcaagcttgttaacctgtttgtgactctgtttatcagtaaaatgagagaaataataatgcttaatttttctggttatggcaaaggttagagctaacatagataatttgcctaatacagagtaaaaacttaggaagtgagctttaatcagtcttagtgtacatttattgatttggttacagaaaacgtgctctttagctagaaagatgatcccctatcccttcttagctactcagttcttagatggacagtacttgcaacttccctccccatctgtcaatttatctacactcagtaagtgcaaaagcctgaatgtgctttcagaaatatatttccttagacaccaagcaatagcttcctttgtgtgaagtttccagatgtcaagcaggcttacctcacctatgtatctggttagtagactgaaaatcttagatgtttatttgctcaaatgtgagcaatacattcaaaatgagttcccatttaaaattctaagatattcattttggatagcttgacaaaaaatggataaatatgtttgtgctttcaatcctggcaatacaaaaaggtgatagacaagaaacattattttacattttatagatacaagattttatatacaatcagaaaaataccccataaaaattataactaattcttaatcagtttttaaaatccttttgtataaatagcttccaaagaataaatgatatgttgatagatatttatggactaataattttattacttaaatgtgctcaatcataaactgtgaggatatagaaagataaatatcccactacacttaaaatttataaaagactgattaaagtcagtagagactagtttattttagcactaggaaactttataaagtctagcctgtttgaagatgcaaaatttgagaaccattaaagagatttgcactctttcagttccatcaggaggaattcaccaaccaatggggactccactcagttacatactagtttatgttttaaatcctttggttattctgtatggagagaccctttcacgagtagtgatttttggcttttccccaaatcccaactctgtagacttgccctgcagtttcagaacttgaaaaaggtacattacaatgggtccatttctttttcttcctacaaaccagtattcaaagcacatgttaccatggagttcatcctgaaacatttataccacctaaatcttcattacccaaaatccaaactagcccaaacactgcaatagttctgatagttctgcacaatgctgtgaatattcttctcatatcttcctgccttctctgtggttataatgcacccttctgtttatttatgtggtaataacccagtgcagactaattactatgaatgagaaatttggatcttagtcttgcacccagaagcagtgggtaatactagaactacctatagaaaatcaattatgggccaggtgcgcctgtaatcctagcactttgggaagctgagacaggcagatcacgaggtcaggagttcaggaccagcctggccaatatggtgaaatcccgtctctactgaaaatacaaaaattagccgggagtagtggcgcacacctgtagtcccaactactcaggaggctgagtcagaagaatggcttgaacccaggaggcgggggttgcagggagtggagattgcgccactgcgctgcagccagggagaaccagtgagactccttctcaaaaaaaaaaaaaaagaaagaaagaaagaaagaaagaaaatcaattatgaagaattaaatgataaatgtgataaatggaaacagaaaggtctattttttaaaaaagtaatgtaaaagaattgagattcttgctaatcctagatgttggttgcatctgttgaaatgtaaagttctgaagaccttattaatcactgtatcatccatattccaacatcatggctggcatataagtgggactgaagcaaatcgaaattgttctcaagccaaaatgaattcttgtctagaaaggaaacattaactaaaattcatagaaatttagtgcaaatctaactttgattttagtgccagggctcccggggtgtttggactgagcaactttttgaaaacaaccaaaagtgccagatgaaatataaaaagtaactttcttaaaacactgacaagctgataaaacaggaaaaaatgataaggctacatctaaatgtaaactggaactagataattaatttgagcatggaagctgattttactctgagagcatttactaaatttgacgttaagttttcaaaatcctggtttagggtacaaagtgccaagtgcaggcctgcccaagcctgaagactaataggaattcttccctcataactcgttttaccacatgggctaccttctcaggatgagggaaaattagcagtaaagttctctcacaccctacatactctcaggaactgcaaggaatgctacttggagaatgaacaaaagatggcttcagaataagtggtctcaagggttaaaaacaagtaattctaatctctcacacacttttccagaggagagggaaaaggagcgtgccagacttggttttatgctaccagatgcctgatagagagacccgggggaaaatgtacaagaatagtaaattataggccaatctcactcatgaacattgatgcaaaaattttagatatattaatagcaaaccaaatctgtgatataaaaagaataatactcttggagtaagctaatttaccattagaaaggcagctactataaattattgcattattctaagagaaaattcatataatctttataataaaacacttgataaaattgaacacacaggcaggatttaaaaaggaaaaaaatcttcttcatgacttaagaatagaaaggaaatgttttaacctgctaaagagtgacactttgaaagatctccatttgaggcgaggatgctgtacacaactattcaaccttatcttgcaggtcttcacctccaccataagacaaagagtaaaaacaaaatatgttgaaattataaacaattgtcatttttacaaatgatatgattgtgtatatagataatacaaaacaatctgcagtaaaatgtataagaaataataagaaagttaattttttaggtatttattccttataacaaagttaattgcatatctatttacgaagaacaagaatttaaatataatttttaataccatttacaataagattaaaaatagcaagtatctggaaataaatttaacaaatatttatgtgaactttacagagaaaatttatggaattaagtcaagaaaattaagaaaatcattgaatgataagacacacatttttgtgaattaaaagctcaatattgtcaatatatcaattctacccaaattgttttatagagtcaatggaatccctgtggaacccccaacagttatttttataaaagatggaaagctgattctaaaatttttatggagaaaagaagtgttaaggacagtcaagattcccctggagaagaacaagatgtggaaattgcctactagataataagagttgctattaaaactatggtaatcaagaatatgtgaattggtggttgggtaaaaaataaaccaaacagaatagaagagataacatagaaacagaccaactcatatacggacattcggtgtatgatttaaaaagggacatttgttgatcaacagagaagaatggactcttcaagaaatgatgttggcttaatttggaatccaagaataaagaatacaaacttgaaacaagacaagaatatcctcaatcaccgctcctattcaacatttctctctatgtcctagctagttcaataagacaagaaaaaaaatttttttaatgtacagtttggaaagaaaaatacaattatctctatttgcagatgacatgattgtctatgcagaaaatataagaatcttaaaaacaaaacacaataacacaactcctggaatgataagcaagttgagcaagggctcagaaacaaggtcaatgtatgatagtaaatggctttgctatataatagcaatcaagaatctgaatttcaagttaggaaatctgaaatatttataatagctccaaaacatcaaagcactttggtataaatctgataaaatatgtttaagacttacacaaaaacctgaaaaaacactaatgaaagaaaccaaagaagataaacataattagaggaaatttgtgtttatagattagaagactcaatatagctaaaatggctattctttccaatgtgatctaaagatttaatgcaatcccactgaaaacctcagtaagcttttttaatatacaaagatatccacaaactgataggaaaatttatatataaagacaaaactactaaggctgggaaaggtggctcacacctgtaatcccagaattggggaggcctaggtggcaggattgcttgagcccaggaattcgagatcagcctagacaatatagtgagactccacctctacaaaaaataaaagattagctgggagtggtggcacacacctgcagtcccagctacttgggaggctgaggcacggggatgacttgaacccaggaggttgagactgcaatgagctatggtcatgccgctgcacttcagcttgggcgacagagtaatatcctgtatcaaaagagaaagaaatgttgctttacaacaagataccacacacttcgcaacttaaaatagtgtctacttattagctcactgtctataggtcaggtcaggagcccaggcacagcatggatgggttctctgctcagggtcacacaaggctaaaatccaggtgtcagtcaggctgtgttctcatctggatctcaggattctcttataagtccatgtggttgtggtggaatttagtttcttgcggtttaggactgggtccctggttctttgccaactgtcagccggtggccactctcagctcctagaggctgcctacattcctttccatatggtctctccatcttcagagccagtgatgaagactctctcttgcatcaaatccctttcactttttaaatctttctttatcaggaaggatcatatctcttttaagggctcaactgattaggtctgacccactattttgaactgaattctgtccttccacccccaaatttatatgttgaagtcctcagcccccaatatgactatatttatagataaggcctttaagaagataataaaagttacatgagatcataaaggtggagtcctaatccaacagggatggtgtccttataaaaagaggaagagataccacaggtatttgcacacagaggaaaaggaggcatgaggactgagaagattgctggtcaggaagagaggcctcaccagaaattaaccctgacagcaccctgatcttagaattcctgcctccagagttgtgagaaaaaaaaaaaagaaagaaaattctgttgtttaagctacccagcctcatgttctattatggcagcctgagcagactagtatacccactaagaataatctatctttctttaactgtgctatttaatacaacctaatcacaggatatcccatcatattcacaagtttctcttactctcaacgcctggagattgtacaagggtatggataaataggggtcatttgatttgtctgttgcaatgtcctcatttgtaatagaaaagaaaatggaaacaattcaaatgtccatcaacaggagaatgaataaacaaactgtggtgcgtccatacaacaggataaaattgaagaataaaatagaagaactactgtcacacacagcacttagagaagtgccgagtgaaagaagccagtctcgaaaggttatatactatgctattctctttatatagcatgtggcattcagaaaaaaggcaaagctataaggttagataactgatcagtggtggtcaggggttggatgggagtatttgacttcacataagaaataggaaggagttcactgttttgataagactgttttttatcctgattgtgatgtagttacacaaatttatacatgtgttaaaactcatagaactgtagaaaaagtcagttttactctataataattttagaataaaaatttaaaaataatttgcctctaaggatacctgataaatttcatgaagctccaaagtaagactattgttaacgttttcatttactgagaataaagagcaaactttaaagccacagatttgacattgaaattattaaaattaaaattcagaaaatatttagtgataaaaaactatgggattaataatttaaacttcttttttattacaacaaaatgctaagttttcaagcaaaatcctcaggtaatggctgccattccaatccacattaaaacatggccaaatttaccatccaaaaaaggagtcctgacttttaataaattttcatgaactacacctagaaaatgttacagcgtgttaatccagctactcattcatgctgttgccacatttctgttagtgacaccatcatttctacacagaaacacaaactcattcatgctgttgccacatttctgttagcgacaccatcacacttctacacagaaacacattttatttcaaagctaatatcaaattaataactgcaagtgttatattgctctaaaatcaagaaagtcaccacagttgtccagctgatgtattaatgaggaaattaattctgccagcaacatgaaatgcatttaaaaaaatgaactttgagcaacctaaaagtcaactgatcttcatttcacttgaatttacccttgttgcactgggacctctggctggggaccagcctgttgctactactgttattgtgagacttctagcctgtgtctttaatgaggggcagatgattggaggagtctgcaaggctttccaaatacgtttttctttcctcttgtacagctcctgtggagcaagaacctgaaaaactactactcttatatgaatgagacaggtatggtaaattcatgcctttgtgaataaaagtgtaaagctagcaaccaatttgtcacttagaagaagctatatcaagatattaaaagcaccatcttcagtttaaaggggtccactttgtccaacttaagaacctccactaggtcagggagtgttagtacctgaaagagctagatcacagaggagaaatgtgagagaagagtcaggaaatggcaacaggattccaaggtacagtggataagggtatggatcatactgtaagctgttctttcttactgttctttctctcttggttgtgaagtatctatgttgtctgttttcattgatcaaataatggcatccctacaaaaattcactttacccattgctctgtgattatagtagagctggtgtattgtaacatgggccttcatttatccctaaggtagagaacaccaacatttttgcagagtaaatgaagggaatacattgaattcagaagagattacctaataaatgagtgcaccaccttctggagcattgtgtaagtgtagattgagtataaatggccttcagtggagtgtgtaaataattcattaggcaggaaatgagaatcagccattttactattagaaacatagtgatattccttttttctttataaggaaggctttcatgacagatgagaatcattcatctcatcaaatgtcttttctgccttttgaaaaagtgcaatgcaaatgcattttcccttcttcctctttatgaatgtgaattcttattacacacattttattgttggtagacagaaactataaccctggctttagaacgaacatgacactctccaggggtttactataaataaagcgtgtcttgtcacttctctgaccttatatgtaacaatttagccccctcccccaacatattaaggtttaccacccaacacttctagcatagggttttaattcactacagtggaaaatggttttgtcaaagtacctaaactggggaatctgcactggagcagcatcaatttactagattttttcccagtttttccaaccaataaatagtagtttccctaaaattgcctgagagcaatgaacacatcatcatgtatatgcatatacacgaacacacacctatgtatatgttgtgttaacatttttcaaatttaaataatgttaagagaagattcattaacttaataattggttattatttctttagcgtaagggagaaaaaggaaaaaaagagagggattaggacaagttaatttgaaaaaataagcctaggagagggatgtcatgagaaaatctccccctctggcttgcagagcgtaccaacagagctgctagtaaatcttgcacaagagattctgggaagatggggctggaaaagttctcagatggcagcaccacatccaccgagtcaccaccacattcacccagcatattatggctcacagaagcctcctagcattatgttacaacaaagtgtttatcagtatctctccttggattttgtgattactaccatttttgttttattgttttacgttttctatgatgtgcaaatgattcaaatattaaacatctttaaaactaccattcagactcttggagttgttaatatagatccaatttactgtcactttttagtgagttcctcctcaaaactgttagcactttaacagagtgacatttattgatttatcatgattatatgaagaatattattagggaaattagataacgtagaagggcaaaaacagatactaataataatggctaagtgctttatttgtgcttgaccaattttaagtattaaatgcattaactaaggccgggcggggtggctcacatctgtcatcccagcactttgggaggccaacgtgggtggatcacctaaggtcgggagtttgagaccagcctgatcaacatggagaaaccctgtctctactaaaaatacaaaattagccaggtgcggtggcacatgcctgtaatcccagctactcaggaggctgaggcaggagaatcacttgaacccaggaggcggaggttgtggtgagccaagatcacaccattgccctccagcctgagcaataagagtgaaattccatctcaaataaataaataaataaataaatacaaatgcattaactaatttacccttcactcaaccacatatgtaggtatatcattatctccattttataagtgagaaatcagaggccttgaacaactaggtgatatggctatggtaaaatagatagatatacagccaggatttgggcctaatgagcagagctccagagcttgtgcgtttaaccactttaattcgtcttaaatatgcgtgggtgtatgtatgtgtgtgtgcatatgtgtatgtgtgtgtggatgtgtgtgtgtgtgtgttgggcacatgactagtgggtgcgagcaatatataacttaaagtttgtagcccgaagctgctttaaaatcctgtcaaaaggatcagtatggtattcttcccttgacactagatggacattttggcagattctattatttttctgcatcttctgtccaacgaaatctctcaatataaagcccttacacttacccactgctgcaatcaaaatcttcccctgtctatatctaattcatcctggattttatcaaacatccaatagttttatctatctgaaaagagaaatttgtattttcattttgacttttttctttgtgtttaagtttaaagcatcttgtcataggcttttcttttttttaattttcttttttttgttatactttaagttttagggtacatgtgcacaatgtacaggtttgttacatatgtatacatgtgccatgttggtgtgctgcacccattaactcgtcatttacattaggtatatctcctaatgctatccctccccccttcccccaccccacaacaggccccagtgtgtgatgttccccttcctgtgtccatgtgttcccattattcaattcccacctatgagtgagaacatgcggtgtttggttttttgtccttgcgatagtttgctgagaatgatgtataagataactttccatagtaaggatgttcatcttctttcatgtatggtgcaaatattttcctgggtttttaaatttgttttgtgatttatacttggatattttcttctatatagactgttactaacaatcatttttttagtagcttctgcatctgccttcaaatattaagaagtttttgccttcagtaaacatttattgaaataagatatggacccctgtggagcttgtaatccagtggaaggaccagagatgaagaatgatcacagcacagtgtgacaagcacagaacaaagtgctatggaatcaaagagagaaactattacattcaaattgttacattattactagggggttgatagttacagagaatattttcatagggtttaaaatatggctgacagtggagtgaaaagagaagcaatagaagggagcagcaagaagtgaagctcaagcagcagaaagaagccaaattgtcagacacatctttttcctcttgaagatttggatcttatatcatagtgatgagaaaagggcctactccatgcattcttgtctctcatttgctccaactccaaccttgactttgctctttctctctatattgaaccaccaatgattccttaagatgatatgtgttctcatcctgaattttgcacacaatatcttaatctttgtgtgcacttatttttcactggtctgtatggccatgttcacatctttatgctttcccctcctcaaatggaacaactgttcccttcatgaactagcattctccctgggcataagccttccttagcatccagtacctgagctgtaatcattttcactcacatgtagcaaaaggctaagctatttgacataatgtactttcaattccacagtagtagcaatgcttaacaaatagtaggcactggatgagtctttactaaataaacaattgggtgaatgagtgagtgagtagtttaattggaatactgttccggctgaaccatggagccatggacttgaaaggacaagttgtccagatgattttactctgctggaaatttcttgaacattctctaagagaaacttctttactatggaaaataaggctctctcactaaaagattactatatgcacagatagttagattaaataaaatatagtctgtatatacacggactctagaaacaaggatataatatatggattttaggaagtctacaaggactgggtcattaggcagtaggaaatggggacacactcacatcaagggagtggcatgattagaactgtagcagaggcagttaacggggtgaacacattagatgatagttccaaagaagaagtaataaaggcaggaactagagcactagcagtaaaaacagacagataaagatggattttaacaattaacaaatatttattgaactctgaaaacactaatgtgaatactatgaagaaatttttatagtattggttggtaaattatgcttagtctccaacgtttctacattctgaccttgttctgtgctctgcggggctgatctcaatggaaagtgtctctggatttcccttatcccttattggctttgactaactggggggcggggtaccagcaggagacccaaaggaggaaggtgaagtatttacctctttcccaccctagctccttcttcatctcacttgggttttggcagcagcagtgtcctgccaaggccacagcttattttcagaagcccctagtccatataaccagggatcatcagactctgctaacaccatgctgcctcaagcatggaagacaatgtctatcaactgaagctagtccttggggaccttatggttcttagttgattctataaacctttccaaaactgtggaaactgtcccttcattaaattatgttcaatttgaccgtttgagggaggctttatctctccctctgggagcctgtttattactcttataaatccaaaggtacttttaagaaaatagacaataccagctatggaaatggagctatcattagtagaatttaggtttttaattatttactaataatcgccacaaagataacacactaatgttatttgtttgtgaacaaactgagcagattctgagttctctaactatacatcccttgccctctattttcaatggatcaccctacaaccaagcatcttaaattctgaagctctggccaggcacggtggctcacgcctgtaatcccagcactttgggaggccgaggtgggtggatcttgaggtcaggagttcagggccagcccggccgagatggtgaaaccccatctctactaaaaatacaaaaattagccaggcgcagtggcaggcgtctgtgatcccagctactcgggagtctgaggcaggagaattgcttgaacccaggcggtagaggttgcagtgagctgagatcgcaccactgcactccagcctgggcgatagattgagactccgtctcaaaaaaaaaaaaaaaaaaaaaaaagttctgaagctctgagatcatctttacatataatttctttccatccccatgaatagccaattgacaagactagtcatctttctctacagcattgctaaattttatgccaagccccttattcaagtctgaattctgattctctctaaaccacaccatagcatgtcctgaacttgaaattgttttttaactgttgtttcaggtatgttgtattgttactcacagaagtccaggagcatcctggggttagatacaaatttgtgactaactttcaaattttcatctatatttcagtgttaataatgtatttgactttatttctccctcttttcaccctgtgtgatcgttaatactgttaacttgattagattgaaggatgcaaaatattgtttctgggtatgtctgtgaggttattgccaaaggagattaacatttgaatcagtgccctgggagaggcagacccatcctcaatctgggaatgcacaatctaatcagctgccagcaaggctagaataaagcaggcagaagaatgtggaagaactagactggctgagtcttccggccttcatctttctcccatactggatgcttcctgccttcgaacgtcagactccacgttcttcagcttttggactcttggatttacagcagtggtttgtcagggactctcagacctttagccacagactgaaggctgcactgtaggcttccctagttttgaggtttggggatttggactggcttctttgctcctcagcttgcagacggcctattgtgggacttcaccttgtgactgtgtgagtcaatactccctaataaacttccctttatatatacatccaccctattagtcctgtccctccagagaaccctgactaatacaccctgaaaactctatttttgttactctctcagaatgagcttccctttttaaatataacgacctctaaataaaccaacccaaatttatgggtatgattcctaatttttgtacagaaaccataattatccactccttttaaaaatataatttcgcatgatggtatgtgcccatcccccaaggctctttatcttgttctaagtatctgaaaaccctgctcactgccaggtgggaagacagcagggctgctattgctgttggactgacgcatatctttggaaacaatgaaaaccaagacaaaatataccaaaatctctggaatgcaacaaaagcagtgttaagaggaaagtttataacactaaatgcccacatgatgaagtcagaatgatctcaaatgaacattctaatattacacccagaggaactaggaaagtaagagcaaatcaaccccaaagctagcagaagaaaaggaataactaaaatcagagacaagctaaacaaaattgagatgcgataattcacgcaaagaatcaaaaaaagataagttggtgttttgaaagaataaacaacacagataatcactagctaaattaacaaaaaaagagagaaaatgcaaataactgcaaacagaaatgacaaagataacattacaactgatgctgcagaaatacaaaagatcctcagagactgttatgaacacctctatgcatagagacaacagaatctacaggaaaaggataaatttctgtaaacatacaacctccccagatcaaatcaggaagaaattgaaagcttgaacagaccaataatgcattattaaattgaaacagtaataaaaacctaccgaccaaaaaaagccctctaccagatagattcacaactgaattctaccagatatgcaaagaggagctgttaccaatcacactgaaactattccaaaaaattgaggaggagtgtttcctctttaattcattctatgaagccagcattatcctgatacaaacatctggaaaaggcacaacaaaacaagaaaactaatggccaatacatcagatgaacatagatgcaaatatcctcaacaaaacactactaaactgaatacagcaggacatcgaaaagttaattaaccatgatcaggaaggcataattcctgggatccaagtttggttcaacatacgaaaatcaataaaggtggttcaccgcataaacagaatggggaaaggattccctatttaataaatggtgctgggaaaactggctagccatatgtaggaaactgaaactggacccctaccttacaccttatacaaaaattaactaaagacagattaaagactcaaatgtaaaaccccaaaccataaaaaccctagaaaaaaatctaggcaatatcattcaggacataagcatgggcaaagatttttataataaaatatccaaaagcaattgcaacaaaagctaaaattgtcaaatgggatctaattaaactaaaaagcttctgcacagcaaaagatactatcatcagagtgaacaggcagtctacagaatgggagaaaatttttgcaatctactcatctgacaaaggtctaatatccagaatttacatggaacttaaatttacaagaaaaaaaaaaacgtatgaccaaactgaaataaataaataaataaataaataaaaacattgaattcattcaaatcaaattattggtatctagcctctcagccataaggaatcactgaatgttaaaaatgtgtggaaatttaacagataaggaaaccaaggcctttagcactaatatagcctaaaatcatgctgctagtagtcttagaatataaatcacaacacatgtcttccttggaatcaacagaaatgcccattgacagtagactggatgaagaaaatgtgtacatatacaccatagaatactacatagccataaaaaagaatgagatcatgtcctttgcagcaacatggaaggagctagaggcccttattctgagcaaactaatgcagaagcaggaaatcaaataccacatgttcttacttatgagtgagaactaaatattgagtacccatggacacaaagaaaggaacaatagacactaggacttacttgagggtggagggtaggaggaggatgagtattgagaaactacctatcagataatatgcttattacctggctgatcaaataatctgtacaccaaacccccgtgaaaaataaaacagaacacacacacacacacacacacacacacacacacaaatcatctccatcagaaagtgggcaaaggacatgagcagacagttctcaagagaagacattaatgtggccaataaacatggaaaaaaagctcaacatcaccgatcattagagaaatgtaaatcaaaaccacaatgagataccatctcaagccagtcagaatggcgactattaaacagtcaagaaactacagatgctggcgaggctgtggagaaatgggaatgcttttatgctgttgatgggaatggaaattagttcaactactgtggaagacagtgtggcaattcctcaaggatctagaaccagaaataccgtttgattcagcaatcccactactgggtatatacccaaaggaatataaattaatttattataatgacacatgcacacatatgtttattgccgcactattcactattcacaatagcaaagacatggaaccaacccaaatgaccatcgatgatagactagataaagaaaatgtggtacatatataccatggaatactatgtagccataaaaaagaatgagatcatgtcatttgcagggacatggatgaagctggaagccatcatcctcagcaaactaatgcaggaacagaaaaccaaacaccacatgttctcactcatatgtgggagctgaacaatgaaaacacacggacacagggaggggaagaacacacactagagcctgttaggggggcgagggcagggagagcatcagaacaaatagcttatgcatgcaggacttaatacataggtgacaggttgataggtgcagcaaacaccatagcacacgtttacctatgtaaaaaaacccgcacattctgcacatgtatcccagaacttaaagtaaaataaaattttaaaaagttatatgatcatctcaatagacacagaaaaccttctgatagaatacaacattttttcttgataaagactctctacaaactattcattaaaggaacattcctcaagataataagagtcatctacacacagccaacatcaagctgaaaggacaaaagctaaaagtattctctgttagggaacaggaacaagcaaatgatgtccactctcaccactcctattcaacatagtactggatgtcccagtcagagcaatcaggcaggagcataaaataaaagacatacacatataaaaagaagtcaaattatctctcttcactgatgatatgattctacacttagaaaaccctaaagactatgacaagaggctcctagacctaataactgacttcagtaaaatttctggatataaaatctatgtataaaaatcagtagcatttctatacaccaacaacattcaagtttatagtcaaatcaagaaagcaactacatttacaatagccacaaaaaaattaaatgcctagaaatatatctaaccaaggaggtgaaaaacctctacaagaagaactatacaaaacattgctgaatgaaatcatagatgacacaaacaaatggaaaaacattccatgctcagggattagaaaaatcaatgtcacgaaaacgtccatattgcaaaaagcaacctcaagattcaacactactcccaccaaactatcaacatcatttttcacagaattagaaaaaaacgattctaaaatttatatggaactgaaaaagagcctgaagagccaaagtaatcctaaccacaaaaaaaaaaaaacaacaaagctggaggtatcacattacctgacctcaaactctaccatgaggctacagtaacaaaacaacatggtactgctacaaaaagagacacgtagacaaaagtaacagaattgagaacctagaaataaagccatacactgacaataagctgatctgtgacaaagttgacaaaaatatgcaatggatcaaggactccttattcaataaatggtactgggataactaggtaatcacatacagaggaattaaactggaccccttcttatcatcatatacaaaaattaagtcaagatgggttaaacacttaatggtaagatctacaatgctaaaaatccaagaagaaaacctaggacttaccctctggacattggcctttgcaaagaatttatgagtaagttttcaaaagtagttgcaacaaaagcaaaaattgacaagttggactcaatgaaactaaagagcttctgcacagccaaagaagctatcaattgatcaaccagattatctacagaatgggagaaaacgttcacaaactatgcatgtgacaaagaactaatatccagaatctatgaaaaatgtaaacaaataaacaagtaaaaagcaaataaccccattaatatgtgggcaaagtatgtaaacagacgcttctcaaaggaagacatacaggtggccaacaactatattaaaaatactcaacaacactaatcatcagataaatacaaatcaaaaccacaatgagttaccatcccactccagtcagaatggctattagtgaaaagtcaaaaaatgacacatgttggcgaggccgtagagaaaagaatgcttatacattgttgctggaaatgaaaattatttcagccactgtagaaagtaggttggagacttcttaaagaattaaaaatacaactattatttgacacagcaatcccgttactgtggtatatccaaaagaaaataaattgttctgccagaaaaacacatgcactcatatgttctattagtccactttgtgttgctacaaaggagtacctggggctgagtaacttataaagaaaagagatttattttactcatggttctgcatgctgtatacacatggcaccagcatctgcttggcttctagtgaggactcagaaaggttttactcatggaggaaaggaagagggagcaagcatgtgacgtggaaagaaagcaagcaagcaagagagagatgagggagggtaccaagctattcatgagggaaccacctcattacccaaacacccccaccaggccccacctccaacattggggatgacatttcaatatgagatttgaagggaacaaatatccaaaccatacttttttgcccctcatcccccaaacctcatttctttctaacatttcaatatataatctacctttctaatagcacctaaactcattgcagcatcaacccaaaaactcaaaatccaaagtctcatctgaaactcaaggcaagttccttacaggtatgatcttgtcaaataaaaaaacaagttatttactcccaagatacaatgatggcacaggtggcattgggtaaacatactcattctgaaagggagaaatcaggcaaaagaaaggggcaacaagcctcacacaagtctgaaacccagcaaggcagacattaaatattaaagctccaaataatgtcccttgactccatatcctgctttctggacacactggtgtaaggggtgggctatcaaggccctggacagccttaccgtcgtggatttgctggacatagcccacatggctgctctcatgggttggactctgatgcctacaggttttccatgctgaggctgaacgctgctgctgattctaccattctggaatctggaggtcaacaaccctgtttccacagttccactagatggggattctgcatggtgccttcagccccatattttcccttggcactgccctggcagaagtactctgtgggggctgcatccctgtggcaggctacttcctgtgcactcaagctttctaatacatcttctgaaatctaggtggaacctgccaagcctccctcactcttgtaatatttgttcctgcaggcttaataccacgtggaaactgctaaggctcatagtagcttgcactcttcaaagcagcattctgagacgtacctggggccctttgagtcaagcctagagctagagaagctggaatgcagggatcagactcccaagatggttcaacgcagtggcaccctgaccctggccttaaaaccattattttctcctaggcctctggtcctgtgataagatggactttcctgaggacttctgaaatgacttctaggcctttaatctatcaagtgtttgcttaacaggcttctttttccttgtctgtgacatggccaggctgctaattttccaaactttaatgctctgcttcccttttaaattcaagttccaactttaagtcatttctttgctcccaaatcagattgttagatgcaggcatgtcattttttaatgctttgctgcttagaaatttcttctccagataacctaggtcattattcttaacttcaaccttctgtgaattcctagggcatggacacaatacagccaagttctttgccctgagaacaacacaggttacctttactccaatagcttcctcatttccatctgggacctcatcagcattaccttcactgtccatatttctatccgcagtttggtcacaaccatttaccagtctgtatgaaattccaaactttccctcatcttcctgtcttcttccaaaccctccaaactcttctaacctctgcctgttttctagctccaaagtcacttatacatcttctagttatctttttagcaaaacctcactccttcataccaatttaatgtattagtccatattgtgttgctatcaaggaatactcatggctgggtaatttataaagaaaataggtttatttggcccacagttcttcaggctgtgtaagcatagcaccagaatctgctcaggttatgctgaggcctcaggaaggttttactcatgacagaaaggaagggggagcaggtgtgtcatattgcaagagagtgagcaagagagagaggagggagagtaccaagccattcacaaggaatctacccccattattcaaacaccttccaccaggccccaccaccaacactggagattacatttcaacatgacatttggagggggaatttatccaaaccatatcatgtattcatcatagcactattcataatagcaatgccatgaaatcaacctaggtgcccatcaatggtggattggataaagaaaatgtagtacatatacatcatgggtatactatgcagccatacaaaagaatgatgtcgtgtcctttgcaacaatatgaatgcagctggaggccattagcctcagtgaatcaacaaagaaacaggaaacaaaatactgcatgaaatatttggtacacatgggcataaaaatggggacaacatagggagaaggggtgcaaatatttcaaaactacctattaggtactatgcatactactcaacatatccatgtaacaaacctgcacaggtacctcctgaatctaatataaaaattgaaattacaaaaaagagaagatactttttcacttaaaatcatacagtctagaacattttggattaactaatggtagtttagtacaaccattaatatatttttaattattaaaagactatattttagattagttttaggttcacagcaaaattgagaggaagatatagatttcccatttactccctgccctcacatatgcacagactccctggttatcatcatccctcatcagagtgcaacactttttacaattcataaaactatgttggcacattgtaaacatccaaagcccatagttttcttaaggtttactcttgctgttgtacattttatgggtttagacaaatgtataaatacatgtatgtatttatacatgtattcattattatggtattatacaatgtattttcattgccctaaaaagtcccctgttcttcacctgttaatcacttctccaacattcatatcttggcaatcactgatctttttgccctctacacagttttttcttttccagaatgtcatagttagaaggagtatgtattcagattagcttcttgcacttagtaatatacatttaagcttcctccatatcttctcatggcttgataatttatttctttttagcactgaatattatttcattgtctggatgtatcactatgtacttatccattcacccactgaagtacatcttagttgtttccaaatctgggcaattataaataaaactgccacaaacctccatgtccaggttttcagtagacataagtttttaactccatgggaaactaccaaagagcgtgattatttgattgtgttatatgagtatgtttagtttacttttatgaaaaactaccgaactgtcttccaaagtggctgtttcattttgcattcccaccagcaataaatgagagttcttgttgctccttaacctcatcaacatttgatgttgtcagtgttccagattttagccattgtaataggtttgcagtagaccattcactttttactgttttctcatttagcttgccctaattaacctcatttttttcaaccagtagaattgcctctttacacatagctttctgactagagctacctgtgaaggagactgcctctgaggagagaaaacaaaggaggaaataaccagggcttcctgcatgctaaaacgggggtcactattagtaattctaattccagaaatgctgtgccagaagaaatgagacaacactggggaatcaggagaatagagattataaatcaagggattaaaaaatcaggaatgcattctgaaagagttaagcagaggtaggaacaaagagaaaggcaagacaggaaatgaagtataatagtatgtgcaatggacattttttcagtcctgtctacagtgatttatctactaaatgtggggctgttgaggagtctattctatcatctggcactctgtgaggtgcttctaagtcactgcttctttagatctgtccatcaaaaagttactggagtggggctataggctgtcaccccacaggtgttgcagaagaccttacaagtccagaatagcctgaaccacacactgtgcctcagcattccttccccaatgactgaaattagtaagttgtgaagaggagtggggttgaacagttgtctgtgagagattagagttatgacgcatcagagcttaacagaagaaaggaaaactggcacacaaaataagaaatcagagtagaagccacctcttgtgtgtgaaacccaaatccaggtagtcttcaacttaagatacaaatagaatatcagatgtaaaacttgcagaagtaaaatatttgccagatctttgtatgaggccaatatgttaccagtatttgtcaagatcttattaagatgagaaggtagatcttgtgactgagtctacaatttgagtaatcttagcatctgcagctgagtaaagttctgtaagatcaggatggacagtttctattaacttaaggagcacaaaatgaatagaatgatgatggctcaatgttgcaggaagtcagggaccctgaacggggggaccggctgaagccatggtggaagaacataaattgtgaagatttcatggacatttattagttctccaaattaatatttttataatttcttacgcctgtctttactgcaatctctgaacataaattgtgaagatttcatggacacttatcacttccccaatcaatacccttgtgatttcctatgcctgtctttactttaatctcttaatcccatcatctttgtaaactgaggaggatgtatgtcacctcaggaccctgtgatgattgcgttaactgcacaaattgtttgtagagcatgtgtgtttgaacaatatgaaatctgggcaccttgaaaaaagaacaggataacagcaatgttcagggaacaagggagataaccttaaacgctgactgccagtgagctgggcggaacagagccatatttctcttctttcaaaagcaaatgggagaaatatcgctgaattctttttctcagcaaggaacatccctgagaagagaatgcgtccctgaggggaggcctctaaaatggccgctttgggggcggctgtcttttacggttgttgctgtgggatgaaataagccccggtctcccatagcactcccaggcttattaggatgaggaaattcccgactaataaattttggtcagactggttgtctgctctcaaaccctgtctcctgataagatgttatcaatgacaatgtgtgcccaaaacttcattagcaattttaatttcgtcccagtcctgtggtcctgtgatctcgccctgcctccatttaccttgtgatatcttattaccttgtgaagcatgtgatctctgtgacccacacactattcatacactccctccccttttgaaaatcactaataaaaacttactggttttacggctcgggggcatcacggaacctgccgtcatgtgatgtctctcccggacacccagctttaaaatttctctcttttgtactgtgtccctttatttctcagactggccaacacttagggaaaatagaaaaggacctacgtgtaatatcaggggtgaatttcagccaatagctcaatattcattggtaaaccaaatagacactagaatttaattacaatagagattgtcactaatttttgttgacttaagaaaatgcatgcttactgaaactattcatttgttctattttccattcgcatctcatagttttttcttttggtatgttaaacttgggaattcccacatgtttttctttggataggatttgagtcactctgtccagatgggaaattgaatcatatggtgttttcactgcatgaagtgaaaatctagataccataagagtgactggccaactgctcagatagcaccatcaagtctgcagatttgctagtcttttcaagagctgctcttcatcatggaaatttattttctagcagagtactattctgattttcttggaaagagaaaaaaaggaaaagagtggaacaaaagaggaatacttaaaaattcagtacttgctttttactgtaggtctctgactaaacttctctctttctagaattacaaaaattaaaagggactaccctcccttttcttttatttcaatttatgtggtttcagtcacttccagtaaatggagatctaaaaatattaaatgaaaaatgctagaaataaacaattcataagttttaagttgcccattgtttaagtagcataatgaaatctcatctgtccctctccttctggcctgggatgtgaataatccctttttccagcatatctacactctctatgctccccacctgttagtcacttggaaatcatcttcattaacagatcaactgtcataaagatacaggagctagaaagaaattatttaggcagatagtgagagcaaaagagttctcggcaaagcttcccttctaacaaaaatcagccaaagaaattatttttttctaacaaagagcagcctgaaaaatcaagctgcaaacatagataagcaagctggaagcttgcatgggggaatgccggcagctgtgccaatggaaaagggctacctggggaccaggcatatccaacatggaggctctatcttcccttctttttgttaccacatgtatagtaaaggaatgggcaacatggtgccagccaggcagaagaacccatttgcataataaaagattagggtggagactgccagttttttgtgccctatgcaaatgacacacatagtcctaaccagtttttcatgccttatgcaaatggcacacctggtccaaccaatcttttgcaccctatgtaaatcagacaacacctcctcaagctaatctataaaaccccctgcatttcaccatggaactagaaacccattcaggacccctttctctgcaacagagaaagcttttctctttttttgcctattaaacttccgctctcaacctcattctttgtgtgtccacgtcctagttttccatggccatgagacaaccaatcttgggtatcaccccagacaacaaggccacttcaataatattgcagtgtttgtgtttaagtcaccctaattttacttaatcggggccccaaagtgcaataatagtgaagctgacaatttccatatgccaaagagaagagaaagaaaaaaatcatatgctgagattactaagctctatgtaaaaacctatcttctatctgtaaaattgcaaaaaaggaaaaagaaatttgtactagtttgctgccacatctcagattgcaaaagttatggccacagtgcataataaatacttagttaagatgaaaaaggcattacatttatgggtggaagacacaaacagaaatgtgatcttatatatgacagttgggtttggtactatacatagtttcaggcatcaactgaggggcttcataggtaacaccccaaataaagggggactattgtattaatgtaagaaatagtgggaccttaaaaggaccaaaccttttagaaaaatttgaacactatatccttgagtgtatatggcatatcttcttatctgatatatatatttttctaactaaaaagattccttttgcaaggctgtctcaggattgtatcaggggagttcttcttggatgctacagtgtagtagagaaagataatttccactgttttcttacctgaggagtcttcaggggctatagaagataaatagctgcaattacaagaaaaaaggagcctactaactccagaagggatgtcactaatgggaatactgttgttaagtcacctttaaagaaatgcacacacagtgaccaataagcactttgtgtcttgaaagaaacacatcttatgactctaatacttatcccagcctagcttttaagagatagcctacgcaggagcccatataaaaggttaacccaacaatttgtgaatagtgaccatgcctttagctttcctgaacacctaatacataaattgacacagagcagtatttcaaagaacagatgaacaattttatctcttcctagctcactcctagctctatttttctttttccttttctttcctaataaactgttttacattttattatttattcatcttactgtttttcctgctgtgtatgctctcaaatttcctaagtaggaatgaactttacttcatgtatgcttcatctttccctttatgattgacacacttaggtaacatcacactgggcatgacaaggtcccaaacatactcctttctgcatatgtttcctgcagcttacttctctctaacaccccaaaattaatgtggcaggaaccatcttatctagatttatggttcctaaggaagatttaattcttgtgtcacctaaggtgactgaattagcatcttgtcacacatgagggtgaacaacacacactggggtttgttgggtgtgcaggggtagggagaacatcgggaagaatagctaatggatgctgggcctaatatctaggtgacaggttgatctgtgcagcaaaccaccttgggacacatttaactatgtgacaatcctgcacatcctgcacatgtaccctggaacttcaaagtcaaaggaaaaacacttcttgtgatgtcattgaataaaaaagataaattaagaattattttcagaaaattattttgtatgacataagtcttcaactggggctggacaaatataaatgtgaccgactttgagacccattgttatttattggaactaactcctagagaataacatgtaatgaaaaactagcaattttaatggcaaacgatctgtgtcagggcatccttaataattttactaatatttaagcctaaaatacgtatcggtttggggttgtggttatgttgatacaattacttgcagcaatcacaaatcagaatttttttggcaatttccttaatctcaacagggataaatttgaagaaatttccaaaaatgattgtatcttgctacgtgttacaaataaaatataaagcaagtgttgtagtaacagatgttgaataaataactatatgttctctgagttattacgaaaagggtacactcttaatctagcctacctcctccttatgattaaattcaaattcagacttcttggtcaatatcatgtaaatgtagataacttggtatgcacttcactcttctgttcttttcatgatctattaatccccaaagatcagtaacagtcttacatccatttcttttttccatattgcgggctttagtatatattgcatgtaatataagttaaaaagttacaactgacttcttataagtaagtgaatgagttttccccatacatttttcatttatggaaagattattcctgtctctggctttgaacagtttaagtttatacagtgttttctccaattttcacctgttatacacatgtaagattttaagcaactcattctgtgatgtagtcaaatgaagagtcacgtatgtcttcaacttttcaacatgctctgtggtttcattcatagaatgtagttatttcaagactgtgaacaaaactaaagtcataatgatcctacaaaatatatggattctcatatattcaacaagtatttcttgaatacctactgtgcacaggttctgtgctaagcgataatacacaataacaaaactattgtgtatgaagatgaaaataattattaactttttatttcctacaaaatggaaccaagagagatttgccacctttattagctataaaagcacaggtagtatggtagttgtgggacccatcactcctgttaaaattgctgttgagtctttgtccttttgtacttagattcattgagtagaaagtatttgttccgagtaataataagttatgctttattatcatctgtcattttctgcctgaactctgcaccttgaaataaacatcagaggtaagaaatacttgggtgtgctgatgatgtagtgtggtggggtgaactgaagtttctctgcctcttagacagattggatttagcaatcagagtgaagcaatggggcatggtgtctttcattaatagctaatacaagaagcttataacatcatcagggcagggaaaggggaaaaatatcttaataaaagaagataatatttagttagaaataaagccaaagtcaaggtagatgaagagaaatgtcttttgtggtcaagttgggaatattttaaagaaaattgtctcccacaagatgtgatgtgaataatttcagacattgcagggaaagagaagcagagtggaaaccttaaactattctcaatcccattattggaaccaaagcaaacccctcaccacacctttctgggcagaaccagcagtataactgggcagatccaaaacaatttacttgcatcataaccaaagtttcacatttgcaagtcttaaggtgtcaagttgcttgccttatgcaaagttaatggcctgaagcatcagaacaaatgaaagcaaagaaaaccagttgctgaatgagataaaagtggggaaaggtgattgaattagcagtttaggagcaacaagaaggagcatgtacagtcatcccttggaatgcttggaggactggttccatgaccccctgcagataccaaaatccaccaatgctcaagtcccttgtataaaatggtgtagaataacctacaaacatcctcccatatactttaaataatttctagattgtagacatgcatcactttgtgacgagagtactttttgaggatgcgttgttaggcgatttcatcattgtgtgaacatcatacaaactgagcagcatgtgactgtacaaaactatagggtatcctaatacaatggtaagtatctgtgtatctaaacacctgtaaacagaaaaggtactgtaaacatatggtatgaataacaaaaaatggcacacttgtataggccacttaacatgaatggagcttgtggaactggaagttgctctgcatgagttaatgagtgagtggtgagtgaatgtgaaggcctaggacaatactgtacactactgtagactttatcagcactgtccacatgggctacactgaattagttttacacaaaaatactttttaaggtattcttctttaataataagttaaccttagcttactataagtttttacttcaaaaacttcttttttttaactttttgactcttgtaataacacagcttaaaacacaaaaacattttacagctgtatgaaaatattttctttctctttaaaattttttattttaattattataggaacataatagttgtatacatttatggattatatgtgatgttttgaaacaggcatacaatatgttgtgatcaaatgagggtaattgtgatatcaatcaccttaagggtttagctttttttttttttttttttcgagacagagtagctctgtcacccaggctggagtgcattggagtgatctcagctcactgcaagctccgcctcctgggttcacgccattctcctgcctcagcctcccaagtagctgggattacaggtgcgtgccaccacacctggctaattttttgtatcgttagtagagacagagtttcaccgtgttagccaggatggtttctatttcctgaccttgtgatctgcccgcttcatcctcccaaataaatttatcattttttttgtgttagaagcattcaaataccacttttacttattttaaaaaatacaacaaattattgttaactgtagtcaccctattgtgctgccaaatactaggtcttcttcattctatctaactgttattttatacccatctatcatcctctctttatcaccccatccccactaccttcccagcctttgataaacatcatcctactctctatgagttcaatttttttttgtacaaccaagatggagaacagtataaaaattcctcaaaaaattaaaaatcaaactactgtatgttctttctttatattcttattctatgagcttttttatttttaattttttacatttttttaaaactgagacataggcacacacattatcctaggttttcacagggtcaggatcatcaggatcactgtctttcaccccgacatcttgtcccactggaaggtcctcaggggcaataacatgcatggagctgtcatctcctgtgataataacaccttcttctggaatacctcctgaagggcccgcctgagtctgttttacagttaactcttttttttaataagtagaaataatgataaatggtatagtatagtaaatgtataaaccagtaacatagtcgtttattatcaagtattatgtgctgtatataattgcatgtgttgtatttctgtacgactgatttgtttacaccaatgtcaccacaaacacgtgaataatgcattgtgctatgatgttttgagggctacaacatcactacgcaatagaaaattttcagctccattctaatcttctaggactactgtcctatagactgttgttgaccaaaacatcattatgtggcatgtaactctacttatgttatccaatacaatataaatgctatgtaaatagctgttatactgtattgtttagggaataatgacaaggaaataagtctgtacatgttcagtaaatacattttatttttttttgtattttaatctgtggtttcttgaatccacagatatggagcccacagatatggagggcctactgtataggcttaaggatgtctaaggagtatccctggaggaccttatccctcctctctcatccttcatataggcagtatgggatgtctctgtgtgtagtactctataaggtatgttgtaagactgttacatttcttcaccacatccatcttaccccaatctatttggttttagaacaataatcttattcagtagtgacccacttatggcttcatttggatgggcctgtatttcaattctggaaaaagcaggccagccagcattgtaaataagtaggaagttccctttacccttctaggccagcttttatcctgtggtctgctcaacactcaaaatatggattccagggagtaagccacctgaaactaaaaacttgatgctacttcaaattattttttaaataattatttattttaaatattgatcctcctcagtgttcaatttgacaatcaatttcagcttttatatcaattcatattctaaaaagatgatcaacatattttgaaaaatcttatgttcattttcagtttccagaaaactatcaacaagttaagcatgagaaaagcaaaatacattatcatctccttcacaaattctggtggtgtacctccacaacacacacacagtcactactagaagctgggcaagcctattgaccacagggtcgtgagtggtgtgagtgagccaaggcatacacaaacataaccatcatcagtgactaatggaaagaataaaatgccttttctgaacttgaactacagcacacatcctttataccagtagcaatcaaccttggctgtccattagattcacttggaaagtgggtaaaaatctcaatggtaaggccacagaccaccattaaatcaaaatctctggtgaaggggtccagtcagacatagtttcataagctcctcaagtagttccaatataaagacaagttggataatcagtgctttaaataatagtttacaatggaaaaaccttgttgtggactatacttttaaggttcttttgttgcagtattttatattactacagtggacatatgtctgacattatgcagacccttcaaaaatgcaaactcactttgaaaagacagaaatctgtgacaggcataatactttcatgtcagatgttttaatgtggcctgtcattctaagagcatatgttctttatccacaaactactcttgtggttctagggcctctgatatgatacattattcccatgatgcacattagcatatacataaaagtccatagagggaggctttattagcaggatgccagtggagtcaggggaaaaaatcaatgctgcccacttactgccagcattgggaagcatttgatacttaatatttgttggagaacagtgctgaaatgccattttctaatcatatgcattccatggaaaggtggcagggaggcacagtgtcccacaaaaagaacgagatcatgtccttttcagggacatggatggagctggaggacatcatccttagcaaactgatgccagaacagaaaaccaaacaccacatgttgtcatttgtaagtgggagctaaatgatgagaacacatggacatacagaggggaacaacacacactggggcctattggagggtggagggtggaaggagggagagaatccacaaaaataactaatgggtactagacttaaaacctgattgtgtttctgtatgccttggctcactcacactcacatccatgtggtattaatcatatctgggttaatacctgtgtggtgaaataatctatacaacaagctcccatgacacaagtttacctgtgtaacaaacctgcacatgtacctctgaacttaaaataaaagttaaaaaagagctctcacaaacctgctgatgtggttttcatgccattgtggtattttgtgttgtaactggtctcagttattttatactcccatattctgatgaggagacatacaagtgccatttattattggaattaaaaaacaagaatttatttttactcttcatgaacctgggtactccttctataaaatctctatttgccaaatctgtggacacctgaaatcttcataactagataaggcactgaattttccacagtgctcactttgccagcgtaatttcccattactttttgctctttctctcaattttttcattatatcttatttcctacttctttaagtaaggatcatgaagtagagaaagagagagaagatggaatactatggttcttattggggactctaacgaagatgcatcatataaaacttggcttaaaacttaaaacagtaagataaaattttatctgaggcccaagcctctagaatttattttaaaaagtattatactagttagtttcaaggagtacaggttttgtattagacacccttctcatggcatgactcagaatcttaatgggttactgtattaatttaatttcaggactcatcttttaataagaatgtacacaactgagtccatgctaaaaacgaaaatgataatgataataatgttatatttgtggaaatgcttattctttcattgcagaaagctaaagatgttacagttggattagaactccaaagtgtaaatgttcttaaatcagtgcaggggaaatgtaggtcaaagcacataaggtgtttcccaagcccttgttccctagacccatagtagaagttcttggaagttatacaaggtgaatttatctcattacttattcagacttattcactgaatgcctggtattttccaaagctgaccagggcatgaggatacaatatgtgctgtcaggacatttccaaatagacaaggagagaaatctttaaacaaatacactcaataggagctgtaatggttgtgtgtatgtggacactatgaaaccacagctagggccatgtcaacacttttctgagatactcagcagcatcttttttggtagaattatatttgacttgatttttgaaatgtgaaggagttcacaggaaagaaagggataaaaggaattccagttcgagaataaagcatatgcaactacaaatgcaggaagtttgccaggcacttgactctgagttaaaggtgagggattgcaggtgatgtggccaaagggcagccagagcctaaaaattcaggctaaagagtctgaacttcatctgtttgggaaattgtggctggttaaaggatgccagttctttcattttgaaagataaatctgatgtcattagaaagctggagtgggggcaggggtggggatagacagtataggaggccaaggtaacagtccaagtgaggatgtgaacaaagcagtggctatttacttagtaaggtcatgaccaacctaacaaatttagtggactgagcaccagccttggagctaggtttctagaccctgattctgactctgctactgaccgatcggtcttgtgtaagcaactctcccttctctaagcctcagatctgtcctttgtagaacaaggagcatctttcagaccaggtgatttccatggtcccctctgtttctcaaacaccatggattttatgatcagactgcagaggaacaacccttcaagattttagggcatacatctactcagagtggtaaaagtagaaggattaaagaagctcagagagttgtagaagctcgtttgtccttaaaatgcaggaatcatggcttctgatacatataggacggtcaaggtttatttctcccctgccttgccttatttcattgaccccagtgtctatctagcactgggtcaatgcaactgatttcattccttctctagtaagtcctttcctgactactccatgctcattaatctttgtccactggactccagcaaactccaaaacactcagattgtaatgaacatttgtcacatttgactttccagcacccaattcccctctttagtttgaagtaattgtcccgaacaggaatctttgtgaaagacagggcccaatcttccactaaaaagatgatagaaggagaatctccctctccttgtccctggcaaccaattcacaacagtctaacgcttcacttgaggaatctgaatttgagagagtgtgacaaaggtgaaggaaaggaagttacacgtgcaactatgtaagcatctggcacaaggggctgggtttagcagaagtgaagaaagcttgtatcattttgtttttatacaagcatccttgtattttcattttcttagagtggttctctaggcatcctttcacttctgcgagctatattttccctcctgcttaagtaagccacagttagttttagtttggagcaaaaagccttaactgacatacattatatactgttttaggacttcatgctttatcagaatctttgggtcttgaataattaagcaatataaggacagaggccatatcttatatttaacgtggatcttattataatgctcagaagtagaatatatggaagttgagcagttaatatttgtcagtatatggattaacttatgtcaattcatatgcatgaagtgtgaaatttctgtatatctgcaagaacagtaattgcaggttagatatgttttctttcaaatattggtcttatttgatttcaagaatcatggaagaaaaataaaaaaacattatttggtttaaaaaatttgatgtattgaatgattaacagtagttacaacatgtcttccatttaaaaaaaaaacccagatttttaaactgaatgttgattgcaaagccttgtttggaaataggtatcttacaagctgtcgttaagaattcaactgttgtacaggatggttttcaatattctgatgacctcaaaatagaaaaccattgtcagggagacaatgaagtctaaaaatagtttaaaatatctaaatgcacttagggaagcctttaaatgctagccatggtgacgtatttcatcctgccataaaactcccagttgagaaatctcttctgtaaaaggttatttccttatttttgctatgtttgggttcttccgaatgcatcacaataattctatccatgccaataagttgtacatctatgtcatcaaaattggatttttctgtgctggataaatatccattgaaatacatgaaagaaatagaacaaaaatatgtctgtcttggcccaagtaggacaattgtgaagggtagtgcctgcttctgaactccctgtgggaatggttgggatttcctctgaggctgtactgaagcttgacttttccttctatccaatccttctttccttttccttcccctggtgtttatccccagggaactcttcactaaatatccagcctgctaaaccccatgtcagattttgcaacctggggaaccaagtctagtacacttgcctgaaatcattgagaataagcgacagagttagaattttaaattcatagctgtggactacaatgtccatttggaaaatctcgatagcaaactatgatgtaattcaaaataatgcatcaaccaaaattattcaagctaattccatggtttgagaactgcccaaaagacttgttcctaagaaacaatcaaataaatgtctgcagttgatgtttaccaatcagctacgggatgaaaagaccaccacacaatcacacaatcagactttctcagaacaggtggtttgagtcatccatgggacaacataactgatatttttgcaatgggccagctcttcatctgaaacaatgagtccccttctcagccttacaggaccccttatccattgatggcagtcctattaagactcaccctggcagggcacggtggctcatgcctgtaatcccagcactttgggaggccaaggtgggcagatagcctgaggtcaggagttcaagaccagcctggccaacatagtgaaaccccgtctctactaaaaatacaaaaattagccaggcatggtggcaggcgcctataatcccagctactcaggaggctgaggcaggagaaatgcttggagtagggaggcggaggttgcagtgagccaagatcgtgccattgcacttcagcctaggcaacaagagcaagacttcgtctcaaaacacaaacaaaaacaaaaaagctcacccttttttcctctactccacccttttggcactccctaaccctaaaggatgttttattttccttatcatttaccaccatctattgtgactttgtcgattcattttgttaattttctctcttcttcctcactagactgacagctctataaggacatggatttttgtctgttttattccttgctgtgtccctagcacctaaatcaatgcctgatacatagtaggctctaactagcatttgttgaataagtgaattaattaatggctatttcttctttgcaaagggttacctgggaagagttgttttcccctataaatcccaaagcacttagtgtagaacttgattataagatccacttcattaaaacagagcagcaagtttacttaaatgtttctccactaactcatttccagtcttttcaatagaactcaagaccactgataaaacgcatcaggtatcctatcagttccatctttttcctttttttaaaggaagacaaaatttattaaataataaaaaagattacataattgttttgaaatagttatctttggctacaaagatcaataacaagaataatgtgagtctgaggttggacagccaattgcttggcagacatcctgcagaaatttttttatgtctaagattgcaatggtctttgtgaaaggttgtgtttttttgcggtcttttgtgatagtttttgttatcagacatacaagcatgaaaactctatccttatggtattccctgactacttgtcagagttttctttttttttttcctttcaacttttattttaggttcaaggggtacatgtgcagatttgttaaatcggtaaattggatgttgaagcggtttgctgtacagattgtttcatcacccaggtaattagtatagtgcctgagaggtagtttttcaaatttaacccacctcccaccctccatcctctagtaggccttggtgtctcttgttcccttctttgtatccatgtggactcaatgtttagctcccacttataagtgagaacatgcagtatttggttttctgtttctgtgctaattcgctcaggataatggcctccagctgcatccacgttgctgcaaaggacataattttgttcttttttaatggctgtgtagcattccattcaccttttccttacatctttctctccttaaatattccattaatcttatccaatcaggactaattattgtctctgattactcacagctgccttttggaatttcccttcagcgtcagcctcagaatttcattaacaactcacctgtgttgtattcttattttttacattcatgttttcctctttcatcgatttactttctatctttggtggaacactctctcccaaaatttcttatccattagagagtgaccattaacattctaaaatgactttattctgtctttgtgtttgcaagttcctctattgctatagtccctctgcaataatccttctgaataaaatattttaatgagtttgaatttgttttttattttaaatatttaaggtgaaattgctccttttaaaaacatagaaccaattatcttattttaaattcacctggtgagaacagatttcaaattttgtctcctactactgaggctttccagagttttgttggttgaatcattttgtttcatggtagcttccctcttgcaggtttagctttcagttttcttttgtacatttagtcagttacttccatggatagaagcactacgtggatgaatttgattcaaaactgagcagggtgaggaaataggaccagtatggagcttccattctatctcactttgtttgcagaagagctttcagtgaaagcagagatgacttctgtcacagaaataacattggcgctgtaaaatgtagtagtagccataaaattaagttcatagtctttattgccggtggcaggtgctcttgtagctgcattggaactttctcagttaagatcattgtctttcccagtttaatgttctagcctctacacacattctctaggcttcacaaggctctctaagctatgcaatatcctttaatgagccattttcacttaagttggcaagagctaattcattttgtagagggtagttatttctgtcacatcttgattatcatgacctgttttgactaaacataagataaacacttttataaagaataatgataaattatggcaaaacaaattactgttggaaataggctttctttgcttgagcaagtcaacacaggctgagtgtacagcattaatatagaaaaatcttgttttctctttgtcaaaaggaagagcacagaagaatggcatggttttgcttggtatgagcagcagtaccacatcaactcacttcaagtttatgttaactctcttattctctaagctaatcaacagcaactttaattttctcaaaaaatttatagaatgttacattaactcactatattaataatacatgctgatgagttctgatgagaagaatacagtaggtactatagatgctttgaaaagtcatgtaactttggttcagctggcgatccaaagggaaggtgaggagtaggaattctgaaatgatgaaccaagaccaaaaaacccattaaaaaagaatattggacaaaattatcaaaatacacctttttacaaccttggcaattaaacaatgtcttacaacaattagaggaacagtaatttaggtgaaaaaactgaaacttggaaagaacagtgggctttgtggtaattgaactttccccatccccagtcttctttccacatatccgaggcagcattaacaatcagcagactcacaagcttggtagctgtgaaatacagcagcttggcagccacttgaaggaatcaaaaaggtttggaggacaggcatggtggctcatgcctgtaatcccagcactttgggaggccgaggcaggtggatcttctgaggtcaggagttcgagaccagcctaaccaacatggaaaaaccccatatgtactaaaaacacaatattagcgggatgtggtggtgcatgcctgtaatcccagctactcgggaggctgaggcaggagaatcacttgaacccaggaggcagaggttgtggtgagccgagatcacgccattgcaacaagagcgaaactccatctcaaaaaaaaaaaaaaaaaaaaaaaaaaaaggtttgaagttcttcggaaagcctattcctcaaagaattgtaactattttacccatctggcagcttcctgggaaagcttcatttacagagtttcttgcaatttgacccatctcaggattcacttagtggaaaaagcatgtatcaaaaacaatcaatggccattggttaacactgttgctgcctaagaggctgataccagctggggtgaaaaagaggcttaacaaaatcttaaaaggaagatctgaggaattacatgttcataggaagctttgaaaagttctatttttgaagatctaggaaccacatgaagggttgtaaattgtcagtgttgaagctttgcactgatacacacagagcccctttaaaaaggatggaagatttagtgtttcagatatttcaggaaatctctaagcaatcattagcagatatttcagtagctgtattttacatggaatacagatattgcaaaatcagtgtaggaaaggtactgaacagacacagaaaataaaataaaaaacaaaataagacaaaaaaaatcctagcaattataaccccaagtgaggtcgagttacttcattatatttaaaatgtacaattttcaaataaagaattataaacaattatctccatttccaggaacactgggggaaaatgacaagcagaaagaccctgaaacctacaggaaagagatagttcaagaaaaaggtaagattgctctaagtgctcttaagaggatattggattccaagtacatctatctagggatttccaatagtaaaagcttaagagaaaagaaaatgaaagtcttggagagagaatgagaatggtggaaaggctatttcactctttaagaatggtaaggaaaatagtttcttctgacaggataaagtccagctatagataattatatttatttctgaggtcagtctttttgacacattatttttcttcattctcattccatgtgagagagagaaaactagaattctcttttttccaacttttaagttcaaggatacatgtataggatgcgcaggtttgttatataggtaaacgtgtgccatggtgctttgctgcatagatcgtctcatcacctaggtattaagcccagcatccattaggtattattcctgatgatctccctcctcccatcccctaccctacaacaggccccagtgtgtgtgtctgtgtgttctcatcattcagctcccgctaataggtgagaacatgtggtatatggttttctgtttcagcgttagtttgctgaggctactgacttccagctccatccatatccctgaaaaaacaagatctcatttctttttatggttgcatagtattacatggagcatacatactacattttctttatctggtctaccattggtgagcatttaggttgattccatgtctttgctattgtgaatagtgctgcaatgaacatacatgtgcatgtatctttattatacaatgatttatattcctttgggtatatacccagtaatgggattgttgggacaaatgttatttcttcttctaggtcttcgaggaactgccacactgtcttccacaatggttgaactaatttacactaccaccaatggtgtaaaagcattcatttttcttcacaacctcgccagtgtctgttgatttttgacttttcaataattgttattctgactggtgtgagatggtatctcattgtggttttgatttgcatttctctaatggtcagtgatgttgagctttttttcatatgtttgttggccagatataggtcttctcttgagaagtgtctgttcatgtcttttccccactttttgatggggttgtttgttgttttcttgtaaatttgtttaagttcctcgtagactctggatgttagacctttgttagatggatagattgcaaaaattttctctcgttctgtaggttgtctgtttactgatgatagtttcttttgctgtgcagaggctctttagtttaagtagatttcatttgtcagcttttgcttttgttgcaattgctattgcttttggtgactttgtcatgaaatctttgcctgtgcctatgtactaaatggtattgcctagatttccttctagggtttttatagttttgggttttacatttaagttttcaatctatcttgagttgacctttatataggtgtagggaaggggtccagtttcaattttctgcatatggctagccagttctcccagcaacatttattaaacaaggaatcctttctccattgcgtgcttttgtcaggtttgtcaaagatcagatagttgtggatgtgcagcctcatttctgagttctctattctgttctaatggtctatgtgtctgattttgtgccagtactgtgctgttttgactcaaatagccttgtagtatagtttgcagttaggtagtgtgatgtctccagcttttttctttttgcttaggattgtcttgactatttgggtacatttttggttccatatgaattttaacatagtttttcctaattcagtaaagaatgtcaatggtaatttaatgggaatagcattgaatctataaattgcttttggtagtatagtcattttgacgatattgattcttcctatacatgtgcatggaatgtttctccatttgtttgtgtcatctctgatttctttgagcacagtggtttgtagttcttcccttgttagctgtgttgctaggtattctattctttttgcagcaattgtgaatgggagctcattcatgattggttctctacttgccttttgttggtgtataggaaaactagtgattttcacacatcaaatttgtatcccgagatgttgctgaagttgcttattagcttaagaagcttttgggctgagtcaatggggttttctagctatagcctcatgttatctgccaacaaagatagtttgacttcctcttttcctattgaataccctatatttctttctcttgccttattgccctggacagaacctccaatactatgttgaatagaagtggtgagagagggcatccttgttttgagccgattttcaaggggaatgcttccagcttttgcccattcagtataatattggctctgggtttttcatatatggttcttattattttgaggtatgttccttcaatacctagattattgatagttttaaacatgaagggatgttgaattttattgatggccttttctgcatctattgagaaaatcatatgggttttgtctttagcactgtttatgtgataaatcacatttattgatttgcatatgttgaaccaactttgcattctggggatgaagtgtgcttgatcattgtagataagcttttagagtcctgctggattcagtttgccagtattttgttcggaatttttgccctgatgctcatcatggatattggcctgaagtgttttgttttgtttttttgtttgtttgttttttgctgtatctctgccaggttttggtatcaggatgatgctagccttacagaatgagttagggaagaggctctccatttcatttgttttgaatagtgtcagtagaaatggtaccagttcttctttgtacccctggtagaattcaggtgtgaatctgtctggttctgggcttttttttttttttggttggtaggctatttattactgcctcaattttagaactcattattggtctattcggggattcaattttttctttgttcagtcttgggaaggtgtatgtgtccaggaatttatccatttcttctagattttctagtttatgtgcatagagatgtttatagtattctctgatagttatttctatttctgtggggtcattggtgatatccccctcatcatttctgattgtgtttatttgaatcttctctcttttcttttttattagtctatctagcagtctatctattttattaattttttcaaaacaatagctcctggatttgttgattttttgaagggtttttaatgtctctatctccttcagatcagttttgatcttagttatttctcgtcctctgctagtttttgggtttgtttgcacttggttctcttgttcttttagttgtcacgttaggttgttaacttgagatttttctaactttttgatgtgggcatttagtgctataaattccctttttaagactgctttagctgcatcccaaagattctcatatgttatatttttgttctcattagtttcaaagaacttcttgatttctgccttaatctcattatttacccaagagtcattcaggagcatgttgttcaatttccatgtagttgtgtggttttcagtgaatttcttaatcttgagttctaatttgattgtgctgtcatctgagagactgttattatttcagttcctttgcatttgctgaggagtgttttacttccgattatgtaattaattttagagtaagtgccatgtggtaatgagaagattgtatattatgttgtttttgggtggagagttctgttgatatctatcagttccacctgatccagagttgagttcaggtcctgatgtcttttttaatattctatcttgatgacctgtcccatagtgtcagtagattgttaaaatttcccactattgttgtatgggagtataagtccttttgaaggtctctaagaacttgctttatgaatctgggtgctcctgtattgggtgcatatgtatttaggatgattagctcttcttgttgaatagaaccatttaccattatgtaatgcccttcattgtcttttttgatttttattggtttaaactctattttatcagaaactaggattgtaaccctacttctttcttttttccatttgcttggtaaattttcctccatccctttattttgagcctgtgtatgcctttgcctgtatgatgagtctcttaatgacagcatacccatgggtcttgattcttaaaccagcttgccattctgtgacttttaattggggcatttggcccatttacacttaaagttagtatggttatgtgtgaatttgattctgttatcatgttgctagctggttattttgcagagttgtttatgtggttgcttcatagtgtcactggtctgtgtaattcagtgtgtatttttagtggctgataatggttattcctttccatagttagtgctttctttgggagcccttgcaaggcgagaccaatggtgacaaattccctcaacatttgcttgtctgaaaaggatctcgtttctccttcgcttttgaagttcagtttgaccagatataaaattctggattggaaatacttttttttctttaagaatgttgaatattggcccccaatctcttctggcttatagggtttctgctgagaagttcactcttagtctgatgggcttccctttgtaggttacctggcctttctctttggctgccctcaacattttttctttcattttgaccttggagaatctgatgattatgtatcttggagttgttcttctcatggagtatcttaccaggcttctccgcatttcctgaattttacttcatggttggattctcagggaatcattttattaccataattttaacattactgggctaagaaaagtttcatgtttgccttctatactatatacactggcctggtgatgtgagacctgattaaaatcaggtgatatggcctgtcttgctaggttggggaagttctcctagatgatatcctgaagtatgttttccaacttggttccattctccccatctctttcaggtaccccaatcactcagaggcttgttctttttacataattccatattttttggaggtttcattcattctttttaattttttctctattcttgtctgcctgtcttatttcataaagatagtcttcaagctctgagattctttcctctgcttggtctattctgctattaatacttgtgattgcattgtgaagctcttgtgtgtatttcagctctaacaagttggttatgttcttctctaaactggtgattttggctgtcatctcctgtactagaaaactagaattcttaaggcagagtggactttaagacccacgttttgtatgagggaaggtagtgtggagaaatattgcataagaacagaacttgaacccaattatatgggggaaaataaaaatgaaaagaaaatgtctgtgataacccagggacttagactggtgactggattgcatggtctttcaccataatggagtttagaggagaatggacatgatcatggggaaaaatggcctttcatttgagacactcaggtttttagatgcctgactttaaaagtgtagaaatttagagtctgacacaaagtgttctgcaataacatagttcctcatcgagtttgtgacagaacttggaaaaccagcataatattttagtcaggtctcatatcaccaggtgagtgtatacagtatagaaggcaaacacgtcttgggagggtgtatgtgtccaggaatttatccatttcttctagattttctagtttatttccgtagaggtgtttatagtattctctgatggtagtttgtatttttgtgggatcagtggtgatataaccactttatcattttttattgtgtctatttgattcttctctcttttcttctttattagtcttgctagtggtctatcaattttgttgatcttttcaaaaaaccagcttctggattcattgattttttgaagggtttttcgtgtctctatctccttcagttctgctctgatcttaattatttcttgccttctgctagcttttgaatgtgtttactcttgcttctctagttcttttaattgtgatgttagggtgactactttagatctaccagaggtacaaggaggagctggtaccattccttatgaaactattccaatcaatagaaaaagagggaatcctccctaactcattttatgaggccagcatcatcctgataccaaagcctggcagagacacaacaaaaaaagagaattttagaccaatatccctgatgaacatcgatgcaaaaatcctcaataaaacactggcaaaccgaatccagcagcacatcaaaaagcttatccaccatgatcaagtgggcttcatccctgggatgcaaggctggttcaacatacacaaatcaataaacataatccagcacataaacagaaccaaagacaaaaaccacatgattatctcaatagatgcagaaaaggcctttgacaaaattccacagctcttcatgctaaaaactctcaataaattaggtactgatgggacatatctcaaaataataagagctatttatgacaaacccacagccaatatcatactgaatgggcaaaaactggaagcattccctttgaaaactggcacaagacagggatgcatgccctctctcaccactcctattcaacatagtgttggaagttctggccagggcaatcaggcagaagaaagaaataaagtgtattcaattaggaaaagaggaagtcaaattgtccctgtttgcagatgacatgattgtatatttagaaaaccccatcatctcagcccaaaatctccttaagctgataagcaacttcaacaaagtctcaggatacaaaaacaatgtgcaaaaatcacaagcattcctatacaccaataacagacaaacagagagccaaatcatgagtgaactcccattcacaattgcttcaaagagaataaaatacctatgaatccaacttacaagggacgtgaaggatctcttcaaggagaactacaaaccactgctcaacaaaataaaagaggacacaaacaaatggaagaacattccatgttcatggataggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcatgctgcctgacttcaaactacactacaaggctacagtaaccaaaacagcatggtactggtaccaaaacagagatatagatcaatggaacagaacagagccctcagaaataataccagacatctacaaccatctgatctttgacaaacctgataaaaacaagaaatggggaaaggattccctgtttaataaacggtgctgggaaaactggctagccatatgtagaaagctgaaactggatcctttccttacaccttacacaaaaattaattcaagatggattaaagacttaaatattagacctaaaaccataaaaaccctagaagaaaacctaggcaataccattcaggacataggcatgggcaaggacttcatgtctaaaacatcaaaagcaatggcaacaaaagccaaaattgacaaatgggatctaattaaactacagagcttctacacagcaaaagaaaccaccatcaaagtgaacaggcaacctacagaatgggaaaaaatttttgcaatctactcatctgacaaagggctaatatccagaatctacaaagaactcaaacaaatttacaagaaaaaaacaaacaaccccatcaaaaagtgggcaaaggatatgaacagacacttctcgaaggaagacatttaggcagccaacagacacatgaaaaaatgttcatcatcactggccatcagagaaatgcaaatcaaaaccacaatgagataccatctcacaccagtttgaatggcgatcattaaaaattcagaaaacaacaggtgctggagaggatgtggagaaataggaacacttttacactgttggtgggagtgtaaactagttcaaccattgtggaagacagtgtggcgattccacaaggatctagaactagaaataccatttgacccagccatcccattactcggtatatacccaggattataaatcatgctgctatagacacatgcatacgtatgtttattgcggcactattcacaatagcaaagacttggaaccaacccaaatgtccatcaatgatagactggattaagaaaatgtggcacatatacaccatggaatactatgcagccataaaaacggatgagttcatgtcgtttgtagggacatggatgaagctggaaaccatcattctcagcaaactattgcaaggacaaaaaaccaaacaccgcatgttctcactcatagatgggaattgaacaatcagaacacatggacacaggaaggggaacatcacacaccggggcctgttgtggggtggggggggaggggggaggggggagggatagcattaggagatatacctaatgttaaatgacgagttaatgggtgcagcacaccaacatggcacatgtatacacatgtaacaaacctacacgttgtgcacacgtaccctagaacttaaagtataaaaataaaaaaaaactaaaaaaaaaaagaagaattaatttgttctttagttcaaagactttcttacagacaagagcgcagtcatacatttgatatcagttcctactgttttctgaaaattatatagcatattatgatttaagatataaaaggggagactgctccttaggacttgcctggacatgagatctttggcatagacttggtacctaggcttatggtgaacctagaaatgtggaggtgccccgaacaaaaggtagcatggaatgaataagcaaagtctttgggaggtgaggatttttcttggccctctagttgccaggttcccaggtttaaccccccgtgttcttagtttcagagcctcagttgaatggggtagagatgctttcccagaggcccagaataccgactgtctttgagaggagaagttgtactgtgtcagtccctacgtcattaggatgtgtgtgtcatctgggtggtgttttaatttaacactccattgtacacaatagcaataaataataaataaaatctgttctgcttaagcaaaaaaagaaggcaaacatgaaacttttcttaatttagtaatgttagaactatggtaataaaatgattctctgagaatccaaccatgaagttaatgaacacaaatgaattaaattataaaaagtaagagaaatttattgttggagagaaaaatgtcttcaatttggtcttggagagatgaacgtctccagtttgttaagacttcactcaacatgagtgaaaaatggagtcaattgcaaagaggtatacttagtggagaaaatatagaaatggaagattgcacatgcaaaaatgcattggtgtcacccacgcaagcattttgcagatgaaaaatgttccagttcctggatccaattccaatcatattcatatggcaagaaaggaaattttaagcaaagaagatatgttctcataattaaggcctcatagcccccaagtaaactgatataatgtttttcctatgtactgagagagggtgtcctagtcatttcaattttaaatagtctagcctttgggagaattattttggattgtgaaataagaagtttgtattctggtctttgtagcaatttctgcaggcacgatgtgctaaatattccctagtttttcagagagactgacttttatggtctgtgttacctgaattctttgccctttggattttggttaaatttggtcaatatgtggtatcagcaggagatcagagagcaagaagagaaagtgggtgcaaatttacttctgcagcacctttctgctaggttccaggttggcatgtgttgcattttctttctaaagccaaggctcgaagtagaagaatcctgttcatccacaggtctgttgaggttctgaaaaccactccacttccttgttctttaggcttagatgcagaaatggtttctatttgtaaatagcctggaggtactccaccactccttgttggattaacataaccctgctcacaattttggcaactgtttcttcaaaaaactattttcaattactccacttgagggtggtaactttttcttgttgatcctcagattgatagcagaaggttattgtgagttgacccctcatggtggatacagacactcaatttgcttacataaccacctgtttgaacatacagaatgaataactgattctagaaaataataaattcatcagtagtctaaatggcttgatagtacccttaactttgctgtgtgacattcaatatattccacaggacatggctactatacttgctcgtttaccatcagaactgaagtgtagaatatgaaaagacaccaccggatcatcatggagccaaattaattgttctttacttcacttgtacaaccatagccttacttcctcatgatgatcagggtcaattttccttgccaggaatagtgacttcttcctcacctgctgctttcctggcacagagagcctgaaatatctgggcaacagccatagtttaaagtttaatagacctcttgctatgttccttgttggaaacattccactctgcaatctacacatctaagcctgaagattttacaattattgtgaagggaagcacagatactccaagtgttgtgcacttggatgtgatgattaggactattcctacttctaccctgtggtttctgtacccatgaattttacctgtttgtacacagaaccacactttgtttattgattttggttgtatacagtggcaatggcactctgctattattttcaagccaatagttcagttgaactttaaaaagcttgttccatttttatatcaaaccagcaacgtctgggtgatatagtgtgggaaattcatagttaatacactatgggaaacttcttggtgatacaatattatggaaaattcatggttacttgctcattgctttattttttttataaggttagtcccttggtacatgtgaagctatatagatatcctgtatctttgtgtattccctagtgttcttagcagatgctgtttaggtatgaaggaaaagcccatacttggagtatgtgttgaacccagtaacagtgaattgctaatcaccttgccaccatggagttggttggtttcttcaagggatggtgccatactgggccttagtgttggtctttgttgctggaaggttggtcatttggcagaagcagtggcaaagccagcctgatgtgttggattgcatgcagttggttcaatgcatagcctctattcctccacgctggctgctttgtgtgctcactgtgccagctagagatagcagatgttagaggctggcagttgctaactagcaaaatcattctgaatacttggttgtttagtatcttccatggtacatagtctcagatcaacattgatttatgatacaaaaatgtttaacttttattcccattccaataggtccatccacatgcttcttccccaggattctttgttactgatcttccaactggacagtgactgatcttagtgactggacaggacactgatcaactgtaaatccatttgccactgcccatgagatgctacattcttacctcaggccacttctttttccacgaaaaatagacgaccagctgcatcttttgaagaactacctatgtggaggatttctcctaattaatgacatttagggacaccattgagtgaagctgcagtgctaccatagtttttttgttggtttgtctttcctactgaactaacccatgtacaaactgtatactcttcttgatttttcttgtaatagctaggcataagggccctcccctgtgctgccatcagtgtgaagtgaggcaggggtgctcataaaacagtggaagatagatctccttgtggggcagttcacttgtgtgttcatctctactcatgccagatcctgcaaataccacatccatcttatagtggaatgctgctgggcctgcttagccatatggcttggtggatctgacacaactcacacaatttaactagttatgcatgcatgatcccttgatatgcccatgcactaacatatgtcttttatcacttctctaaattgaggatcctctgggttttctcatggaatgtagcctgctgctggatctctcagccttatgtagtgtatcactgtatactcatgttactctccaagtttcctctggaaaatattttctaggtcctgtacctttctaatattatagttcctttcttctctgagcacattcagcactctccctgctaggttatgttgtgactgaaacctagttgttcgctggagactagaaaaggaattgaaatagatcctgaaataggcttatgttgaaagcaaggtagaaagagagggcaatgagaatttgcagggagtaacttctgaaagtcaagaatgttcaggggaatctgaaagctcaagatttgcaagtaaatcaacctagattgttcctatctcaagccataggctcctactccttccaatctgggttctataaaagtatagcagatttgctgattgagaatttagccttttcttgagttctgctactcttaattaagttctcttctgattcttagctttttgtaagaatgagagtatattttttgttgctaaagaaactctcggccgggcgcagtggctcatgcctgcaaccccagtactttgggaggccgaggcgggcagatcacttgaggtcgggagtttgagaccagcctgtccaacatggtgaaacctcgtctttactaaaaatacaaaaattagccgggcatggtggtgggcgcctgtaatcccagctactcagaggctgaggcaggaaaaccgcttgaacccgggaagtggaggttgcagtgagccgagatagcaccattgcactccagcctgggcaacaatagtgaaacttcatctaaaaaaaaaataaataaataaaaataaatgaaaaatagaaagaaactctcactttttccctgaatacttactctcagtctttcaatgattttcaccaatgcattggtcaatagccatctaattacatagtgcttatataattattacttttgtagaacctctctaaatctaagatattacatctgccagtacattctcttccaccgtctaatcccattttaccattggtgaaattttaagtcacactgttaaaacatgctaggagatatttttctatgtaccattagtgaagttgtcctcattgccagctagccagcgggtaatccagcactcaatcccattttcaaatattttttgtaccactcctggcaccaactgtctaggtttggttcactggaaacagactttgaggtggatattttcatgcagggaatattctcaagaataacacctgtaaaaagtgaaagaagcaggaactgaagcagaaaaaagcaaagctgaacggggatgcccttgcaacagaggcttcaactgatctcacacagagtttgaaagctggcatggccttccagaatatctcaaatagtgggagggatacttcccttcatatctctgcattgaccagacactggatgtaggtttccctaaggagggggcataaacttggctgagaggtttctctctggctgagggaaatttctgtggagagagccagatgtgtatttgcagctatagccactcctcacagccaagggtatgaatacctcagtcctgaaggatgggaataggaggcgtaccacaacatacactgcaagttatgtgaagaatcagttatctgtgaacctcttaggaacttttaagaaactggttatctctgacatcaatctcttccagcttatgtccatcctcaaagacagtcagcaacatcaaaaaaataaatttcatcatgtaactctccatcccaactgtgttcctagttgccacaagactgcatgatcaccagagcttaacatacacaatcttgcgtcaactactctctttgatcttctttccaaccattgcacacataaattctaattttctatatacattagtatttttgaaatatcggcctgatatttctgcgtaaatctccctgacttcttttctctgcctgaaaattacctattcatagttcaaaatcaaattcaaatatttattcccatgagaagttgcagcagtgaagatacttttgtctgaaataacaggaagtgcaatattggcttaaacaaatagagtccttttcattatcacataacaaaacatacagaagtgggtgcttgattcaaatgctaaatcatgtcaacttttcatcttctatctctctgctctgacattctcatggtgttcttatgtcatggtttactatctaattttcgacaatcactgtcaaaacctcaagtcctatgatcgtattcaaaatcagaaacagggatctatctacaacacaaagagaggttggaaggagagagcgagagagagcaagagagagagagagaaagaaggaggaggacgaaaaggagaaagaggagaggaaagtcactgctcagaccattcttaaattttattaggatacttttccccggaatacccccagtagattttctccaatattttacgggacatgacttggtcacatgctattcctggatcatattaggttggtgtaaaagtaatcactgtttttgccattgaaagtaatggcaaatctgcaatgattttgcaccaacctaaaagatttaactcttacttgataccaaggcatcttcatgctatagttaattaactaaaagtttattcacaaggaagaagagatcaaaatactgtgggataggtagccatagtatttgccacagaagcattccatgccacttaccacgttgtatcttgatttgtttgtttacataactgcctcttccattagactaactcctcatagacatagattaggacttttaaaaaaatatcgatattatgtagcatgaaacctaacctgttataggtacacaacatttaaaaaattaataaataataaaaataatacataattgtcaaagacagagttttgaaaatgatcttgaggacctaggaaaatggtctggctcataataaaaaataagcaactgtctgttatgagcttttcactactataaggatactggagtgctttccttttggatctgtccatcctgaccccaatacttttcatagtcagtcatattttgtttaataatttttaaaaagtaaactccagtaatgacattttagtttagaaaaatgtagctatcgttaagaggcatcaagattcagtcttgagaataaaaatgtcattatttgtggtgtcatcatagtttcatgaatatttgaaaaaaattgagtcatggacattgcaattctctcatgggacactgggagattgcaatactgaaagttacaatgtaaaattaaaagtttaacttcttgtttgaaggtaatctgaaagcttaaatcttccgaaaaaccaataattcaatattcattaaaatcagatatgagtttatgaagacaaaaaacattttcaaaaaacattgtctcttttaatcctcaaagaaactatatataaaataaataataatttgctctcctcttttactacataatcattacaattatttcatgtatgtgttattctatatacacaatagtgttacttatgcttaggtaatccatttgtcagaagaaaatatctaagatgctttgtgctctagtaatttccatttttgattacattaaaaactatcactcaatgagataaagaatagaataagaaaagtgaatatgttagcctcatttgatttgaagcagcatttttatgcagcataataatgcaggcatgcctctctgtttattctatagttagtaaatgcgttgtcttggagcactttgaatgactcctgattataaatccaagaactacttatttcaattaaacaaaatgatttagcaattctgtcaagaccttgatgtctagaaatatggttcaattacgggagcttggtattttccaattagatatacaaatggagccaaattcagtggggccaaattttgaagtgaaaaattatgggatgagcatggtttgagaagttttttttgtttattctaaagcatcttgacaaaagagttttgtcaccaagagaagtaaaacacaagaagggccaatatcaagggcaaaggatgtgagggtcagaatcaaatcaagatttcttaaaacatcattagaacgagaaactgcacaatatctgggagtgttattaaaattctataggtagtgagcccaagaaaaattccttgattaagatcattaggaatgatcaaagtgttcaaatagcagatactgtaaagactgtatctcagtataagggaaaagatagaaacagatttgattgctctcatccaactaaccagatgtagataaggaaaccatacacaatgggattttcctaggaagtttccattttattcctgtccaggttagtgttcctcggtacagaaaatgatcattgtagtacagattccagagttcagaacctaatactaattcacaccagtagagtttttcaccagtaggggtcttacatcttgaaacagatcaattttggtgttgtttagagaacgataaaagacaacaaaaattaccacaactgcattgtatattattataatttttctattttattatcagttattgttgctaatcttttgctgtgcttaatttataaataaaactttattgtaggtatgtatgttaaggaaaaaaacagtttatgcagggtttggtactatctgttgtttcaggcaaccactgggaatcttggaatatattccccgtagataaggagggactactgtaattgttataagagtgaaaattttcctccgtgttaacatttttagctataaggaagctactatgggattggttctatacccatagacttttaaaactaatgaacagatatcaagtatggaaattgttgtgtccttcagcaatccctttaatgactttgggtctcaattttccctgacggaaaaacaaaaggataggattcagttacctctaaaatctaaggagctttaacactctgagtgtcctttttcttattgttctcccccttttcctattttgtggccaaatccagcttttgtattccctctactccatcctggataagtctccctgctgttccttgtcatccctgccaaaagatacctcttagagactgttagtcagagacattacataattatcaacaattccagactataagccttaatcagggagaggactctgagaaaacataaaagcaacagtcattagactgaaatgagtgggcaagaatatcatcaaggccaaaatgtgtttcatgctggattattcgttttgttttcctttactttcttctttttttaaatccttttattttcttacttgggaaattcccagaaatattttgtccaaatcatatagaaatggcaagttataaaggcttctttgtatctcctcctcatctcctagcttggtagaccctaataatttgtaataaaccgattagctggatatacagtttgccagtagtggcttctgcttttagtgattacatatgttgtaaaatatgttcatttatgtatacataaacatatgtacatacttttttttctgtttcaactttaaggataagtcgaagatttccagcttgtgctgaaaaatcaaatgactaagatggccaactagatgcagccgggtggaacagctgccaccgaggaactgggacaactggcacactcccaacagatcttcagagagaagccactgagagtggatggaggaaagacacagaagctgggctgaagagaaaggaaaactgggaaccttgcacgaggctaccacacacagagagtttttcctggcccctgacaactctgggggaacaggtgagttgaactggaaaggagcaacttgctcttgccacaggcctctggaattccagcaggaagagacgctttgaccaccatggaaacttgagttggcagggagagcttcttagaaaaatagtaggaaaagcacaccagccaatgtggagcccagagggtttggtgtgggagcatctgtagcagagcacggcgaggaatgcccatccccataggctcaacttgatcccatagaagactttagccctaggggaaatattggacctgaactctgcaggaaggccttgcccactagaaggggccagttccacctgatcatcccttggtctgctggtcattcctggggagccaccttggctgcacctgcttgtagtgcaaccttgggtgtcctgggggcctgtgtcatacctcccgcactgatggaccatgcctgattaccagagagctccagtggcgcatccctcatgaccatgcaccaacctatctacaccctccctaaccacagcttctctggacccacagccaccccccccgcccacattactttggcagttcatgtgtgcaggtgaattttgactccccagccccactagcatgcctgtgtgtgtgcaccctgccctgccactgctgccaacgggagtgcacactgccctccctccccacttttaccaccattgcagtcggagccttggcgggcaacaaggccaccatccccaccctggccagcaccctgcccctgcaccaacactgctgcaagagtgaaacaaggcaaagaaaatagcggatcctcttattccctgagcaaccccacctatatgaatctgtacagacagtgcattcagacctgtgcctgcctgtgccctgcccctgtgccaacacccctactggcacaaacacatgcacagttgctagcaggagccctccacatccctgagccatgctgcctcaactgcttctgtgaatgcccacatagaagcaagcaccccagcacacactagcaccctgctgcagctgaggaatgtgtgtcctaccatgctaccgctgccactgtcgctggcatcagcaaactatgatggattctgccgccactgccctacgaaaagctttggcttgcaccacctatcaaagtgtagagacaagtggtctgggagcaccttggttcctccaattgcggtgagttcctaaacttgaagagtgagagaacaaagtcggggcctgatacaagtcccccagacttagagcaagcagtccaggagttgggagctgagccttggccccctacatcttccataaataaaaccagtctaatgaacccacctagtaccacaatcaaaccctcaaggacatcagatgggataaaggaaaaaagcaacttcaaaaggacaacaacttcaaagaataaaggaatatcagcccacaaagatgagaaaaaagcagtgcaagaactctgacaaataaaaaagccagagtgcctaattcctccaaatgaccacactatctttccagcaagggttcttaacgagactgagaaggctgaaatggcagaaatatagttcagagtattaatagtaatgaagatcattgagatgcaggagtacattgaaacctaatccaagtaagcaaagaatcagaataaaatgatacaggagctgacagacaaaatagccaggatagaaaagaacataactgacctggtaaagctgaaaaacacactacaagaatttcgtaatgcagtcacaaatattaacagcagaatagatcaagttgagaaaataatctcagagcttgtagactagctattttcaaattgctgctttctgatgccttgcaatgctctgaaatttcaaagttgtttgtgacaaaacttaaactgcttagactctgcaactcccaatatgtctgtgattcttacggaggaaaaaaaggacaatgaaaagactagcaaaattgttttactagttaaaaatattagaaaatatgtgttcactcactcgttgagtaaacatttattagatgtttttataatctgctaaacatcataggaattggaggtaaagatgacacaaattacttttcttctgaaaggacttataatatttaagaggagacatactgtcaacaaagacttcaaatgtaatgtcctaagtgtaagtaatgtctaagatcatggcctggggaggagagaaactttggttgcttgtgaccagcatttcttcatcaacacacttgttttctgaagtgtcgctagcaatttgcaaaaagaaacaaaaacagtgcaaatactaacatttgtaaattactttcttttgctatttttataatatattcaggttaattttttatgcttacttggactcatttgtcttttgatgttttcttgaatggggcaaatgtggagatattagagctagcagaaagggattatataggaccttgactcattcttccttatgtcactgccaacacagagtactttaacagctgagagaaagaagaaaaaacatagcattccaaagctgagatttaacttactttaacttacttttctttccaactttacctatgacaatttttttataagcagaacttcaggtattcttaaacacacatacacacacacacacacacacacacacacacacacacactgtattatcattttctttaatgtatttgcaaatttggtggattttttttggtaggtggaggagtttcattaaaatctgggcatgaaaaacagaacatttcactcatgaaagtgacacgttggagaaatcctgagacccattgatcacaagattcagactatgctagaagaaagagtatttgccacattgaggagtttgaacttgtcattgaaactattttaagcattttacttatatgatcagatctgcatgttagaccagtccctcttttggatgtgtagagtatgagtttgtgttgactgaaaatggcagaaataatataaataaagatacttttgcaatagttccagccataaataaaagggcttggtgttagtgttgagtggagtaggggaatgactctagagaggtggggacagatttgagatatattacaatggtaaaatgtatatattagtaaccaatatgttctagttcaggtttctgccttttattatgaagatcgagacagatttggaggaacaaggtaatagatgaattttagaaaacactagagtttgagttatctctgaaatgtatagaagtgaaaagtgtagaattacatgaagcagtcagtgttaaggtatggggctaaatatagtagggctgactggagggaaatgcttgggggttattattggtttataagtggaaacttaacatacgggcttttgattaaagagagaggctgagaaagggctctgagtaaacttacttgagtggttaaaaaagaaaaatgatgttttgattgaccttgagaagtagagatctgagatttgagcaaaaatctgtaacaaatttaaaaatgagaaaatgggagagtttgaaggagaagagattttcagcaatgacaatcaaacacagcagaaaaaataagttaaaactaaaaagtgccattatgatctgccaattagaaatcagtgagtacagcagtgagaatggagttgttgaaatgctgtagaaaatagcaagattacagtggattgaaaagttaatggaagctggcaaaattgtgccatcagatgaaccaaccctggatttatgcttcctgaggcaatgtccattcaagtgacatttcgagtctatttctcttcaacatttaaaactaatttctgaggatacataaacagatagtgtggaccaagaaagtacctctttttcttcagatgtttcttttactgaatcagctaacttattgaagcaggacctccttccgggcaagagaagaaccatattttggatcctgaatacacgactaggtaagtgcctctactctactagaatcttcaaataagtcctcaagttaaacttgcaaatagagaaccagctaaggaagaacacagtgtgttgtgagtataacactctatttgtagttgcacagtctggggagttaacattatttttcatcacaagcaaagctgagggacttaacataataatgtttaattctcatacaaatcctggttatgtgacttttcgctgaagatgatggtggtctctaagctcctttcatgttgtgtaactctatcttcagcaaatggttttaagattgctattacagtatttagtcatcaaaaggaatgggtttggagcttaaacatgtcacactgacatttaaatgtctcagttcagaaataacatactactgacaaccgctttcattgacgagaactagtcacatggccccatatagagtccaggaggctggggaatatagtttagcagctaggatatagttccccttgccttggaagaggaaatgggtttggtgagtatctgatcagtttctacaagagtcttccctttgcttatcacatatattattccttccttcactacatgtagacaacattctccccttcctcagaaagagatctcaactttccaccagttactccatccagctcaaagtgtaggattcctggttcctatacattcaacacagatgagattcccaatgctctggcaacctacaagctaaaaagataggtcatcttcttttcataccacatctaattaaaaaatgttggatcggaggcatattcacaacaataaccatccaaaattagaaagaaacaaatgggaacatagaatagttttcaatatgttcaattgtgaaatcccaagaaacagacagtgagaaagtacagatactgatctctgtatagaactcgcatctccattgttctccatggctcctgactttaccctataagagattcttccctgtccatgattctttttaatgacataaaaataagttttgaagattataccttcctagtttgctgtgcagctgttgtagctaccttgttatgcaatgattgttcaagactctttgaaaagttacattttttcagataaagatttttggttgattttgtaatacggttccctcaaaaacctagtaggcatcagatctgcatttttccatatgccagtgacctctctcacaatcctttcctagtcattgttttaaaatctgctttatttctgtgcccattcaccctttactttgttctctcaatataatggaagctatcttcatgaggctatcagtttgagtggagaggctatacccttagtcagacttttgttataaggtggagtcactatcttcaactgagaaatgttattacatctttgttgttcaaagtcttttctgatttcaaatacaactgaagtccagaagctcttgtttctttccagaactgtaagactataaatacgaaaaagtgaaagaattgtaagaaaatgaagaactgtaagcatatccatatgaaaacaatgtaaaactgaatttctcgaatcagtattccacttcatttatatttgaaatagacatattctttccagatatctatataaatcaaatatacctactgaccacctaaacttttgaatttttgctttttaaacatctttccctcaaattaaaacccagtggagtctagtctgtctcctaattattgcaggcaacaatgttaccaaatgtcttgctcattcataacacgccatctctctagactctgatgttaggttctttgttgtctcattcctattttcattattgtattgaaaattgtaatttttgttataaaagcactttacttcaaggtactaaattttgtattgttcatgttagattggctaaaatctcagtagattaacccaaaaagaaattatcgctcattcacatcagagttcaataaggtcaataatggaggtgtccactcttttaagtcacccagggaaacaggattctttcatgttgggactttgctcttgttatgattatcctttagagatgagattgattctcactcaaaatttggttttgatatcaagactcttgatgctatacacacacatactttttttttctcacataacgaggctttttggggagagcaggacaggctcccagtaggttataaatgtgttgagagagcagagagttgtgattggcacagggtgttcaagtggttagagaattaggctacacagagggttccgtcatgtgggtagagccatgcatggtttaaacttcccgttgaaatcaaaaaagggatcagccagattttatcagcttgccccaatatgagcagacgggggaaaggggagagtgaagcttgaatactaccagaagtcaaatatcaaaaactgaatccaactctattaaagctttcttctacatgtgacctccaaaattgctgggaaaggataagagagtggaggttcgtacactgcattagtttatggtataggtctggaactcatctttgtaacttccacctataatccattgagcatgactagtcatattcccacctctctttcaccttctcccaaatacaaaaaggtaaaatgtaatcatcctgcggacccaggaaaaatgtgagatggtttcatatacacttaggcccaggcctgatatgcttagttgtgtgatttaattatgaagattctgaaataaaataaataaccagggacgctataaatactcagatagtttcatcaagcttataaagtgataactatgcaatttcatgaatacagagcaataaaatctctccacaattctccatttgatgaattttatgcctttagcatatgctactaaggcaaagaaaaagaatatgaaagtgaagatgaatcattttgagcactttaaaatccctaaatatattgtattacacaataagcatttaagttgtgttttctatatgagggaataatcatgcggaataataaacaaacttgtgtcttctaaacagtgttaaaaccatgatggacgttttcttcttggcctaaacatgattttcccagagtctggtatgtaatgaatggtaacaaaattatgtattgaataaataaatgaataggtgaatgaatggatagatgaatgcatgatttggatgttactggcagatatctgcctattataaaatgctacttctattttccttcggttggagcatagaagtacactcaccgtgagtgagaactagtaggaagaaaaaacacagaaattagtgtcagaacaatttggattaatgacagtgttttgaaagtatgtcactgtgtgatgttggacaagttatcagtgggaatctcattttcctatagtgtcacattaggataggcttgttatgtgaattaagtaattaactgatacaaaatatctgaaatagtttgcatgattataaatgaggtttcattgtaattacatttttacacattctgattttctaccctagacattcccttcactccactcttctacacaaacccatatccaccctcctcttattctcccccaaccccaacacaaagagaccaccacagacaccatggataaaagccccagactatgaaaagccaggaaaggccttctggactatgtgtccttgaaatgaaaaataagtttttgacaaactattccatgaggtgatttcaagttattcataagaaatttcttctccatattcatttgttcaaattactttctgtggttttctgaatgaaattaatcttccttctgttgtgttcataaattctccttactcagccaaatcctttatctctcatcaagagacagaggtaatttgtgacttttaattttctcttctgataagtcctttactagtttagggacttctctctaacccaatctttctctcttttgttttgaaatgagatcttttattttattatttaagaattttgaatcctatgcaaatttttagctgagaaaaatgttgttacatccctttattttgctactaagggaatttataattgagttaaatattattgattacaattttgtgcattttatttgtttttctgtttttcaaagaccttcagtatttggcaacattaggatatagtagagcaaaagcaaagataaaatatgcatggaataaacaaatatcatgtaaaagcaacacagagccaaaatattagcacgaattagaacaaaacaaaaaagtacgtttaggcaaaacgtaatcattctgttcttttattttcagttacttcaatttcagtaaaaaggaaaataacaaaagaatccctttgagtgtatacagcagggaaacaattcacttcagaaatgaaatgagtcaagactgtacccaggcatggtggctcacgccgcctgtaatcccagcactttgagaagccaaagcgggtggatcatgtgatgtcaggagttcaagaccagcctggccaacatggtgaaactcccacctctactaaaaatacaaaaaaatacaaaacatatctgggcatggtggcacacgcctacaatcccagctatttaagaagctgaggcataagaatcatttgaacccaggaggcggaggctgcagcagtgagccgagatggtgctactacacgcacacacacacacacacacacatacaagtcaagactatgttcacaaatcaatggagatcagaatagtggaactttctgatgaacacaatttttataccattatctgatttgttctattttgttatttacctatgatgtattctttatgtgtacaccgagttttagcttctgcatatgtgcgaaaaaaattattgaaaagtagggaactctcagttaaagttttgcacaatatttactacaacaaactgatatataaatatattttaggtcaatcttttgagggactgatgtagaaatgttattgccaaggaatgctcccaagggaaagaggagacaaatatttcttgagtctctaatccaaatgttcagtgtttatttttcctcagtctttcctttgaagagatttcccaagtacccctaaactttccgtttttaagataactttaacattttgctctttatcgtccctgtcttctgtattagcctccttcccattatgtttccttttctttatgttgatcttgtatttgagctagaaatattcttatgactttcaagtttctcaggtgacaatttagattttatataacatgaagcttatataatcttgaggagactctaagaaaaagtacataaatttgttataaccagacaggactttgtaaggaatctgtggaagtgaaagaccctggagtttgagcttcactagcttcatgatagatctgtgcattatggttaatccacgcctttcctgctctttctttccatttatttctcagcatacatttactagaggacaaaatataacaaggcttctactgttgttattcagtgccctattttcactaactgaggtagctagttgtgtaaagaagcaactgtggacttggtagaaatccctggagattaaattcataccaatgtatatctgtcaaggaactaaattgaatctagatcggactcaattgtttagccatgcaactttcactttgaaagagaataagctgaagataaagaggcatggataaaaagagttacatattgaaaccagttttgtatttcttatggtgaaaattaatacataaatacaaaaggaattttggaaaaagttgcaaagagtgagttaaaagatatatcaacctatttatttataatgagctgatctttaatactcctactcctactgctagagaagcagtataaagtgacagaaaaactgcagactttgaaattaaattgacctcaataaaaagttgagtctgacactctctgtgagattataacacctctgaggttttgttgtatcaaatatgaattggagaaaagaatgaccaggttgtttagagttttgttatagtatatgtgagtgtacataaataaagttaaataaatcaaagttatttgagtttcattaataagctatatacctatatacatatatataatatgtatgtagcatacacattaatgaatataattggcattaaatgaggattaaagtttaaaggtgtacgatgatccatatttagggcagaacagtaagcacattatttacatacttttcactttaatttctatgtccaaagtatttttccaaaacgattttgcactttataaaattgtggcaataatggaatgtcgttgtgaattttaaacgtattatttccttcttgccttccaaaccttgaaccagagaaccacacactatcaccccccaactgaatgataacaactgtaaattaagctgatatctccattaagcatttatatttataaaaacattaaagtaacatttttctatccttataagcactattctatttaaagtaatgagccaggttgaacataaatgtatctaagctatgtgaggtcaaaagtattaatattagaagtcttagggaaaacacagtctggaacaaagggcagttagtacctaagtcaaaagacacatacaatgagagagacctgtggagaattgtttcccattacgagccaaaatcacaatcttgccctacaacagtttgcaaaagttatttttctctattacaaacataaatatatatgtttgtttaattgttattgtatttaaaaatcatttataatttaaaaaattatggcataatttacatgcaaaatcttttacattttaaaattacacagttcagtgagctttgacaaatacatacacccacttcaaccaccatcccagttaagataatgaacacttctatcattccagaaattttcctccttcccttttctaagaaatctatcaatctaggcagaggcaaagactgttatttatcacttatttttttcctagtctacaattttatgtcaaaggaagcacatagtatgtacacttttgtgtcttgtttcttttgatcaacgttgtttgttgttgttgttgttgttttttaagacgggtctcgctctgtcacccaggcgtgatctcggctcactgcaacctccacctccccaggttcaatcgattcttctgcctcagcctcccgagtagctgggactataggcgcacgacaccatgcccggctactttttgtatttttagtagagacagggtttcaccatattgtccaggctggtctcgaactcctgacttcgtgatctgcctgcctcggcctcccaaaatgctgggattacaggtgtgagccaccgtgccaggctgatcaacatcgtgttttgagatttttttacattgttgtgaacatcagaagttcaaatcatttaatacatacttagcagtgaattcaagaaacataggacaatattggtaaacatttggattgtttacaagttttgtctaaaatgattaaagctgttatgaacatccttgtgtacatatttttgctgctatatatataatatatatattttgcttctctaagatacaaaaaattttgttttgttttactctaagaaactcagttatagtcaaaggaaaggcaaacaagtgggtcaaaagtcactctcacatattgttgctgggagtgtaaatggtgtaaatgttatagaggtaaattggttagcatgtaacaaaaatctttttcatattgttttatagttgcaaacatataatcttatgtagatttttagaaatgtgattgaattcaagggaaacatgcttatgaagaaactaagatactggctgggtgcagtggctcacgcctgtaatcccagcattttgggaggccaagtcaggcagatcacgtgaggccaggagttcaagaccagcctggccaacatggtgaaaccctgtctctactaaaaatacaaaaaattagccgggcatggtggtgggcgcctgtaatcccagctactcgggaggctgaggtaggagaatggcttgaacctggaggcagaggctgcagtgagccgagatggagccattgcactccagcctggacaacaagagcgaaatttcttcttaaaaaaaaaagaaagaaaaaaaaattgagatatttatcttaccttaaatcaagacttattctaaagttatagtaaatgcaattatgtagtgttgttatagatagctagacctaaggaatagaaatgaaaaaactggctcatatgactcagttgatttatgacagagatagcactatgtatcagtggggacggaaatgactattcaacaagcagtattgagataataggaaatttaaatgagacaaaaatatatttaatccctatctaataccatgcacacaaaatgtcaattccttgtgtagtaaagatgtccatgtgaaaagcaaagattaaagtacttaaaagataaatttgaaaaatattatttagggcatctccatatagtaagacataaaaagcataaatcataaaggagaggattaataaatagaacaacattatcttaagatgttctgttcatcatcaaaaaataaaagtcacacactgagtttggatagtttcaaattataaaactaacaaaaattagtttctagaatatttatatttgaaaattgtaatcatcaataaaaatagaaactattttttggaagaaatagtcaaaagtcaagaaaagttattttataaatggaaacacgtaatatacatataaagagatatttagtttcatcaataattaataaatataaattaattccacaattagagattatttcatactcaccaaattgacaaaaatagagagaatatgataataataataattgttgacaagaatgagagcttatgaaaatgcttactggttgcaaattgagagcgtaagttagttctcattaggttctgatgggagtgtcagaaaacctaaattatcagtgaattatcctaaatagtggcttatttcgccctcacatagtattaaatatccatcactattattgagattatcatctgtactatcttcattccagcaaggagaaactaaaaatgagaagtatggtactcttttacctttcaagattgcgcatcatctctgtctacatcccattggtcagaactcagcccatgagctgcaagggacggagaactagtctgtcctacaaacaggaaaaattgtggttgtttcagaaaacaatctgatattatttgacaagttaaagaagcataaacctgacaaaccaacaactaaaatactaaggctatatcccagagacacacatatttacaaggagatacggacaagaatgttcaaagcagcatttatttaaaaaataagcaaaaaaaatccgtaactgttcattattcaaagaatggaaaaaatgttccatattcaatgaaatactgtaaaggacagcaacaatttagaaatatgatattgagcaaaaatgtatgttatacaatcatacaatcttccagtagttattttattccacaattactatactacacaaaatgtatctttaactctaagatcctatctctcaagtgggttcacatgaaccctacaatttggctaaaaactgttatttggtttcagcttttggcttcagaatttggaaagctgaagagctaaatatctacttcattgttgtctctggcagttttgaattgaatttcatcatgtgatagcctagcttactttattctaatcagtgcaacaattaataatacatataagacatatctgggctggacgctgtggctcacgcctgtaatcccagcattttgggaggccgaggcgggcggatcacgaggtcaggatgtcgagaccatcctggctaacacagtgaaaccccatctctactaaaaatacaaaaaattagccaggcgtggtggcacgcgcctgtagtcccagctacttgggaggctgaggcaggagaatcgcttgaacccaggaagcaaaggtttcaatgagccaagattgcgccactgcactccagcttgggtggaagagcgagagtccgtctcaaaaaaaaaaaaaaaaaaaaagacatatctgaattcatttgaacactggaataactggaatacttgcttttaaagataagtttccattataagtataacttgaaaaaatcctatgtgttgtatgtgttgaatttctatcattcagtttatatgtaagtttatatttacttttacaagagtatattttgtgaagatcgtaaagtatacacaaaatagttgttaagaattttcaaatagttaaaaaggaaatagattgccaagatgactattaagggactattacctagaaaatttatggatgacacaacattctttttgagccaacaaatgtgtgtataaatttaagtgtcaattccaggcagaagagactacagtgtttgacatatttgcttcaaacagctttatgaaagctttttacttagttgtatttacttaattccatttaagtcttgaatctttcaagtcctgtttctaaatccttcacatcttgtgaagatgaagtaaaagcagaatattaactttgccaccccaatatttcctcaggaaaaccccaaagttatataccacacataatgaagaaaaaacagagaagtcaaaaagaagacaaagtgagatcctcctccagaaatgctagttgaaagtcaatatgtagagcataaaaaatgagcagtgaagtgattcctggggcaatcctgaagtttaaaatggctgctaaacttcaattatattataatataattgttaatacaacattttatatgtatttttgtatcccagaagttgatttatggcattgatgaaatcttgttttcagcttttgctcatttggcattttgcaaaaatatgtactcagtgccttctattttatcattgaggctcagtgcttgggcttttcctttttaaagaaaaattagaaatggatacgttcatttttcttttagatctgcttagcctggttctaagttctaaaataaatctctgcttattagtttatcgatcctttttttattttacattcatttttccactgcttctatgcagagagtaagtctgaactatatatttcaaactactctgaatcttctctgacttaatcaattttattctctaagacagagtattttaggcacaagtatttctgtcctttaaactcttagtatttcaatttcattcaaatgtttctctttcttaacaacaataacacattatacttattttaaatatctttccacttgtttatgaataaaatctaccctccgactttaggcaacaacaccatttgggttaatgaatgctgaaaacttggtccaaatttttgtaattagtaaattctggttgaggtagagatcatatgatgaagttttagactagagtacatggagaacccattgaatttcctaagattggacaatctgttccctcagccttatagtaaaatgacattaagagaagctgaattgggggcttctgaacaaggattacccacttatatctggcaggcaacatataaactattggcctttatctctcatgattctgtctgctattgcaagtttaaaattcagcatatatatttggctgagaaaacaacagaggttttttggttttgttttgttttgtttttccttttacccgatgcacaaatgcttggaaagctcaaacacttagaaatgcaacttgttttgatataggccttaactaggactaaatggctttcttctttgatcatgtaatccttgtgtcagcagattctgcgtggttaaaagctaagctactgtgggtcagggtaaggtcagccagaagttcctattgtttatgcttactgaggcctgccttgcctgaaacagttaaaaacctaccaaaatataaactgctgcaatccaccaaggtcaaaaagccacatgacataaaagcattgatatatgatgtctcttgcccaggctgtgccagaaacataatcttttattctccaaatatcagctcaaggtttccatggaatgatgcaagatattggggtattaggtgatcattgaatagcaaccctatggcctgaacccaagttagaaactagttgagagacaggcaaaaagtcaaattttctcccgttctgtgaattgtctcttcatttggctgattgcttcctttgctgtaaagaagatgtttttatttgatgtgatccaatttgcctattattgctttggttgcctgtgcttgtggggtgttactcaagaaatttgtgaccagatcaatgtcctggaaattttcctcaatattttcttacagtagtttcataggttaaggtcttagacctaagtctttaattcatttaaattggatttttgtataaagtgagagacagggatcaattttcattcttcctgcatatggatatcaagttttaccagcaccatttattgaggagacaatcttgtccccaatgtatgttattcacatctctgtcaaaaatgagttcactgtaggtgtgtggatgtgtttctaggttctctattatgttttattggtctatctgtctgtttttatgccagtaccatgctgatttggttactatagttctgtaagataacttaaagtcaggcaatgtgatttcaacagttttgttctttctgctcaggaaagctgtggctattttgggtcttttgtgattccgtataaattttagaactgtttgttctatttctgtgaagaatgtcattggtatttccgtagggtggcataaaatctatagattgctttgggtggtgtggacatttttacaatattgagtctttcaattcatgaacatgaaatatcttttcatttttttggtgttctcttcaatttattccatctgtcttatatagttttaatttaatttctttcatttctttggttatagacattttattttgtggctactgttaacaggattatttaatttttttttcagattgttcacttctggcatatagaaatgctactgagttttgtatgcagattttgtgtcctgcaactttactgaatttctttaaaagttctaatagtttctatgtggagtctttaggtttttccaaatataatattatatcatctgaaaacaagtatattttgacttcttccattccaatttggatgccctttatttctttttcttttattattgctctggctgacttccactactatgttgaataacagtggtgaaagtgagcatcatttttgttttccagatcaaagaggaaaggctttctgctttccccattccgtatgatactagctgcgattctctcatatatggcttttattatgttgaggtatgttctttatatacccagtttttgagggtttttatcacgaagaaatgttgaactttatcaaattctttttcagtatcaattgaaatgattatgtttttgtgcttcattttgttgacataatgtatcacattgattgatttgcatatgatgaaccatgtttgcctccctgggatagataacacttggtcataatgaatgatcttttcaatgtactgttgaattcagtttgctaatattttattgaggacttttgcatcaatatttatcagatatattggcctgtagtttcctttttttgatatgtctgtctggttttggtatcagtgtaatactggcttcatagaatgagtttggaagtatttccttttactctatttttgaaagcattttgtgtaggattggtattaattcttctttaaatgtttggtagaattcagcagtgaagtcatgacgacccaggcttttctttactggaagacgttttattacaacttcgatattgttacttgttattggtctgttcaggttttgtatttcttcatgggacaatcttggtaggttgtatatgtcaaggaatttatcaatttcctttagacttttcaatttgttggcatatatttgctcatagtaacctcctttgaatttctacagtattagtcatagtgtctactttgtcatcttcaattgtatttatttgggtcttctttcttgttttcttgaataggcttgctaaaggtttgtcaattttgtttaactttacaaaacagcaactttttgtttcattgatgttttgtattgttttcttcatttcagttttatttattggtgctctgatatttattatttcttttcttctaccaattttgggtttggattgctcttgcttttcaagttctttgagatgcattattaggtcattatttattggaatttttatgtaggcacagtactaagtttccctcttagtaccgtgttcactgtatcccatatgttttgatatgttgtgtttccattttcaacttgttttaagaaatttatcaatttccttcttaatttcttcattaacccactggtcattcagaagcatgttgtttaattttcacgtgtctatatagttttcaaaattcctcttgttattgatttctaggcttattccattgtgatcagagaagatgtttgatttttttgtgtgttttaagacttcttttctgacctaacgtatggtctattcttgagaattatccatgtgctgaggagaaaaatgtgtattctgcagctgttagattaaatcttctgtaaatattaggtccatttgttccatagtgtagtttaagtctgatgattgttgattttctgtctgagagatctgtccaataatgaaaaggaagtgttaaagtcttcagttattactgtattggagtctatctctctcttcagccctaatgatatttgggttatatatctggatgctccagtgttggatgcatatatacttacaattgtcatatcctcttgctgagttgacccctttatcattagataatgaccttctttgcctcttacagtttttgtcttgacatctatttttatctatatatgtgtagctactcctgttcttttttcatttttattggcattgttatctttttccatccctttattttcagtttatgtgtacctttatagataaagtatgttttttttttgtaggcaacaggtcagtgggtcttgtattttcattcattcagccactcaatatcttttaattagatagttcaatccttttacattcaatgttattgttaatggggacttttactatgtgttttctagttgtttttggtcttctcttccttctattcatccttttagtaaaggattttctctagtagcatgtttaaatttcttgctttatatcttttctgtatccattgcgtgatttttgatttgaggttactgtgaggcttggaaatactatcttacagcccactactttaaaccaatgacaaatgaacactgactgcataaacatgtgaacaaacaacacacagaaagaaaattaataaaagtttacactttaactttgtccccctgctttttaagattttgttgtttctctttgattggttcatcatttagtctttctccataagacaagtgtagcttacacaccaaaattacagtgttaaactattctgtgtttttctgtgtgcttactattactgatgagttttgtaccttgagatgaattatttttgctcattgacatccttttctttcagattgaaaaactctctagcatttttttttttttttgagatggagtttcacgcttgtcacccaggctggagtgcaatggcatgatctcggctcactgcgacctccacctcctgggttcaagggttctcctgcctcagcctcccaagtagctgggattacaggcacccaccaccatgcccagctaatttttatatttttagtagagactgggtttcaccatgttgaccaggctggtcttgaactcctgacctcaggtgatccacccaccttggcttcccaaagtgctgagattacaggcatgagccaccgcacctggtcgaaaaactctctagcatttcttgtaggacaggtctggtgttaatgaaatcctcagcttttgttcgtctgagactgtctttatttctgcttcatgcttaaaaggttttttcagcctattctaagcgtcataagtttccaccagataaacagcaatgccacgaagacttcaaggtttaacacccacgattaccacaattattagtggctgaaataaagagattagcctttgcttttccatccaaaaaaaaaaaaaagatttttgccaaatataatattctaggataaaagatttctttcctcaacaactttaaatatattaagccactctcccctgccctataaagtttccattgaaaagtctgcagccagatgtatatggagatccattgtatgttactcatttctatcttttgctgactttaggatcatgttttaatccttgacctttgggaatttcattattagatgccttgaggttgtcatttttgggttaaatctgcttagttttctgtaacctttttacacttgaatgctgatatttttctctagttctctcttattatctctttaaataaactttataggtttatctctttctctacctcctctttaaggccaataactcttagatttgtcctttagaggctatttttactacctttgtaagtgtgcttaattgtttttattcttttttcttttgtctcctctaactgtgtattttcaaatagcctgtcttcaggctcactaattctttcttctgcttgattaattctgctattaagagactccaatgcattcctcagaatgtcagttatatttttcaactctataatttctgcttctttttaattatttcaattatttgttaaatttatctaatgtaattctgaattcattatctgtgttaactttaatttctttgagattccctcaaagcagctattttgatttctctgtctgaaaggttatatatctgtttcttcgggattggtccctggtgccttattttgttcatttggtgaggtcatgttttcctggatgttaatgatgcttgtagatattcatcagtgtctgggcactgaagagttaggtatttattgtaatcttcacagtttgggcttgttcatgcctgtccttcttgggaagatttccacgtatttaaagggacttgggacccaagaccaataacactatggtttttgcagactcatagaggcaccaacttggtggtcttggaaatgattgggatgaattctctgaatttccaggcagagacttttgtttttttcccatactttctcccaaatatatagagtgtctctttgttgagccacttggagctggggatgtggtgatgcaagcacacctgtggtaccaccactgggactgcactgggtcagacctgaaaccagcacatccttgggccctgcccaaggaccttccctttagggcagtgagttctccaaggccctgagtatttccagagatgctgtctgggagccagagattggagtcaaaaaccttagcaatttacctagcgttctactgtactgtggctaacctggcactaaaatcacaatacaaaccatctccctaacttccctccccttttcacaagcagaagagctgctccctgtggctaccaccaccactggttcatgggaagttctgccaggccactgctgatgttcacttaaagcccaagggctcttctgttagtttgtggtgaatgctgtcaggcctcggactcacctttcaggactgttaagctcccttctttcccagggcaggtccagaaatgctgtcccaccacctaggcctggtgtcaggaaacccaagagtcatttggttttccagtggggtcggagagcaaatgttgtaggcttctattccattatcttgctcctaaacctgtgttattcatttttagtatgagaaaagaacataatgaatggtcaaatatcatgaagaatactaaatggtaatgatctaacaaagatacttttgcagtaagtagaggagacatttgatatctttataatataaaaataaataaatatatttagagtttatataaagctgtaagaaacactttcaatttaaaaaaagaataaaaacaagaaagttactggagcgaaatacaatagctaataaaaaagaacaaatatttcatgttgttattgattaaagacacatatattaaagagaaagagaaataagattttatttttttctattaaattagtaaagaatttgtaaaatgcgaatgctaatgctgatattagtgagaaaggcatttttatgcattttagcaggaatataagagaatgaaaaaagaaatttgctaatatatatcaagtgtcttaaatatatcctaacaagtgatcaagttatttgactttcaagaagctcctttataaaaaacaaaaacaaacaaataaacaaaaaacccagctagaaatggacagagcagtatttatagtagtaataagttggaaatgtctcaatggaaactcttcagattcacaaagcagttgttcagccttttgcaaattttacattttagaaaaaataaacaaaaggactctgttacaactttcatccaaattgcatttttagtatgtgtattaccaattattaaaaatgttataattgctagttatataatgtctgagtggtgagcattgaattattatattttttaaagaatttaactagttttaataagttttatagactgtattcaagtataatttaagaaagtgcaaaagagattggttagctttccaatagtttgtgatacctttttggaaatcaatatcaaaaaattacgaagggtggagaaagatttattcaatatcttcttaatgtcagcctaaatggctagctggatagctggattaatactttgtgggcagaatgaagtaaatataaattctattcattttacgggttatatcaatacactgatgttttatatgaataagacaatgcaatttactctaaattatttttctgcaaaaataaaatattttacatttagaaaaaagcataaaacaaatacccatacagttatttgtatatattaagataaacttataatgcatgtgattcttattctacaatcttttctggacaatgtccttatagtcctcatcctacagaattgcctataaaattcactgtcagtcaatattgccaattgcctaaaaccttactcttccctggctgctcccatcacagctttgtatcaagtttccagaagggtatttaggaatatctctctgtttattcgaccacatgctgagatgaccacagtccaattcaatatggcctcctggtgatttgtagtgtcactgtgtctagcactgagaatgcatgaaacttggtcggcctccccatttacaggaggtagtcattttccttcaagagaagcaagagagtgggtagcgattcccagtagtcagacaatttaccagtctcaatttccctccagcatccccttttgctactttcaaaattatggtcttctttcttctagtgtaacactatcctttcaaggaacatagacttcagaaaaacaaaattcaaggagattgttgtttcctgtctatacaaaccttcctcatggaagcatcagaaactggtttgctttacagtagagaggaagtaaaatataaagaaaaaagaagaaagcatgaactagtaactcaacagccttagctagcattatttctatgaatgcttttctttgagtgtaataggattattttctgtattatcagcttgaagaaaaataattttaaaattcttatacaattaaaaagcaataaaaatttgtttccaaaaagatgagtttttagttaatgtagcaaataaatagtagtacctctggaagttttcattacatgcaatattcaatgtgtttcctagaaggtgaaatgatgtcaaatgatagctctagctataaggaaaacacatatagttaattccttatttctggaatcttttttacccccctttatctggcttgatctcatgttaggaaattaacagtgaagacttcatgcactaatttttgtggcattgtctgtgactgcctcttcagtccactaatgaagaaatcaatcttatttccaatggggccagctaatttgttctgtccctgttactgcagagtataccattcaccccagccagctattccactttcagcatcattggtcatgggaagaactggatcagataacatgaaacagcagaagagaaaacatttttcaaagcatcatttatttcccagtagggaaacgttaacattatcattccaaggacagtgatcccttttgttaactccaagtgtagattaagtcaaaccaaggtgagtatctcaatgtattctgcaaaaatctttctggatgtaaaaatatccaattccacttggaaattcttttgcatttttatgaagactcagacactgaaattgacagaagcaattcatactttggagactggggttacagcaattaacacacacaaaactatgtgctgcaaagcttttggttcaacaaaatcaatgttgaaattcctttcccatctccccacaaataagagaaatataattccaggtcctctacagtctcatagatcaagttatgcaaaacgtcattgaaagtgctgaataagagtacttcctgggtcattttcccatcctgaatcacacacaatttttattcataagaccacgtgactaaatacatctggttatcattttgggggagatgcaaaaggtaggcaaggacctcagtatgaatcctcagaccaatatgattgatggagaagtacattgtaactaaatgttatcctaaaacactttcttctgtttaccaattactattggaaaaccccaaaatgtctcctgggaaatatccacacactctggactatttcttagcgataataatcactgtatgtttatagcagtcattctttctcaattttatggtcccaaaattaatactgttaagagcattctttatttttctacttaaacctgacacttgttaagttaggtatttaagtgaagtgagtggaagcactgcaagcaaaacaaaagaaaattaaaaatataaataaagaaaaacaaaagctttatatgtgatgctagtagcagcttttgtgcctctcctttaagacagaatgccccctctattaacaatttcccagatgcttcatcaattgagtatatgcctgttcagctcctatgtacttagcaaattcattagtgtaacctaaaacatcctccatggaaaactgtgacagattggacaggtagcatgcagtgttgctctaatcgctggaataaatgcacaaaatctctcctgtgctaaaataaatactccaagaaatacttttttctacttaaattacgaaaaggggaaactagacaattctttggctagcttataaacgatacagttagttttaatatgaataaaagaatctccctgacattcaagtacgattactcatttttgtcacttaatctaggatggagagtggtaggaaattagactctaagtctattctattttactgttgatggtcagatgtttagggcaaactatctttcaacactcaaaacttaggtaaatgaacaagttagttatatgattgctgtaacaacacaaagtgatgcttttcaatgaaataagatatagatataagcaagctattagattatcgcttacatgtacattctctaacttgcatctaaaagtctctgggtagtatctgcagttttaacaagtaattaaatgaataatgaagcttcaaatccacagtataagaatagcactcatcagggttaagcaagacaagggatagctctgaggctgtgtgttattaaatgaaactggctctgtgtgattaaagtagatgcatgaagtcatattacatgttgtcattataaaatgacagcagtgatgataaatttaggtttacgaaaaagaaaattgcatctgtataactgcaattctattatgatttattttgaaattgcctgcttttatatagcacagaaagttaaagcatctctatcttgcccctttaaaagtctcccaactctcatcacatctctatgaacactgcactgttaaaaaggtctcctgaaaatttctcaagttctttcaatattacagcatctgccaagaaacataaagttccatctaaaaggaaacaatggttcatgacatttcttattcatgatacagttcatgtacttacaagggacagaatatagatgctggtgttgaactttgtctctttcaattagcctttgagatttgagggtttaaaatcaaataaatgctttgttatatatatttcactcatcaaagaaaatacctaaaagggaatcaaccttataatatttccttccaaataagcttctctatttctatttctatacagtatagagctacaattttctcaattataccagctcaaaaactcaaagtcatttttcagttttcatattggttatgcatggggctaggatctgggaatatgaagtaaaaaattctttcccacacaaaaacatagaacacactttggcagccagccaccaagatgtagcccaatgatcctcttctcctggtattcatacacttgtatattcccctcccactttgaattatggctgacctatttgaccaatagggtaccagaaaggtgacagtgtgagtcttccaaagctacgttttagaggacaatgcagcttctgccttcagattttcaattactcaccctgggagaaagcagtcactgtggtgtgaggacatataagcaagcttatggagaagcctatgtgatgggagcctcctgccaatagccagcaccaacttgtaggcacatgaataagttaccctgaaggtgaatagtccagccccagtcaagccttcaggtaattacatccttgcccagcatctgcctacaatttcatgagattcttcatgccagaaccctaccttccagccaaatgattccaaaatttctgatcctcaggaactctaagagataatacgtttttattgttgttttaagctgccaaacttttgaagtaatttgttacacacactcattatcaccatataataaggttccaaatattagaaattctaccttcaaatctcacatgatgcccttctttccattcccatgattaaaaccatgactcagaacctcataagcagctgggtttagcctttcatttctccacaacactgtagagttaatgtgctgaagttacagctctgaccatttcattcccttgatcaaaagttctaaatagttgtcaactaatttccaagattggtttccagttgtttattcttccatttaaaggccttttactatacaccatctttatccactgcttagcctccatattatgatgtgtatgcccaatgctggagccaaattgagtgtcagtcctgcctgtaggtattttcttatgctcttccctccacctgaaggccctccttatacatttttgagtatcaaagcacagatcaaatgtttctactttcatggagccatcctgtgtgtccctgctgtctgcaagggttttcttacaaggatgaggtaggagagctgcactttccttgacctcccttgctcctatttcttgtttctgcagcaatttcaactgcttgctccaagtgctgttttctttttactctactttattccatgctggacttcatctatttcattttattatctcagactaatgataaaaaactgctgtttatagcagacttttactaaaagtttaaggtaatggaggaggattatagagcagtaagaatcactgttaacactggatagagcttttgtaaaattattagcagaactctaagaacatttatgttttcctttccatgaccataagttcacgttttcttactaagactcagtttggcagctttttcttttactttctcaaacccctcatatttccattataccctacctcctctctctttggctattatttcctaagaagacttattgttttcccagcaaggcaaattgctcaaccaagatgatttgaaaataaagaaacaatatctttgagacaatttttgccacactttagacataatgaaccatagtagttatttattctcagataatcattttttgtatcacatgaagttttttctttcttatcttttcctgaaatttggtatgcccaagtaaaaaatagtacctttccaagtttaatttagtctttctctaaacgtttctaaataaacatttatttgctgtcatttgtctatgaaatgctatcctgagtctcagtatataatgaaataaaaccttgaacatggattcctaactaggtctactgtaatgtaggtatttctttttactacaagcccatcaaatcctctattgcctgcctgaaactacaattcttaaatatccgctgtcaaccactttcccattgaaactccctcctcctgtactgaatcaaaactcacaacaatcacttctcttttctatttgtgtagattatctgttccttgatcacatatgaaaccttggctcatgatagaaaatattttattaactcttttgacagcttgcaacgtattcttttttgcttctagtagatcttcctttaagcagcacttgaataattattttctgactgcttaactcaaattatgtcatttcccttctcagaaagagttcaattattctattaccaactaagacattaaatccaaattcatgttggtggtcatttaaggtcccttagttacacttctataattctctttccagccccctgtacttgagccttatttcttctcagtattgtttccagctggaatgtttttaagattctgctgagcctgtagcaaactgtcccatctctgttcatctcacctcagtcttgtttggagaggagagcggtttcatatcctttaaggatagaattactatttcagcttaaatcaacattcccataaagtagcatttctccaatattacaaagatttacacaagcaatgtatactgtattagctgaatatagatgcagaaaaatgtttaataaaatgtaggtgcaatttgctaattatgatgaaatagagaacagaataacaaactataaaagtatcattacgtacactcatcaatagataaatttcatcaatggagtttaatgttcaatattcctgtttttcagagggtaaggtaaaccactacagtgagggcaattcattatttaacatggtattagtaaagtaaggaggaacctttgtgcttcatggaaatatctaggagaactttgagtctagaaaaatagtgctagataaagctttggggaaaagatatttcagttttacaaaatataatatatgaaaagaaagatttgacccatagccaccttgatcccagttttcccatttcaaaggccattcaaattgaagttatcacacaaatggagcttctttgccttaggatactaattacataacatatagttgcctggtatctgaaattgggaaattcatataataattataattttggttagatacacctatttcatgtatttgtctctaaaagtcccaaaaaatgtaacgtattcagattttataaaacaaaagcaacatgcaaaaaaaaattcaaaaaataagtaaactataaaacattggtggaagaaattaaagaatgcataaataaatggaaggacatatgttcatggattagaatgcttaatatttttaagagcgcaatactgctcaaataatctacagatgcaatatctatgaaaaatcttgtcaatattttaactgcttttatttcagaaatagaaaagctgattataaaattgaaatgtaattgcagggaccacaaatagccaaatagaaaaataaatcttgaaaatgaagaacaaagttgaaactcttacacttcctgccctcaaaactcactacaaactataataatcaaagaagaatagtatcactataaggatagacatacagatcaatgggatagaattgagagtctgaaaggaactccatacatctattatcaattgatattcatcaagggtgccaagatgatttaatagagaatgaaaagacctgtgtcttcagcaattggcactgaagaaagtggatattcatatataaaataatgaaggagaacccatacttcacaccaggtagttacagaagtaacttctttgtagtaaaataaagatttaccattttaaacattttaaagtgtataattcagtaacgtttagtacattcacaatgttttgtcccttgttccagaatgtttttatcactccaaagaaactgcacctgctgtcttagtccattttgtgttactataaatgaatacccgaggctaagtaatttagaaagaaatctataagctcatggttctgcacactgtacaagaagcatggtgccggcatctgctcagcttttggcaaagtcttttgtgctacatcgaaacaacaaagtcaaaggtgaagtgggcatgtgagaagagggaccaaacccgagaaatactctggctttataagaacccactctcattctgacagaaactgatacattcctctgataaacaatcaagtcttctgagagacctcactcactaccaatagaattgcaccaagccattcataagagatcttcatccatgacactaatatctcccacaaggccccaactcccaacaccaccacactgaagataaatttcaacatgagatttagtggtgacaaacaaacccactaagcattcattctgcattatcctctcccccccagcttctggcaaccaccaatatgctttctgtctctatggatcttctcgttatgaatattttatataaatttgaatacctaatgtgttaccttttatgtttggattttttcacataacaaaatgctttaagttccaaacatgctgccacatgtattagtacttcattcctttttatagctgaataatatttgattatgcatctaccataattttttttccttcaacttttactttaagttcaggggtacatgtgcatgatgtgtaggtttgttacataggtaagcttgtgccacgatggtttgctgcacaaatcatcccatcacctaggtattaagcccagcatccattagctattcttcctgatattctccgtcctccactcaccctgtgacaggttccagtgtgtgttgtcccccagttgtatccatgtgtactcatcattcggctcctacttataagtgagaacatgcagtgtttggttttctattcctgcattagtttgcagaggacactggctttcaactccatccatgtccctccagaggacatgatctcattcctttttatggctgtatagtattccatggtgtatatgtaccacattttctttatccggtctgtcattgatggacatttacgttgattccatgtctttgctattgtgaatagtactacaatgaacatacatgttcatgtatctttataatacaatgatttatattcctttgagtatatacccagtaatgggattgctggattaaattgtattcctgcctctaggtctttgaggaattgccacactgtcttccacaatggttgaacaaatttacactctcaccaacagtgtaaaagtgttcctatttctccacaaccttgccagcatctgttgttttttgattttttaataataaccattctgactggtatgagatggtatctcattgtggttttgatttgcatttctctaatgatcagtgttgttgaactttttttcatatgtttgttgactgcatgtatgtctcgttgtgagaagtgtctgttctacaaggctacagcaaccaaaacagcagggtactggtacaagaacagacacattgaactatccaacagaatagagaacccagaaataagactgcacacctacaaccatttgatctttgacaaacctgacaaaaacaagcaatggggaaaagattacttatttaatcaatgatgctgggataactggctagccatatgcagaaaattgaaactgtaacccctccttacaccacatacgaaaatcaactcaagagggattaaagacttaaatgtcaaacccaaaactataaaaaccctagaagaaaatctaggcaatgccattcaggacataggcaaggaaaaagatttcataatgaaaatgccacaagcaatttcagcaaaagcagaaactgacaaactaaactaaaaagcttccacacagcaaaagaagctattgttagagtgaacagacaacctacagaatgggataaaatttttgcaatctatccatctgacaatggtctaatatccagagactacaaggaatttaaagaaatttaatgaaaaaaacccattaaaaagtaacccactgtaatttttttattccttcatccattagtgaacatttagttatttccacattttggctattgtgaagagtgctgctataaacatttatgcgcaagtctttgaacacctgttttcaatttttttagtatatacctaggaggggaattgctaggtcttatagtaattctacctttaacttattgaagaaactgcaacttattttacacagtggccaaatcatgttatgttcctacaaacaatgtatgagtgttataatttatccacattcatgtcaatatttgttattattatttttaaaattattatagccatcgtagtggaaagaaaataatctctcatttttcattcacattttcttaaatgactaatgatgttggcaatctttttatgtgcttattgacaatttgtatattttttggagaaatatatgttcaatcctttgctcattttataattgggttatttggggttttttttgagttgtaggagttttttatatattctgtgcttgatccttatcagatatatgacttataaatatttttcccattctttgagttgtcttttcactttcttgatagtgatctttgatgcacaatattttaaaaggcacattgcagtaatagttatgtagcataatcgaaaacatgcatgcatgtgtgtaagtttagaatacttctataattttagttataataatactagctcttgtaacagataagtccccatatctcagtggcttaaggaaattgaagttaatttgttgcttatgtagcatttaaaatgtgtctttcttttctaagtgagtttcaaacttctaagttgtgatttgggctccttcaaaatggggctctgccatcttcaacatcctgatctgtattaaacttgacagggaagaacacagaggcatgcacatggcaggtttttatgggcctggcctaaaagtgtagcacaacacttagggtcacatttcattggtcaaaatgaagtcctatggccatacctaactgtaagggagatagaaatacagtctagctttttgtccaggaataataaataatatgtttattgaatcgctaggtaatctctttcacaaatatttaagaatatagtaactgaacttacctctagtaagtgaggcaggggacagcagagagaaattcttaatttttaccctataactttctgtactctttgaattattttcaatagtcatgactgttaggagctgaattaggtccccctccaaaattcatatgttgcatccttaactctcagtacctcagaatgtgattgtatttggagaaaggcccactaaagaattgaataaagtaacatgaggctgttggtgtgcgctccagttcaatctgtgtgatagccttatcagaagaggaaatttacacatacaaagagacaacagggtcatgctgacacacaggaaagaccatgtgaagacaaaaagggtatctgctagccaagaagagagaccttagaagaaactaaactgtagtcttgaaattccaggctccagaactgtgggaaaataatttctatttttaagctacccactctgtgaacaaaacaaaacagtacatcactttctaggaacaactaagtttaaaattacctagagcatcagttggctcagttaaatactgacagtgcccatgtactgcactgaattacagttttcaaaatttgcagagatggagagttaaatctttttatctttttattttttaagtagctgagtttctactattgattagttttcaaatttttctaactttactttaaacactgaatattatgaccataagtgaaaattttatgtcctttgcatattgttgttgcttaagcaataagcaaaaatgaatctatagattgttaactcataattaatttaggaatttacagatatgctaaaaattaatggaagtctaaccacattgtgattggggtgacaactgctaacaatttattactgacatatgggaaaagctgcagtatggttttcatcctatatttgctctggattttttttcttcattgccctgcttttgcattgccttttctgtaacagtagttgtctaattctacacccaatagaattccatggaatattgttatcctatagctatcagaatcagcgtgttgattatggaattcttaatccaaataatccacatattctgtccccattccacaaaactcagcagctgtattttattttctattctatttccatgtccatttgaattgctgttgttcaaattcatgccatacataattccactatgtaacattaagtccccaaattctaacaaatgccttttcagtgtctctttcttgcacactactctacagtttgcacatacttctatagctttgaaaaaaaaatattctctcctatagtgatatgctctatctttcaaatgttctttcatttatggtaatatgttttctctttatgtaaaaaaactaaagtaagaatgtgaaacaagggaagttcggtggatgcttttcagttttaacacatagcgttcaggtctagctcatagtaattgaagacgtgagcccctagtcgtactagcaattctctcgtaattctctaaatgtgttcctgtggtcttcgctgttctctgaatttagtctggtgctttccacctctatttttatgaacattttatgttttctgtgatcatgatttgtagccactctgtgaatctatcgttaaaggaggatgggtatttcagaagctgatgtggggagtcagggagcagagtgctgccttcttttaaataactcaatacaattgaactgagtaaaaggaaacacagtgtttagccacagaaatagtcattatcttacaaaggattccccttagaatctcttttgaaatgttcttttgtgtatatatgcataatgtatgtgtgtgctcccttagaaaatgtatgatatccaattttccaacacaattttttttcttttaacttttattttagcttcaggggtacatgtgcaggtttgttatataggtaaacttgtgtcacaggggtttggtgtacagattatatcataacccaggtagtaagcatagtaccaataggtattttttctgatcctctccctcctcccatgctccaccctcaagtaggctccagggtctgttgttcccctctttgtttccatgtgttctcattatttagctcccacttataagtgagaacatgtggcatttggtttctgttcctgtattagtcactaaggataatgacctccagtgctaaccatgttgctgcaaaggacatgatctcattgtttttatggctgcatagtattccatagtatatatgtaccacaatttcttttttttttctttgagacggagtctcgctctgtcaccaaggctggagtgcagtggtgcgatcaccactcactgcaagctccacctcccgggttcacaccattctcctgcctcagcctcccaagtagctaggactacaggcgcctgccaccacgccttgctaattttttgtatttttagtagagacggggtgtaccacaatttctttatccagtctaccatctatgggcatttaggttgattccatgccttttctattgagaacaatgttgcaatgaacatatgcatgcgtctttatgatagaatgattttcctctgggtatatacccaataatgggattgctgggttgaatggtaattctatttttagttctttgaggaatcaccgcactgctttccacaatggctgaactaatttacactctcacaggaagtgtataaactttatttttctccgcaacctcaccagcatctgttatttttaaattatagctattctgactggtgtgagatatttcactgtggttttgatttgtatttcttgaattattagcgatactgagcttttttcattagcttgttggctgcatgtatgccatcttttgagaagtgtcttttcatgtcctttgcccattttttaattttttttttgcttgtaatttttttaaagctccttataaaatttggatattagaccttcgtcagaaacacagtttgtagaggccaaggcaggcagatcacttgaggtcaagagttcgagaccagcctggccaacatggggaaaccccgtctccactaaaaatacaaaattagccaggcatggtggcagatgcctgtaatcccagctactcacgaggccgaggcaggagaatcacttgaacccaggaggcggaggttgcagtgagctgagatcaggccactgtactccagcttgggtgacagagtataactccatctcaaaaaattaaaaaaaaaagtttgtaaatattttctcccattctgtaggtcatctgtttactcctttgacagtttcttttgctatgtagaagctttagtttaattacatcccatttgtcaagatttgctttgattgcaattgcttttggcgtcttcgtcatgaaatccagttcctgtgtccagaatggtattgcctaggttgtcctccagggtttttatagtttggggttttacatttaagtctttaatccatcttgagttgatctttttatatagtgtaaaggagttcagttttaattttttgcatatggctatccagttatcccagcaccatttattgagtaaggaattctttccccattgtttgttttggtcagctttgttgcagctcagatccttgtagatgtgtggccttatttctgggctctctattctgttgaatagttctatgtgtttgtttctgtaccagtaccatgttgttttgtttactgtagccctgtataattgtttgaagtcatgtaaggtgatgcctccggctttgttctttttgcttaggattgccatggctgtttgggccctttttttggttccatatgaattttaaaatcattttttctagttctgtgaagaacgtcatttgcagttttataggaatagcattgaatctgtaatttgctttgggcggtatggagagtttaatgatattgattcttcctatgcgtgagcatggaatattttcccttttgtttatgttatctctgatttgagtagtgttttgtaattctcactgtacacatctttcacctccccgattagctgtattcctacgtatgttattcttttttttggcaattgtgaatgggattgtgtttatgatttggctctcagattggatattgttggtgtacaggaatcctactgatttttgtatgttgattttgtattctgaagccttgccgaagttattctaatacaaatttaatggcctcctgtgtataaataatggaaaagtttggaacctatttggagaaaagcggtaaactgtttattttttctataaatgaaatcaagggcttttccacatgcagcagcagaccatgattataattcacagagtgaaattaccacctgaatcttggagattcttactgcatcagcaaatagcagaatctcttttgttattgtatgcacagagaggctctccttctaagcactcttctctcaatgccccccaaaaatgcagagcaacaagacctcctggggtccacaaactctggtatccttacaaaagtaaagataacagagaaggtaataatctctctggaaataagtaaaattattcccttgacatggaaaggatgttaccaaaaaaaaaaaaaatcctgtgggagaacaaattgaagcattctgtatagttttatttatattttatttatttgatatatgaactcagtcataccatgagtgtttactgaaagtataaagaaatagatgaaaaactgtggttctgtatttttttccagaaagtcaatatatctttcaatttactaaaactggtaagatcatctcatgctgtaatttatacaacccaaggcctccattatgtataattttgcccatgttgcttataaaatttaaaaccccctttttctattttaatttgtaacagtttataagaaaggcacaccatcattatgagttgagaccaaaaataccactgtgtaatcataatattcatcatcatgaaactaccaactatattgtattacaataataccttaatggttagtttggggggttttgtataaatatcacaagtattttattacatgcccagataattgggaaggaggcataataactactgatgtttataatcacatgctaattttctgctgccagtaactatggtattcattttcaatgtggtcagtagggctcagatattttattacattatagtgaatattgccagtagaatatttgaatattgatcttttatataaaagcataagatttcgagtttaaatttattagaataaatggatgtgaaatcttctctattgcagcattatgagaatatagatgtctgtatacctaagatatctaaagttgatttggtctatgaaaagtgatgggtacaacccaaactaattgaatggaattacatagtcagtgaaagcaactcttttgacttctgctttcacagaattgtcttcatcattgatttggtttcatgtatgttatgcttcattaaaggcaattatagaaaatgttttaatagtctgaaatgcatgtagaatccatttaggtttaatacaacaaaaatcctaatatttattaataaattactgcatatgctaagcatattttagccattagatataattatactctcaagctaactatacatttttatttttattttcaagaaggttaagtgactagcccaagattacacagtagcaagtagcacattaacttacctaaatgaagattcacaatgccctgaaatgccaagactgattctaagtacaggcgtactttggagatattgcaggttcagttccagaccactgaaataaagtgaatatctcaataaagggagttacacagcttatttgtttcttagtgtatataaaaattatatttacactatactgtagtctattgagtgtgcaaaggcattaactctaaaaaaaatcacgcatctgaatttaaaaatacttaattgctacaaaatgctaaagatcatctgagccttcagctaattgtaacctttatgctggtagagagtcttacctcaatattaatggctgctgactgatcaggaggtgatggtcgccataggctggagtgcttgtggcaatttcttaaaataagacaacaatgaagttggcaacactgattgactcttctttgatgaaaggtttctctgtagcatgcaatgctatttgatagcatttttaccctcagtagaggttctttcaaaatttgagttgttcttctcaaactctgcctctgctgtatcaactaagtttataaatatactaaattacttgttgtcatttcaaaaatgctcacagccaggagtagattccatctcaaacaaataaacaaacaaacattttatttgctcatccgtaagaagcaacttaactattcaagttttcccatgacactgcagcaattcagtcacatcttcaggctccccttctaattctagttctcttgctatttctaccacatctgtagtcactttctccactgaaatattgaaccccctcgaagtaattcatgaaggttgaaataaacttccagatttctgttaaagtttatttttgacagtttcatgcatcataaatgttcttaatggcatctagaatggtgaatcattttcagaaggtgttcaatttattttgcccagatttctcagaggaatgactatagcagctatagccttatgaaatgtatttcttaaataataagacttgaaagtcaaaattactactcgattcatggactgcagaattgatgttgtgttagcaggcacgaaaaagacattcatctcctcgtgcatctccatcagagtgcttgggtgcattgtcaataagcagtaatattttgaaaatcatattttttggttctgagcagcaggtatcatcagtgggcttaaaatattcagaaagccatgcttaaacagaagtgctgttgtccaggctttgttgttctacttatagagcatgggcagaggagatttagcatcattcttaagagctctaacattttcaggctggtaaatgaacattggcttcaagttaaagtaaccagctgcattaacccctaacaagagggtcggcctatcctttgaagatttgaggccaggcatcaacctctcctttttagctatgaaagtcctagatggcatcttcttccaatagaaggatgttttgcatccattgaaaatacattgtttagtgtagccatcttcatcaataatcttagctagataatcaggataacttgctgcaacttctacaccagcacttgttacctcaccttgcacttttatgttacggagatggcttctttccctaaaccttatgaaccaacctctgctgcttcaagctttccttctgtagcttcctcacttccctcagtcttcatagaattggagagacttagaacctttctcttaaccaggcttcggtttaagggaattttgtgcctggtttgattttctatccagacttctgaaactttcttcctatcagcaatgaggctgtttcactgtcttatgatttgtgtgtttactggagtagcacttttgcttcaataacttttcctttgtgttcacagcttggctaactggtgaaagaggcctagcttttaacctatcttagcttttagcatgccttcctcaccaagctcaatcatttctggcttttcatttaaagcaagagatgtgtgattcttcctttcatttgaacaattagaggccattgtagggctattaattggactgattttaatatgttgtatcccagggaatagggaggcctgaagagggagagaaatgggaggacggaaagttggttgaacagtcagaacacacacaacatttgttgatgaaatttgtcttcctatatgggtgtattttgtggtactcaataattacaatagtaacatcaaggaccacagatcacagatcaccataacagatatataataatgaaaaggtttgaaatattcaaaaaattaccaaaatgtgacacaaagacacaaagtaaacacatgctttgtgaaaaaagtgtgctgacagacttgcccaatgcaaggttgctacaaaccattaagttgtaaaaagtatcatatctgtgaagcacagtaaaatgaaacacaataacaaaaattatgcctgtaactctaaaacaaatgaattaatcaataaaaaagatctaaaatctccagaataaatattgcaaagcagaagtacaatgtagtgccatttttttcaaatattttaccctttatcaaatgtttatgaatggaattgacttaatgctaaccaagtagttgcaatccaccatataaatatcgagactaattctctgtaatcctggttatattctccttcaaatgacattaactatttttcattgtactaaaatatacataaaatttactattttaaccattttaagtacacagatcagtggcattaagtgcattcacattgttgtacaccctttcctaggcatctacagagctttttcatcttcccaaaccgaaacttcatactcgttaaacaattctccattctccctccccaagcttccagcacctggcaaccaccatcctactttctgtctctatgaatttgattactttaggtgcctcatataataagtagaattatacaatctatgtccattagtgaatggcttattgcaatttgtatgtgtctttaaggattattcatgttgtaacatgtgtcagaattatcctactttttaaggctgaatatgtcactgtatgtatataccacattttatttattagtttatacattaagggacatttgagttacttccacctttcagctgttgttaataatgctgctattagcacagacatacagatcatctgttccagtccctgttttcaattattttgtgcatatgtccagaattcgaattcctggatagtaaggtaattctatctttaattttttgagaaaccgccagactgttttatacagtggctgcaccatttgaccttctcatcagcaatgtacaagggttccaatttctccacatctatgccaacacttaccatttcctggttgtatttgttgttgttgttgttgttaatagccatcctaatgggtgtgaattttgatttgcatcctgtaataattgatgatgttgaacatcttttcttgtgcttattggacatttatatacctttgaagaaatgtctatttaagccctttgcccattttgaattgggtatatttggttcttgagatttagcagtttttaatatatggtggatattaatctcttaccagatatgtaatttgcaaatattttcactcattttatgtatttttttcactctgttcatagtatattttgacacacaaatcattttaatttggatgaagtccaatttatttattttttcttttgtttcctgcgcttttggttatcatattcaagaaattattgccaaatacaatattatgaagcttttcctctgttttctcctgagttttattgctttagatcttatagtttagctctttgatccagtttgttaaagttttgtatatgaaataaaatatgtttctaactttattcatttgcatgtggctatccagtttctccaacactgtttttctttttggcattgaatcatttgccactttggtcaaatgcaatttgaatgtatatataaaggtttatttctgagttctctattatattccatgtatctatatatctgtctttatgacagcatcacactgctttgattactatagctatgtagatttgaaatcaggaaatgtgacatctctaacttttttatctttatttttattattattattataattttgagatggagtctcactctgtcgcccaggctggagtgcagtggtgcgatctcagctcactgtaacctccgtcctctgagttcaagcgattctcctgcctcagcctctcgagtagctgggattacaggtgcctgccaccacacccggctaatttttgtatttttagtagagacggggtttcaccatcttggccaggctgatgttgaactcctgacctcatgacccacacgccccggcctccgaaagtgctgggattacaggcttgagccactgcacccagcctatttttattttttaccattgttttggctattctgcatcccatgagtttccatatgaatttgaggatggatttttctattttctgcaaaaatatttctggaatttgggtagagattgcattgaatctgtagattgttctgtgtgcaatagacattttaataatattaagtcttctaatctatgaacattgggtttatttgcatttatttacatcctccttaattttttcagcaatattttataattttcattgtgtaaatacttatttctaagtattttattctttttgatattattgtaaattgaattttcttatttattttgggggttgttcactggtggtgtatgaaaatgcaacttattttatgtttgattttgtatcctgcaacttagctgaattcatttattaattttaacaatttttataacatctttagaattcttcacacgattatgccatctgcagatagagataattttacttcttcttttctaatttagatgccttttctgccttattgcactttaattattattttctgatctaatcaatgatgatgattaaactcaattgtatcagaactcacccattttatagagaattttattttattttattttattgagatggagtctctctctgtcgcccaggctggagtgcagtggcacgatctcagctgactgcaacctctgcctcctgggttcaagtgattctcctgcctcagcctcccatgtagctgggactacaggcatgcaccaccacgcctggctaatttttgtattttttagtagagagagggtttcaccatgttggccaggctggtctcgaactcctgacctcgagtgatccgcctgcctgggcatcccaaagtgctgggactacaggcacaagccatagtgcccagcctagagaattttaaattaaatattcaactaaaattacatgtgtcatagataggcttacatatatgaaacaaatataaaccttggattcaagtagtttatgatttcttatgaagtttaattctagtactgctatggtttgaggtttctgtccccttctaaattcatgttgaatcttaattttcaatgcagcagtattatgatgtatggtctctaggaagcgattcagtaataagggtgttgtcctcatgaatgagattaggtttttaaaaagagtttgatggaaggaatttgccccttttcattctttccatcccttccacccacatgaggacacaacattcctcttctgaggatgcagcaaaaaggcgacatcttggaagcagaaagcaggcctcaccaggcaccaatcctgctggcacattggtctgggacttctcagcttccagaaatgtacaaaataaacttgtttttcataaattgcctagtcttaggcttttaaaaaatacctataacagtactagcagacaaagacaagtaccatatacttgcataggcatgcaccacataacaacattttggtcaacaatgaactgtatataggagggtggttacataaaatcataatagagattaaaaaatcctatttcctagtatttacaatactatattttttatcattattttagagtgtactctttctacttaaaaaaaaaaagttaacagtaaaacagttttaggcaggtccttcagaaggtattccagaagaatgcattgtgatcacaggagatgacagctttatgtgtgtcattgactctgatgaccttgcagtggtacaagatgtggagttgaatgacagcgatattgatcctgagcctgtgtaggcctaggttaatgtgtgtgtttatgacttagtttttaagaaaaaaattaaaataaaagcttatagcgtaaggatatagagaaaaaatatttttgtacaattatgcaatgtgtttatgttttaatctgtgttattacaagagtagaaaagttaaaaattttaaagtttataaagtacaaaagttacagtaagctaatattaatttactattaaagataaataatatgttaataaatccagtgtagcctaagtgtacagtgggttttttttttttttttttgagatggagtattgctctgtcgcccaggctggagtgcagtggtgccattttggctcactgcaaactccacctcccgggttcacaccattcttctgcctcagcctcccaagtagctgggactacaggcagccaccaccacacccgtctaattttttgtaattttagtagagacggggttttaccatgttagccaggatgatctcgatctcctgacctcgtgatccgcccgccttggcctcccaaagtgctgggattacaggcatgagccaccacgcctggccgtgtacagtgtttataaaatctatagtagtatatagtaatgccccaggttcacattcactcaatactcactccttgactcacccagagcaacttccaatcatgcatttccattcatggtaagtgccctatacaggtgtatcatttaaaaaaaaaatcctttatgccgtaattttaccacactgtttctatgtttagatatatgtagatacccaaatacttaccattgtgttagaattgcctatagtattcagtacagtcacacgctgtacaggtatatagcctaggagcaataagctatactatgccgcctaggtgtgcaaagactataccacttagttttgtgtaagtacactatataatgttagacaaaattgtctgaagatgatgcatttctaagaacatatcacagtcattaagtgaggcatgactctaattcaagatagacatttaagagacagaaactaggtgatctgctgcttttcccattgttacgattaccttaagaggcaaaggaacctgcactcaaactttggttctgatgtctgagaatgatgatgccacactcataccaagagggtatgaaacggttaattacttatttgaaatctccagggagagcatgcaggcttaaagtgacttgagagcaagaaaagaagaattacctgttttgttttgttttttattttggctaggggatgggactgagatgagagttcctataagggcaggaatttgtgttgcttgaatttcttgcccctgtcagagaacaaagaaggtaggttttcttattagcttgcccaggtgcagggcacagaagggagaggaaaaggtctggcataaaagctgtcagttgtaaaacatttaaaacatggagtcagactccctatgtaacttttctactgctggtgaacatttaatttgctttgagttttatgttattaagaataataaggctatgaatattcttgtacatgtctttggtaaatacatgaatgcatttctgttcgttatatgccaagaagtagaaaagctgggtcttagagtatgcttatgttctgtttcagtaggtactgccgagcaattttccaaagaagttgtaccaattcacactttcacccaaagtcaaattaagtcctggtagctctgcatcctcatcaatacttgatattttacatagttttaattttagtcattctatcattgttatttgcaggattaaagaaaataatgtgtagggtgttaaaatttggctctgtgtccccacgaaaatctcatgttgaactgtaatctctaatcttggaggtggaacctactgggaggtgattggctcatgaaggtggtttctaatgatttagcaccatcctcctagtgccgtctcatgatagagttctcacgagatctagttgtttaaaagtttaaaagtgaagtttgtagcacttcaccctttgttctctctcctgctgccatatgaagatgtgcttgcttcccctttgcccttctgccatgattgaaatttccctgaggcctccctagccatgcctgttatacaacctgtgaaactgtgagtcaattaaacttctttctgttataaattactgagtcacaggtagttttttatagcaatggcagaatggactaatacaggtgtttatatatttctagccccaaaacatgttaccatcatcatcatcatcaccatattaaaggcacattttgtattgcaaatatcaaggcattatcacattataaatataaaattaatagaaaattaacaaatacccaccacagagaaaactaaagttaataaattctgaattctgtgctgctcacagttttttcttttttcctttttttttttttttgagatagagtctctctttgttacccaggctggagctcagtggcatgatttaggctcactgtaacctctgcttcctaggttcaagtaattctcctgcctcagcctcccgagtagctgggattacaggcacacaccaccatgcccagctaattttttgtattttctgtagagatgtggttttgccatttggccaggctggtctcgaactcctgacctcaggtgatctgcccacctcggcctcccagagtgctgggattacaggcgtaagccaccacgccggcctcctcacagttttcttgtcaaacttctctgaatatgcacactcataattagtttctaatagatacagtattttgaatgttttcccccttaaggctattgatatgcaaatgttgttatctctaaattgagctagtctcgtgctttgaccccaggctgagcccagctggctattcggacagcctaagtgcacccatctggcaaaaggcaagtttgtatatatggactcttgtgtctccactgtaggtcttcagccagctccaggtgccttcagtacgctgcagaacttcttgcttacagtgcaaaactttttgcatattagtcagtttggttgattcaagttaaccatatgtgttcatttttaaaagaaatattttactactctctcataagctgcttattgatctactcttgaagaacaagatatagtgcaaaggacaagatctaaatagagcaaaaccagttgtcctgtacactctgcagggagacatgttaaatataagcaatttcaaaaatgtaacatttaaccagtattaatggtctgaaacaggaacttccttgacacaagagcaaaaacgaatccttctgggaaaattccgaaagccttgtttcaagatgctaaacatctggttggtcatataggaactcagctttactttttgccaccttcttcataatctttcttcccttgcctacacaagcacatggtctggctatacatccatcactgtgtggctgatggaaggcctaagtgctcagtgttttaattggagtgctttaaaatttcttctaagtataaagcctacagtgattcaagctagaaatttttgaatgtttcctaggcttgttatctattataaatgctgttatatcctaaatgtgttatgtacatgagagtagaagttcttaaatattctgtcttcattgtcttatacttactaaactcttgagagactccttttggagtataaaatgtcacaattcacttatgtaaatgttggctgcagctgaaagcctgttccacatttagcaagacaaaagaaaagggaataaagggcattgcaattgagcctatattatacaaattataagatgtttgttttacttattttcctttctttttgtccttttcgtctttcattcatgattgctgtcatgtagtcatttaggtagagggtagacactaataattgattaacttcatattttaacccccaggggctacttgcaagactaaagaacatgtttttctcttaaacaacaatgatccttaggtcatgcagacctccttgatggcatccagaagtttgatcagctgagcgatgcaagcagctttgatcatccagaaatctcatgtcccgcattcctatcttactcataaaatccccagttatgttcaaatgcaggttgaatttgagagtttgcctcctgccccttcactttggccaaatcaaataaacattctctgctcctaagtgctaatgtgtcagtgtttggcttactgagcactgggtactcaaaccacccttcatgctaaaaactctcaataaattaggtattgatgggacatatctcaaaataataagagctatctatgacaaacccacagccaatatcatactgaatgggcaaaaactgaaagcattccctttgaaaactggcacaagacagggatgccttctctcaccactcctattcaacatagtgttggaagttctggccagggcaattaggcagaaggaaataaagggtattcacttaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacagagagccaaatcatgagtgaactcccattcacaattgcttcaaagagaataaaatacctaggaatccaccttacaagggacgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaacgccatccccatcaagctaccaatgactttcttcacagaattggaaaaaactactttaaagttcatatggaaccaaaaaagagcccgcatcgccaagtcaatcctaaattctggatttctataacagtatttgggacacttctttaaaggaatagaaaataagggcaatcattctgaagaaaggaaatgacacaacttactgaacaagattgtctcaacattgctttcagcttgactcaactttagtagaaagatttcctgactctagtcctctgggctgcctttcttggggtatttactttagaaaacttacaactgcagatcatttctttgcccctttgaaacgtatataaatcttatctcagcatcttgctagtttcccaatccagacaatatctttctcaaggacctgcgatccatctttttgaaatgtaaacattaaaggtgatagagtaatagtacttctatctcccagcctctgtgtgagggtagaagcctaacttagaaaggtgccagttaaaaaacacagatggcctaatcacagtggaaaatatttgcaaactcaagaataactcaatgtgctccacaatgtgatccacattgatcaaccctcccccaacatcctccagtaattttccagtagctcaccccagtgttaaaaaacctttcacctgttgcaatagcctgtgtaaaatctgttttcatcctctaaattttatgctcccagggtccagtcccagcttcgagcattttatatgtttaaatcaattttgataatggcatttgagtctcatagaaatgttgcatatcctgccctagaggagtttacattctgaaatggctaatgctacaagattctactttatacaatttgaaatgagatgcaatcacttactttggaaataagaacagcttcagagaaaatgcagtttttaggcatgatccaaataaatgatgtaataaggaatccttcaaaaaatcacagatgaatcctgaaacctgttgacaatgtcatcttgtagaaataagtaaagactaatcccatgagaataaccaaaggctatttcttcagagattgctatggcaaaggagtcagccactatcatcacatgcatttcgcagagattcaaaggcaaacagaagatttggaaagctttgtgttgtacagacaaaaaggcttcaggcatgaaacttaactgattggaggttgctggcatggggaagttggaggtgggctaactagaagtgggcatcttatttaactttaactttctgtggttggccctgaattggaagcagatgaaaaatgcagggaagctagcagtgattgacaaacttctgatcattctggactaattgctcagaagctgtactctagcttcccaaacaggttgcttcaaaatgtgcaggtcagagttctatggccagagatcatctagccaatgtccttttttcttttattgagaacatgttctttatatttagcaaagtagggaaattacagagtctttcctgtcctattgttttacatataaaacaacagataattatatttggatttaccattggttcataatttctgccccaggcaaagtaatacagtgattatctcccttcctcatcatgtctctgtagaaacagtgcatgtcataagggagagtatatctatgccttgtcattgataaatgactgagtaatgacaggcccaaattccaggaatgttctggacaacaaaaagactcctctcgtatctaagagctggcacattctgtgggaaatatctgggtggttttaggcattgatgctaaaaagggaataaaggacactgtgaaaccttttttttttttgcagtctttgtccttcaatttcccgaagaacatatgtctatatgattttaaagataacagtgtgctatggagaatggagagatagcaaaaactaaaataaatgaggttaattttagtaaataggctgatgtctgggttgggcatttgagataaagggaaaccagagagaagacaggctgtgaacatgttccaaataatcatccaatgtggagcacactgatagaagtggtatagtgatagcactacagtgatagtaaaagacaagaacctgatgctacaaataaactatgctatacattaccctggatgtctagattttattaaataagtggcaggtaatcttcaatggcatacatatcttttcgtggcaatggataatgacagaatagttccactcaggggaaagggacatgcaggatcttgcaacccaggactacacaggcttgatctggggtaaaataactcagaaagagggattctcccaaaagaaaagtatcagcgcaagttttaattcataaaagtcagatgtgtagacaatgcaggacatccagagaggctgtatagaagttagaatatgttgtgagaagtcacagacagtgaagttttcaggattatgtaaacactgggttataaggagtaaaagaggcaaaccatgactcatgagcaggctccatgtataggagagcaagacaaaataagaccaagttcagtgaaacaatagcagcaaatatataattacaatcaaagtgtagttgatttgcctttctctgatgattagtgatattgaacatttttcgtgttttatataggttttttgaagatgtacaacctgcttgtacgtcttcttctgtgaagtgtttgttcatgttgtttgcccggtttttaatggattatttgttttttgcttgtgatttaagttctttgcagattctggatattagacttttgtcagactcaaagtttgcaaatgttttctccctttctgtaggctgtctgtttactctgttgatagtttcttttattgtgcagaaaataaatgcaaatcaaaaccacaatgagatactatctcacacaagtcagaatgtgtattattaaaaagttaaaaaataactgatgctggtgagactgtggagaacagggaaggctcatacactgttgaatggaatgcaaattagttcagccactgtggaaagctgtttggagatttctcaaagaacttcaaggagaactattatttgacctagtaaccccattactgggtatatacccaaaggaaaattaattattctaccaaaactacacatgtgctcgaatgttcatcatagtgctattggtttggatagaaaaactttgatacatatacaacatggaatactacacagtcgtaaaagaatgaaaatgtagttaaggattagaagcaccaaattagttcacaaaatttgttaggttgaagttaacccatttttccacttataaaaatgtataaagtatttcacacaaaaacattcatgctattatgtgttaacttttcccctgacactagagttacaggaattcctctgtaacaacttgcaaatctcagggaatcaagagtaggtgtggataggacttgaaagcatcacagagcaaatcagcacatggacaaactatgctcaatcttttgtaaaaaaattctctggaacattgattttaggttacctagaagcataatgtgttcatcatgtttactttcaaactactgtgttttgtcttcaactttagtgttgagtggctcttctactctatagaaatatgctgcctggttagtttttctccctccatcatgggtttcaggtcccaatccagaagggtgtgtttttgccaaaagcttgatcactctaccatatgtcatttcgatggtcaaagagttccttatatatttttctatgatatatttagaaaaaaaccataataagtttggtttaggggttagaatgaagcacacaaagatagcttaaaattataaaatatatactggctttcttctggggagaggaaaaatgtagtgtcatgaggccagaggaaggctgggtcagaacaaagatgcatcagcaggaaggatagagccctctttttggaggccacgatagtcctgggaaaataatagaagaaaagcaaggggacctcaagtgaaaataaaagcaacataaaaatttggagaattttacaccatattctaaagcgtatttttcactaaagtacattaatggagatttaatttgaaaatagtaatatctttgtgcagtaaaatgtggaacaaaaatgtggcagatatctactgcactgtgttctcaacacacattatctgtttacttttcaccaggattctataaaataggcacaattttatgacaagttttaagtattatggaaataagggtcagagctatgcagaagagccagaatttatactcaaatactcatcaggactttggctttttaaccaaaattctaagccactttaggactcacttccctattattcacatagctagtcccaggtaattacaataaagttcagcaatttgctgagattacacagctggtaagtggtagaaacaaacttagattctgaaatagcatgtaaaatattgtaactaaaaaacaccttgtaaaaggattcacagttacgggaacagccttcctataataaactactataaaactggataaaatatattattaaactattattttcaggcatcagtcagcagtcagtgcaagactgtggtccatgagataaacaaatgagactttatgattactccagcttattgagtttccaagccatagggtagaaagtgtcaaatcaaatggagcccagtgatcttactgagttggtaagataaatattaatgttaacggaaatttaggcagctagaatttgagggaccaaatactgaagaggagggagctatacaaaaataagtttaccgaaagctgagagaagaaccactaggaatagtaatcttgttcctagaactcatacaagggtgagattaatctgtgtttctaccaggcaataactcagaagaatatcaccattttagtgagatttaactaattttagaataaagactattttggaccttccttaacaaagtttaaaactaagttctgaaaggactgtcttcattataagtaattaactctgtgctagaagaaagtcaaaggctctttaaagaaatgccacggaatgtattatgcaatacagtaataaacacagttccaggcttccagtgaaaaatttcaagccatggaaagaagcaaaaaattatgatccatttagcaataaatacgcaagcccagaaatgacatgattgaattagcagacaagcaccctaaaagatcaactacaaatatgtttcatatgctaaagagtgtagaagaaatagcagacatggtgaagagagaaatggaacatataaaaatacaaaaatgaaactcctagagattaatatattatatttgaatatgttatctacctatttgtcatctatctcaatagtagagataaaacataatccccttaaaaagactgactatattctatgaaaaccacattaagtataaagacacagatcataagtaaaaagatattaaaaaatgcaaatgataatcaaaggaaaggaggggtgtttatgttattaggataattagtctttagaagaaagaatactttcatagataaagaggaatacagttgatccttgaataacatggttttgaactgtgcaggtccaattatgagaattttcttctgtctttgtcacccctcagacagcaggaccaatctctcctcttactgttcctcctcagactactccacctgaagactatgagggtaaagacctttatgatgattcattttcacttaataaataataaatatactttttcttgcttatggttttcttaataacattttcttttctctaaattactttaagaacacagtatataatacatttaacatacaaaataggagttaatcaactctttatgttatcagtaaggcttccagtcaaaagtaggccattaacggatttgtttttggagactcaaaatttataccctgatttttactgtgcaaggagttagcatgcctaatccttgcattgttcaatggttaactatatttcataatgaaaagaggttaaattatcaagtggatacaattttaaatgtgtaggcgtacaaactcagagtttaaaaaaatataaagcaaaataagaaagaagtaaaaaatggtaattccaatgttacagtaggacacttcaacttactatttgacagaatacatgaaaagaaaatcaataagcatatggaatatttgaacaatactataaagtagcatgatctaactgacatttatagaacactccacccaacacagcagaatacacattattttcaagtgcacttaaaacatttaccaaaatagaacacatgctgagatacgaaacatttctcaacaaacttaattgtgctgtaattattcgttattgtatgaaaaagtctacattgtaacccttaaaaattcccagaagcaaacaaatggaaatagatcatatgcataaatgtaagagaacaaattctaaaacttcaagtagaaagtaggagaaaatacttgtgagctgggttaggcagcaatttcttaagcagacaaacaaattaaccataaaagaaaataattacaagtttagctgtttaaaaaacatggttaacattggtaaggaaatcaaaaggcaacctaagagtgggagaaaatatttgaaaagctgtatctcataaaggacttgtatctaaaatatttaaaagaatgtttatatctcattaataagaacacaatcaaaccaattaatatggagaaagatttgaacaaatattgaagcaaagaagctacataaaatttcaagaagcattattaggcactctggaaatacaaattaaaatcataatgagataccactaccacccattacttagcaatgtcactcctagttatttacccaagagaacagaaaacctatgtctatttaaaaaagcctcaaatataaatattaatagcaactttattcatagtaaccaaatccttgtaacaattcaaacatccatcaactgaataaacacactatggtttactcaaataatgaaatactgctcaaaaataaaaagaataaaatgttaataatacacatataaatttggatgcattgcaaaggcattaggctaagtgaaagaactcagagacaaaatacttcattctctatgattccaatttttagaaaaggcaaaactatagtgaaagaacagaaaataattggttgccaagaaacaggagccaagcaaggatactgactacaaagaggtaccagaactttttaggatgctggaaagcttctatgtcttcattgtggtaatggttacataaatgcattacatttgttataactcacttaatagtgcgtttaaaactggcgaattggattgtatgtgcgttatttcattctcatgctgctaataaagaaatacctgagactgggtcacttgtaaagaaaagaggtttaattgactcacacttcagcctggctggggaggcctcaggaaacttgcaaccattgtggaaggagaagcaaacacatccttcttcacatgtggtggcaaggagaagtgccaagcaaaagggggaaaagccccttacataaccatcagatcttgccagaactcactatcactacccgcatgagggtaactgcccccatgatttaattacctcccaccgggtccccctcttgacatttggggattatggaaactacaattcaagatgagatttgcgtggggacacagacaaaccatatcatactgccccagcccctccctaatctcatgtcctcacatttgaaaacacaatcatacccttccatcagtaccctaaagtcttaacacattccagcattaactcgaaagtccaagtccaaagcttcatctgagacaaggcaagtcccttctgcctatgagcctgtaaaatcaaaagcaagttaattattccctagatacaatgggggtacaggcattgggtaagtacacccattccaaaaggaagaaattggccaaaacaaaggggctacaggcctcatgcaagtctgaaatccagcagagcagtcaaaagctccagaatgatctcctttgacttcatgtctcacatccaagtcacgctgatgcaagaggtgggtttccatggctgtgggctgctccatccctgtggctttgcggggtacggcctccctcctgattgctttcacaggctggcattgagtgtctgtggcttttccagttacatggtgcaagctgtcagtggatctaccattctagggtctggaggacagtggcgctcttctcacagctccactagaagtgccccagtggggactctgcatgggggcttcaaacccacatttcccttatgcactgccctagcagaggttctccatgagggccctgcctctgcagcaaacttcttcctagacatccaggcctttccatacttcctctgaaatctaggcagaggttccaaaacctcaattcttaacttctgtgcaccctcaggctcaacaccatgttgaagctgccaaggcttggggcttgccaaagcttggggctcgcactctataaagcaatggtgtgagctgtactttgaccccttttagtcatggctagagcagctgggatgcagagcaccaagtccttaggctccacacagcaggagggaccttggccctgcccatgaaaacattttttcctcttggcctctgggcctgtgatggaagggctgttacaaaggtctctgacatgacctggagacattttccccattgtcctggtgattaacatttagctcctcattacttatgcaaatttatgcagcccacttgaatttgtcctcagaaaatgagtttttcttttctattgcattatcaggctgcaaattttccaaacttttatgctctgtttcccttttaaaactgaatacttttaagggcacctaagtcacatcctgaatgctgtgctgcttagaaatttcttctgacagaaaccctaaatcatcttcctcaagttcaaagttccacaagtctctagggcagggcaaaatgccaccagtctctttgctaaaacatagcaagcatcacatttactccagttcccaacaagttcctcatctctatcttagaacacctcagcctggatttcattgttcatatcattatcagcatttttgtcaaagtcattcaacagcctctgggaggttccaaaatttcccatattttcctgtcttctgagccctccaaactcttccaacctctgcctgttacccagttccaaagttgcttccacattatcaggtatttttacagcagaaccccactctgctggtaccaatttgctgtattagtctgttctctcacactgctgataaagacatacctgagacagggtaatttataaagaaaaagaggtttaatagactcacagtttcacatagatggggaggcctcacaattatggcagaagccgaaaggcacattttacatgatggcagtcaagagagaataagagccaagtgaaaaggaaagcctcttataaaaccatcagatctcatgacacttattcactaccatgagaaaagtatggaagaaaccacccccccatggttcaattatctccccctgggtccctcccacagcatgtgggaaatatgagagctacaattcaagatgagatttgtgtggggacacagccaaaccatatcattctggcagtggcaaaatgctgccagtctctttacatagcaagagtgacctttactgcagttcccaacaagttcctcatctccacctgagaccacctccgcctgtacttttttgtccatattaccatcagcattctggtcaaagccattcaacaagtctctagaaagttccaacctttcccacattttcctgtattttgtgagccctccacacggttccagtctctgcctgttacccatttctaaagtcgcttctacatttacagcagtgccccactctctgggatacaaatttattgtattagttcatttaaatgctgctaataaagacataccggagactgggtaatttataaaggaaaaaggtttaatggactcacagttcagcttggctggggaggtctgagaaaacttacaatcatggtggaaggggaagcagatacatccttctttacacggtggcagcaagaagcgccaagcaaaagtggggaaagctcctcataaagtcatcagatcttgtaagaactcactatcatgagaacagcatgatggtaactacgccatgattaaattagctcccagtgggttcctcccacagcatgtggggattatgggaacgataattcacaatgagatttgggtgaggacacagccaaatcatatcattgtgtaaacaataataaggctgattaaataatcatatccccttcccccagaaagcaagactaacaaaaaatgatttggagcctaactctctgggtttcaattctggctttgctagtcagtagttttgtgaccttagaaacatgacataccctctctctgttatctgtaccaagaggataatgatgtctgcctcacaggcttgttgtcatctaactatgtaaagcacatagatgagtgctcagcagaagtaagtgatcagtgagttcctgctgttcctcagctattgctcctgactttgctactcaaatatttatgacagtgattgaatcctttaaattctatttatttttttcaacattaaaatgttattactacatggatctctataatctttcaagctttctgataccctagagtctataaatacatggaaaatgtttttactctcttagaagacattcttcaaaaaatggattcagggaaggtttctgaaagaagcaactgcactctgaaaatatttatgtttgtctaatagataaattcactttattttgcaaaactcttaagatggtatgcatttattaccttaaataaatcatgttttgccatggagatacagtaaaaatatataaatttgaccaaaatctagtatattgttcaccagaagaactttttttatagctttgctttaatttattataaattagataaaattgtctttcaagattgatgaaaacttctcaatttgtttaatgtaggcctacaagtgttccttaatgtatactatttaggaggtcaaactcaatggcttgtatctaatcagcactttttccccctcccccatcctctccatcccccccatccccaccccatttcacttctgatgctgtcctcgataatatagtgatgttcaactagctggaggctatacatatcaggtagcagaatcttgacagatgtttgacagaattatgtgttttttctattcaatatatttaccctaaggtgatttatagtggaatgaatgagaatctaatggtgaaaagactaagtactcaagaattacttgagctactgtgtagaattgaggtggaaggtctgttctcttcagaaattctgccaaagactatttcacttcctacaggaagaaagggacatgttttaagagctcagccatcttaaagctcttaggtataaatcatgcattttttctgtcatagtataacacaatccttgctttcaaatctcttagacaaatatattaagattaatttcaattaataaaatgtcctcacatcttcttgcattcactatatgaaaattcctgatgattgcttgcatatttaataaataccataggttatagctgtcctattttggctaaaaattgatttaccctctggtaaatgtttgaggggagaggagcatggttacatttcttttcagcattttcttgaaagatgctttatgcaaagacagccaagctcttgagtctaattcattaacaggcctgcagccaatgtaagtgcttgggggtactgtgggctgtcatcatgcactttgctcactgaagatgaaacccccacatggttgcccagcctcagtatcacgagaggctctttaagtctaaaattaaggctcactggctactgaatgtatgtgttttatctttattttttcccatatttttctgtgctttgaggtaatatccctcacttggaggctatgatccattaatagtggagttgtgcaagactagagacttttcctccactccagaggcttccattattcatcatataaatgggagtgcataaaggtatttctatcgtgtttaactccatgtgacagtaaaattgaagttcaaactcaactctcccatcttcaagaagtcaagataattaatcttaattagtaaatcattcagaagtttgttattaagtaccactgagtactttgttttttctagaagataatagtttcagtgaaatttcagtcaaagagaggatataactaaaggcacttaaaagcaattataaaattatccaagatagaaaaatcacagctggattataaattccacataattaatttaatgtgaagaaaaacgaagcatcttcattttctaaaaaaaattaatctgatgtttgcccaaaccgcaacctgatttttaagtggaagaatagggtatgtacacacccacacacacctcgccctcccgacaatatatatgatgtatatgtatatgtatgtgtgtgtgtgtgtgtgtatgtgtgtgtgtgtatgagtgtgtgtgtgtgtgtataatatggtttaaacattttggtactctaattcggtgaaactgttttcagtctctcagctcctcctgtctctggatctttttcttaatattgaatcctggctacactattcccagcactttatttttttattttattttttgtatcagtctctgtttaaaattctgtttcttaggcaaaatctctgaataaatcaagaataggtccttaagacctatggagttaggttattggttttatatttttcttcttttttttaatttgggtgtttaaagctatgaatttgcttctgagtatggcttttaatgaatcccatgtgttttggtgtgttgtgttctcagttttattaatctcaaagtattttcacttataatttctttttcatttattggttgcttaagagtgtatttttaaatttttacacaatgaaaattggaaaaatggaaacaatatgcaatatacttaaaatatacattagttgcatcaaaaataaaataaatactaaagaaaatataataattgatttggaaaatgatgaattttccaattccttttaattttggttgatagaattatattacccttttctctaactttttatctctataactggtgttatgtgtttgtaatttacttaaataatttagcctagatagagtgacatggtatttatatctatgctatcccattctaatctaagccctaaaatagtttactatctaattaaggacacgtattattggtttgggtaagtacaatttgatcaaaaagccacacttccctaggaaggcactgcaggcctccatctatctttatgtcagatgattttcaattacataatagttgtttaaaatcatttccattgaagagttagtgacatcaaacctttgacgtggctagaaatattgtttcagggtcttcaatcttacacgaacagaaaaaaaaaatgtaactgtcagtttgtatacactcttgggaattctcctgaggttgagttttgaattatcctgtattcaggtgcaaatttatggaggctgcttgaacccaaagttacataaatcacacctttagaattctggatcctttgaagattgattctgggaatataaaatggtggtactaccctggaaaacatttttttcattttttcaaatattaaacatatatttaccagcaatttcacccctaggtatctagtcctaatttctccatatcttcactgacacttgtaaattgtttgtttttttttattattgccagtcaagtcgctgtgaattagtgtcttattgtggttctgatttgcattttcctaatgactaataatgtggagaaaaattgtatatactttggtaaagtgtgtactcaaatatttttgcccattttaaaattggattaattaattggttgggcacagtggctcatgcctgtaatcccagcactttgggaaactgatgtgggcagatcacttgaggtcaggagtttgagaccagcctagccaacatggtgaagccctgtctctaataaaaatacaaaaattagctgggcgtgctggcaagtgcctctaatcccagctactcaggaggctgaggcaggagagtcacttgaacctgggaggcgaaggttccagtgagccaagatcacactattgcacccagcctgggcaagagagtgagacttcatctcaggaaaaaaaaagaaaagaaaaagaaaaacactggattatgattgagttgtaagagtttgtaatgtattctggatgcaaatcccttactggatatatgatttgcaaatattttctcccagtttgtaccttttcttttcttttacttgatagtttctttgatacaaaaagttttttattttgatatacttcagcttatctttttttcatcacttgcattcttagtactatatctaagaaattgttgcagaaacaacaatcacagatatttacccttatgctttcttatacgggttttagcctttacatttaggtttctatttctcaatactttttaactttctgaccctacaagatgttctagattaatcgtttattctctgccttaaccctgaaataaaccatgtatccaagttactctggtttttatacagaaaaactagtatcaatatctctacttaggagcttagtagtgtgcttgtttctaatggaatgtaattgttctaggccttctcagcagacagggcttggaaatatatgtgtgcatactatgttcatttattatattcatcaatctgtatttatatcaaactagccatgagttcataataatgtatgcaactcgaatacagggaggatgatcacattttattccagctcttccctttgcttatctgtaccttcctattgcaatagtgagaagcctggctctctccatatgccaacaattcccttatttgctcaatcacagtatacatatatagtggatatgtatgtatactccatgcctctatgaactggagttcattggctatacacagattattttgtctttggtcttacattcttcacttatttccaaacttatttggagcaacaactctttttcccttatcctgaaagaagagttaaatcacacttttaaaatacggttagattctctttttgtacagtctgcattccaaagtggaatttcccaacttcctaattaattgtttcttttatctgcacacattaaagtttactctttatgacataaatgtttatgggttttgacaaatgcatggacatgtatacaccactacaatatcaaacagaatgtgtggtggccccctactagtaattgtggcctcccaggaacttctaactcttatactagttgatactgagcctctaggaattcatgaaaattaataatgaagtaagtgattctacttgttttgacttccagtagcttcttttcagatagtcagatctctattgatgtatttctctggatgcacctaactcttccgatttgggggtaagaatttgacatagagctttactcctgtgacagatccaaggaaaaatcacagattttttagtttgtaaagccttttcttgttgcaagtacaggagtgacagcttccaagctctttacatgttggagttgaaagtgagagttgactaattatattttttgaaatttaaaaaatagttctgttctgcaaattataatatatatcttatcagaatgagaatcttttcagaattatttcaacttaattctaggagatatatgaataacattggttcaacagttacattctctccccactcatttttgccattattgttatatatatcatatagatttatgttaaaaacccaacagtacagcattgtgatttttgctttatatacttgcatgtcttttaagaaagcacaagataaggaaggagtaaaattatatatatatatatacacacatatgtatatatatatacagatatgtatatatatacacatatgtgtatatatatacacacacatatatatacatatatatacatatatatatatacatatatatacatatatatatatacatatatatatatatctcctgcttatttatcctttctgtcactcttcatctgttcttatggattcaagatatcatttgttgttgctgcctggttacagtatagctacatttattacccctttctctgggctgtttttttcatacatacatgtctatgttataagcccagcaatacactttaataattattgttttaacaactgcttttcaaatcagttaagaaaagataaaagtatataattatactgtcttttctagccatttgcataattaccttccagcactcttattttttctcatgtgaatatgaattgttgtctgggatcacttatttttattctgaagaacttcctttattatttcttgtatagcaagtctactaacaagaaattctttcaccctttatctgcaaatatctttatttcaccctccatcattttgaaggatactttttctgagtatagaattcttggctgtttgacaagtttaatttcttttgttgtttgtctcgttttgtttttgtttttaacactctttgtaggtcatccccctgcattctagcacctttgttttttatagggaaccacctgttattctcattgcaatcattgcaatcattgacggaatcattgcaattccgtcatatgtgaggagtcactttttgttggctgtttataaaattatctctgactttggctttcaatagttttactatgataggtatggatttttaaaaaattatcctactaggagtttgtcgagcttcttgaatgtataaattaatgttaatcattaaatttgagaattgttaagccattatttctttaaatatgttcagcccttttgtattagttttgtatgctgcataacaaagtatcacaaactccatggtttaaactacactcatttattacctctttccttctggggccagaaatctaaggacagccttattattttctgattaacacattatcaaaaattaagtagtttaaaacagcacagcacagatttactatttcacacttctggaagtcagaagtccaaaatgagtttcactgaactaaaaacaatttgagtgcactacatcacttcttgaggtcctagtgtaaaattcattccctttgttttttccagcatacaaatctgcctgtgttctatggcttctggcctcttcctgaatcttgatttatgcaacaatatgggtgaatcctaaatgtattgtactgagtgaaaaagccaaacctaaaatgctacataatgtattttttttacttacatgacagtgtgaaaaaagtaaaaccatggaccctgaaagcaggtaagtggttgccagttttgtggtgtggggagtgtttgactacagagaggcataacaagggaaattttgagatgatgggcttgttctgtgttgcattgtgctggtgaaatgctagatatttgtctaaactcataaaacttcctacaacaaagcgtaaatttttatatgcagattaaaaataatcaacttgaatattatgcaaaaccaaaattgaatgcagactatgacaaatgaatctatgtatattgcacataattgaaatgatcatggtgaatggagtgatgaagaaataagctgccctgtgtaacttaaaaaaataacattgatctgactggatattgtaaggctaaagacaaaacatattagtatgcaaacattgtattctatttaattggtgtaatttgagatatggttttactgtgtccccaccaaaatctcatcttgaattgtagctcccataatttccacgtgtcatgggagggacccggttgtgggggccaggtaattgaatcatgagggcgggtctttcctgtgctgttctcatgatactgaataagtctcacgagatctgatggttttataaaggggagctcccctgcacatgctctcttgcctcctgccatgtaatacatgactttgctcctcatttgccttcagccatgattgtgtagcctccccagctatgtgaaattgtgagtcaattaaacctctttcctttacaaattagccagtctcaggtatgtcttattagcagcaggagaatagactaatacagtttgaatgtttgtcccctccaaatctcatgttgaaatgtaatccctagtgttggaagtgaggccttttgaaagatgtctgggtcatgggggcagaacccttgtgaatggcttagcaccatctccttggtgatgagggaggagttattgctcaatgagttcacatgagatgtggttgttttaaaagaaactggcacctccctcctctctctcctttgttcccactctcatcatgtgatatgccagcttcccctttgccttctgccatgactaaaagcttcctgaggttctcaccaggagcagatgctggtatcatgtcttccatatagcctacagaattgtgagccaatgaaatcacttttctttgtaaattacccagtttcaggtattactttatagtaatgaaaatggactacacattgacaatattttttctcataatggtgagggttaacaattctgaaataactctaaatataaatcatatttgaagaagtaagtaaatatattgaagtaaatgagagccactttctcactgtcagagaaacaggagataacgccaagatgaaacgtgctgcttaattgaagatgaaggtatcatttttgcctcatggatatatagattgaaagaaatagaaagatataaaaatgaatacagataacagatacatgtatataaatgggtcgtacaaaaagaaatatgacccagctttgtccaataagagagcctaaaagaagtataccccagcagtaatgagcatacctagttcctggattttggtttgtaaatatcattcttcattaacaggaatgagagctccttagagatgtggctagttctaggacaaagaaagagaaaatagaagttaaccatagagctttctgtggcatcagaaagttggaaagtgctaaaacataagtttgggcaagtaaaaaggaaagaagaatcaaataaaaagagacccaaatatccaaagctagaacaattttgcacaaaataattaaatagtgctagcctctaaccctgagatggtaaatttattgtgtcaatttgactgggacactgcgtgccagattaatggtcaaacattattctgagtgcatctgtgagggtgattctggatgatgttaccattagaatcagtagactgagtaaaacaattttttcttcctagtgtgggtgggcttcatccaatcagttgaaggcctgaatagaacaaaaagctgatcccctaaggagtaagcaggattttttttttcgcttttagacttaaactgaaatggcactttttcctatatcaatcctgccagcatttggactagaaattacatcatcagctttcctggttctcagattttcagaattaaactgctatgacacctttggctttcaagggtctccagcttgatgattgcagatcttgggacttgttaatctccataatcatgtgagtcaatacattttaataaataaatctctttctcctccctccctctctttctctccatctttgtcattagttatgtttctctagagaatcctaactcatacaaacctgaagaataaaataaatatccatgagaccatgccaatataaataagtggttgaatgagtaaacaagtggagaataagggataattagtccctagagaataattccaaataacaaatatggatgacaagaaaaaataaaaattactgttgaaaacctatgtgattattactgcagtgaagatacactgataaatgttaaaatcagtgggtaaaattttaagcagaaacagaatgtttgcatagtctcaaattttctctctccagatatttgttaattacaaaaggaaaaactgtaacattatagtggaggaacctgttggccaccaccttgacaaggtgatcaagtttaacaaccccataataggatatcttgttgtcatgtgtctcctgatataacaatgtggtattcttctggaaaaaaaaacaaaaaaccatggtctcaatttaatcatgagtacacatgagacaaattcatattgaaggacagtttacaaggtacttatctactattcatcaaatgagtcagggtcataaaagacaaggaagaattaaggaactaacacatattggaggaaactaggtaaacaggacaactaaattcaatcagtgtaggatgtcggattacattctgaaacagaaaaagaacattagtagaaagactggtgaaatataaagtctgtagtctattcacttttattgtacaatgttaatttcttagttttgacaatcatactgtggttatttgggaagctaacactggaggaatctgagtgaagagtgtctaagggttttcttaactacttttacaactgctctataaacctaaaattatttaaaaatgaaaacttacaacagtaacttgtatacccaggggggaggagccaagatggccgaataggaacagctccggtctacagctcccagcgtgagcgacgcagaagacgggtgatttctgcatttccatctgaggtaccgggttcatctcactagggagtgccagacagtggggcaggtcagtgggtgcgtgcaccgtgcgcgagccgaagcagggcgaggcattgcctctcttgggaagcgcaacgggtcagcgagttccctttctgagtcaaagaaaggggtgatggacaggcacctggaaaatcgggtcactcccacccgaatactgcgcttttccgaagggcttaaaaaacggtgcgccacgagattatatcccgcacctggctcggagggtcctacgcccacagagtctcgctgattgctagcacagcagtctgagatcaaactgcaaggtggcagcgaggctgggggacgggcgcctgccattgcccaggcttgattaggtaaacaaagcagccgggaagctcgaactgagtggagcccaccacagctcaaggaggcctgcctgactctgtaggctccacctctgggggcagggcacagacaaacaaaaagacagcagtaacctctgcagacttaaatgttcctgtctgacagctttgaagagagcagtggttctcccagcacacagctggagatctgagaaggggcagactgcctcctcaagtgggtccctgacccctgacccctgggcagcctaactgggaggcaccccccagcaggggcacactgacacctcacacggcagggtattccaacagacctgcagctgagggtcctctctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaacgcagttcctcaccagcaacggaacaaagctggatggagaatgactttgacgagctgagagaagaaggcttcagacgatcaagttactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatgaaagatgaaattaatgaaatgaagcgagaagggaagtttagagaaaaaagaataaaaagaaatgagcaaagcctccaagaaatatgggactatgtgaaaagaccaaatctacgtctgactggtgtacctgaaagtgacggggagaatggaaccaagttggaaaatactctgcaggatattatccaggagaacttccccaatctagcaaggtaggccaacattcaaattcaggaaatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcagcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgatagattttgtcaccaccaggcctgccttacaagaactcctgaaggaagcactaaacatggaaaggaacaaccggtaccagctgctgcaaaatcatgccaaaatgtaaagaccattgagactaggaagaaactgcatcaactaacgagcaaaataaccagctaacatcataatgacaggatcaaattcacacataacaatattaactttaaatgtaaatagactaaatgctccaattaaaagacacagactggcaaactggataaagagtcaagacccatcagtgtgctgtattcaggaaacccatctcatgtgcagagacacacataggctcaaaataaaaggatggaggaagatgtaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagtaccaaaattcataaagcaagtcctgagtgacctacaaagagacttagactcccacacaataacaatgggagactttaacaccccactgtcaacattagacagatcaacaaaaaatcctattcgaataaaaacaaatcagaatcctgacctgaacttctcctcttctggataaatcatgttaatttctttaaactttcttcacacatttaaagaaatactatttatccttgtttttctgctctgcattctctctagatactctttaactcccttaaattttggtgttgcagtattctgattgactaagccaaagcgggcaatattagcatcaatattcacttcactgtgatgcaagctggagctatgcaaacctgtcttgaaatactaataagagaaatgatccaggagggaacctcagaattctaaagaacataaatacagacaagagagcaaaggatataagaaaaactaaaggctaagactggaaatagttgactaaacttttaaaagtatggattataaatataattattgtttataaattatgtacttattcatacattttccataacttaaattctaattgtagaatttaaaatagacaataaactttgtaaaacacctaaaattttactttaaattctcatctacttaaaaaatattgcagtaaaatattacttatgttaaatttactttccataatagacaatgaaaaaataacttaaaccatccaaaattaaaaagtgagaaaatttcatattagaatacactgcaagtagaagtcattctaggttctcatcaggtgttgtggttagccatatacatgactttatctaagtcacttcacctctctgagtcagcttcaggatgatagtgtggagatgtgtcaactctcacagcaaaattctagcaggagatcttcattcacttcacagtcttttgaaaagcacccctggaattgtacaaaagtgtggcccttcctaaagtgcagatatttttcttcttaaatgaatacatcaagttcctcagagtttcaaaattaaagaaataataagtaggggacaacctggagtctagaatttgattcaaaaaaggagaatttctggacaaggatcacagttctgtataggtaggacaattccagcatgccctggatatctgcctataatcttgccatctctctgctcagttatttttaaaatttaggtagaacacatataccgaaaaatactttaatatgaaatgtacacctgaacataatatttttgatattcaccctgatttttgcacatagcaatatgttatgttgccaaatagaatttcattaaaggaatagacttccctttatttatttattctacttacaattagcttttaattccatctctgtaagaagacattgtaagtaaggcaatttggttatacctgaatacgaggttgttttggtagatattggttgcttccaacagttgtagataaaaaaatctctctaggtctcctctcccaggaatcaccaacaagtggtatgttacaagtcataaatagtataagcctacacacagcaatttatgagaaagtaagcataactttgtcctttcagggatttcagtaaattttgcctcaaatctccatgaaaatcagacattcagattcctccagaggtgaccgaacacatgaaccagacataatcctagactgaggtcaccactctaaaaggtacaggatttttcttgcttctctagacctcctctcttgattcatgcaaaggcataaagatagacaatattctaacaaatccacatatattaaacaccactcaagtccgtaattaaaattattcctaacattatactaactaatgaaccatctggtgctgatcaaatatacagttgaaggacacttctggagcctgaatttctgaataaagactctgattgttacataactacaccctttattatatactcttgataagggggcctcaagggttcactaatgatctccagagtatagattgaaaacctacacatgcatatatattatacaaaccatattttaaatattttaaataaaattacaaacaatattaaaaattttcttccaaacactcaagtccaacttgccaaaacagaactaatctctacattaaggagttagcccagggaggcggcttctcttgacatattggagactacccagggctgttcatttgcctgactctgtcctatcttctcattcctggggatctgtgaggtttaactctctgtaaagaatcaaacggtgggaaaaagagagcaaaatttcatctgttattatagtacatggttgaacttgagcccttggcagataactctgaaaagaatgggaatatctcttttactcattggctatttccccaagacatattgttaaaataaatgtttatttcatccaatctgtagttggatggtgcagttcacaaacctgcaagtcagataatctaggctgggcttgggtaactcaactccatgtgacatgtctcatttgggaccctggctgaaggtacaacacctggtgaaagcttttctcatggtgatatctgaggtggaagaaggaaaagaataattttatctaattcagaagttatctagaagttaattcaaattataaacttgaaaaaggcatttatgaaacaaggtagtaaggaaccagtaagtcgggagagagatgtaaagaaagttatatatatgaagattttttgtaaggaaggctataaaggaaagataatctttgatgagaaaatactttgtagggtaaattttttttgtcctggggtaaaatgactggttatttaaagaaaaaataagaggaagaagaagaaaatctgggactgaacagaaagcctaggcatgttgtggacagtctgtgtaagtcacatgtagtttttactgtttctctgtgtgtgtatcttcatgaaccaaagagaaaatagaaagttgaaacagtttagataataaaatattctttaaaacctgaaaaattggagaaatttggctaactttttaaaaatttgcctaattaacattttcgtatttaaagctcttagtcttgatgaagataaaataagaaatattgtaaagaaatgcattggcagttttgcattttttaaaatatagttaatcatgaagccagatgtagtgtggaaccaaatttcatacacatgcttgcattgcttcatactatatatagtactatttgctattttgcacagacagtactagcactaaagtgcttactggtcatgtacctaaagtgaatttcttaattgcaaaaatatgtatcattatattggtggacctaaaaatattaaattgtgtttcaggaataaaatgttatcttttttaataggctctgggtaacactgtagcatccaaggtaaacttagtaggagaaaaaattgaggtgggtttcctgtttgcttttacttctaattttttatttatttgccatttgttctgctttgagttttacttatgtatacatacatataaaccattgactttttttagttcctaatggaagacttttatttggttctgtgaatagtttttgtttcctatgcatttctaacaagtcatcatttgttttatttatctagaattcctaagctacctctgtcaagcctgcaaaaactgatggagcacaccagccacttaaaatttgattttccttacctctgataatctagagagctacaagagctttaagtttcctagccaaaaaaaagagaattattataaaaagttctgaacagaaataagaacattatatattttgttatttggaaaagtggatgatagtagcagtgcttaaatggtgtttagttagttttagatatttttctttaatgaggaaaaattgtgatatggatacaaagttttaatgttcaggaaagattggccttgtccttaagacaattatattaattggaatttctctcaaactaccttagttgtgtttactattattaaaattaaatggcattcacttggattaagtagtaatttaaaaaatgtgagactttctagtgatctttgatcccaagccgtttatcactgatgggccttcatgtgtgcacttgaaaacaaaatatgtataagtgttgcactagtttgaagattttggtagccaaagttacctcatcagttgtcagtactgtatctagaaaccaatcttggaaatgtgtgatgatactcttttaaataggtgaaaagaaattattgtgtgctggttcttactttgtctctgttttattgtctattacttaagtgaaagattaccttcatattgaactttcagaactaatatttgcatttatcattttttgatggagacaaaagttagttgtcttcctttcataagtttggcatacaacatatcactttttgatgcttttagtcacagtctgtcactagaatgctggcaattagacatgtgcaatgagtaacctaactacttgaatacagtgatttgaagtgttgcaggcagtaactcttaaacaccaaatcacaatgttttaattttgaacatattagaaagaatgttaggacattctgtaatataaatattctattaactaatttttgtgctgttatgttacagggctttgactcctgggtctgaaggaggcacaaacccctgctaaattttgagcattgataccagttgaagcctcatctttagactcatggaagagtgacaatcaacatgaactgcttttgtgagacagaaattaaaactattcagtccctctatactcagggactattatagaagaggtgggcacatgagattgcaagggccaattttgaggaataagattagttcagagtttttctatatgttaaacattaatatcaaaagcaccctaatagaaggccagcatctgggcccatgtgtcagaataatagggttttcttggatcatgctctttaatagaacattgtaaaatgttataaaaggttgatggaaatcttaccttatggtcaaactgattaaaattagataaatttttataaggttttattaaaattagctttaacattaatacaccatacaaaggtaaaatatggtttttctcttttgtacaaaatttttcatgtaagagatagtataagagttttgtttacctttggagtaaactgcagaggacaaattgggggaaagagacagatatagctggcctcaagctgtatttattaagtagcattgtttaggaaactgagtctcctctttatcaaagagtaaatatttttgtattatcattttggctaaatgaatgactattttatagtaacctgtaaccttatttttaatatcaagtgtcttaaacttttgatatttgtcatacttttcaagagcaaaatttaaagttctaaattcagtcttttttacctaaaactattttttgaatgttagtatccctgaagtccaagagagatatattatgcttattaagcttatttgttatgttaggattatacaggaatcattattaaatgtgagatggtacttaactttttttggctatatttatatagatatgttgttaacatgtgtttcaggattatatgacattcctgaaattctgatacgtatgtatgttattggtaataattatgattattatgttaaattgttgtataccatagaaataaccaaattttattgtcaactgtgtctttgactatggctgtcctaagacatttgtcatccataactgatgttttgctttgatccttctcaaaaaagtgatttataatcagctactgtctagagcttgctttttcaggggaattcttgaaaaggactctttagcgtgggtttctgataacattggagattgtgccattggattagagagcagagtgctaattgaaaggctgatatgttcataaaggttgctaatcaaatatgaagcaaagcaggagttaactgtgtggactgaactaatggaggactgaaatcatttgtatagcctttttgtttgaaatattgctgattccttttgttttatgtttcagagtctggggaattgttttctttatgctattcatagccttaaaatactttaagtgtactgagtagagtatatgtttgtaaacagaatttgagtcatatatttttctctcttggtccaatttatccagaattcattaatcatttgtgaaattcttaattcatggcaatgtatttatttgcataagtttaataagaatctattttctcggccgggcacagtggctcatgcctgtaataccagcactttgggaggccgaggtgggcagatcacgaggtcaggggatggagaccatcctggctaacactgtgaaaccccgtctctactaaaaatacaaaaaaattcgcaaggcatggtggcgggtgtctgtagtcccagctactggggaggctgaggcaggagaatggtgtgaactcaggaggcggagcttgcagtgagctgagatcgcaccactgcactccagcctgggcgatagagggagactccatctcaaaaaaaaaaaaaaaaagagagaatctgttttcttgtataatgggacacagttggaggaactggttatttttccagggctttgactggaatggccttgtgagaggttccagcaaagccagtttagcagaacctattgggcaatgattactgttgcactttgtgtgggtaatcaggccaagcatatgggactgaagctaattttgcaggtagtttggttctgctgcgatttgtctttggtggaagtgggagactggagagagaaatactctgtttcagaagaaagctctagtattagattaacctttgattcctgagtggccacgtggtcacctatggtattgagatgcctacaacacccctccctcagcatgaagcagccagaaagatcaagaccagattccccatgactaaggaatttataaatagaaaagagggactgaaactgacacaacagttccatagataatttgtttttatttttgttttttaataaacatagaaatcgacccttctgttcttaaagcttgaaagttatatttattttatctgaggtctttcctcaagaaatgatcctcaggcctctcaaaaaagtatcaaagaactaaaactcaccagatcattacatccagaccatgagatactggacttctcatttatcatgattacttccttgcctctccctattttctatttttcttacacattgttacatttcttccccgctatataaaccccctaattttagtcagtcagggagacggatttgagaatgagctcccatctccttggctgcagcacccaattaaagcttttttcattggcagtagtcattgtctcagtgattggctttctttgtggcaagcagtaggacctagaccagacctctggtgttttggtaacactagtacggtggtttttgaattatgatgcttaggccagtaacgacagtatcacctgagaactggctggaaaagcaaattactaggcctcattcgacttgctgaattaaaaactctggaggtgaggcttaggaatctgtgtgttaataaatattttgatgattctgatgtattctaaagtttgaaacccactgtcctaagcacaaaatagcacaatagctggcatagagtaaatgaaaagcctgaagaaatgaaagttgccataactgttacaatactaataccgtatagctgaattaataaagaatgaagttaagtgttaagatttttaaccactgtttcctcctgtaaataactggacaataatacctgtagccagtatatagggagaggcagagagaactccctttgaacataagaagaaaagcaattgtcttctgaatgtttttcaaagacacacagtaaagataatatgtgttaattaacggtggagcaggtcaacaattgaagtgtagaacaaggagaggcaaagtttggcaatgattatcaaagctatttgcagtgaaggtaccattttgcctaatgaatttggctaattattaaagtcccagtggcaagtctattacttttgtagactttctgaaattgatgcatgccattaagtattcataatgtataactgcctttctgtgttctgatcatttttatttgctttctcatgcatgtctatgtacttgttacttaaatgccaggggttcagtctaggtactgttgctcacacacagaaagccaattactaagtcaacaagtattgccaggaaagaaagctgtattcaggtgctgcagccaaggaaaatgggagatcagtctcaaatccatcttctcaactgactaaaattaggtatttctatagcagggaagaaatgtaactatgtgtgggaaaatagaaattatggaaagacaaggaagatgagttggtcaacaaaaagcaggttgtagattaggcaatcaggatggataacgagtctgatgtgtcattgtccagatgtggtgatttggttagcttcagttccttaatactgtctgggaggactgatggtttgtttcctgagaaaggagctcagttaagacaaatttaagtttctcaagttttaagaccggcagggtcaaatctctatttttactataaagaaaccatacacatcagttctaagggacaattggatcaattgcatactgatgactgctcaaacatcccccttgactactctaagaggaactcaagtatcaaatcctcccttctcaaatgtcagtttcttctgcctagaatgggcaagtaaaagtttgttcttgcttttattttgagttgtacacttagaagcctttttttcatatttagcttcataacaaccctataagtactgttattatctctatatgaggaaactgagaatcaaagatgttaaataatattattaagtacacagctaaaaggaaaatcaagacttaaacataggccaaggaagcagtgggactcatgattgaagtaaaagggcaatgggcaggaaggaatactaatttaggaaggtgcaataggaacttaagacaagtagagccaacatgaaagcaacaggagcttgcagattggagagtttgctatatttaaagtgaccatacctaatttgagatgttttctttttcatttttcaaacctagtttggtccatatttgacagatatttgttcatttgaaacaaaggaaaagtctatatcaatgatttccaatggtagttgtatcaccccaaggaagtatttgggaaatattgaatgacatttttgttgccagaatgatcagaaggcactgttagtatttagtgggaggaatcattaatgttcttcataggacagtgtcacacagcaaatacttctcatgttctctgcaaaaattttaattatctcactggatattcttataggcgactatccagtctagaagtgaataaattcattttcaagggaagattgagcacaatagctcatctttagaaaatcatgtaatctgtgactacactaaacataattaataccaaaacagcgcagctgtttcagggaacatttgtatatatgatttaagaacaattctgaatacagtcatcaggacttctagtgtggttatgctgaggacaaatatatattatttttattatgaatttatttatatttttacatttcacttagggtattagcatacatgcataattacgttgaagtaagattatattacttaataatttttccagggtggtaaaatatatgttttaaaattggagcattaattctgatgcggttgaaaaccaactctctctaagatactctgataaacatcattatatccggaaaatatctttatgtaattgctattgttaaatcataattttgtacaaataatttttataaggagaaagtcaactctgcaaaatattttttaaaattctatataaagacataaatttatacagtctagtatttgtctgtcaacaatttgcttcggaattgaggtttgtatttattagattagaattacttttcctatatttcctgtatttcaagttcagtccatggatactttgtttatacttgaagaaaattttaatctggcaacccaccagtaactaatagttagaactttacatgaaacatatccatttatactccaagaattaccatacacatgcttccaaaacacagaggtgcaaatttgtctgaaggcctgccatttaacaaagtgaaatcaaagtaatctttgcatggtagaagacaaactaaaatgtgtgagggagaactccactctttagaccctcaaattctcagattgcaggcttgggtctaattctctggtggacattgacaggataacctcttcaccagctttaggtgcaaaaagagggtttatgtaaggttttggaatcctgcagaaaatgacttaatttccttcttcttacatatgtattactcttcagatcactgttttatagtgacacatgtgaattctcacaggaaggagcaaaggaaatacttgttctgaaacagatgattaggaaaaatcagacagcatttgaaacatgaacaggaacaagatcttctaaaataagtaaaataacactaatactttgctcattgctgagcaggaattatatcagaaaagaacatccatgtgaaagtaagagagtgacatacagcaaaacacttctaagctttttttttaatagcaagtttaagtttaggttctcaaacctgtttgcacaatagagtcacctagggagctttgagaactaccaatgcctggtccccaaacacagaattctgatgtgactgctttgaagtagggcctgcgtatcagtataagctccatgggtggccctacaattcagccaagtctaacaaccactgactagtcgcttcatcagtatccttatggctctgccagtacacacctatgggtgattagtactaatttaagcatttgctttgattaagttcatagttttactgtataccttggggctatgtcattgtttttttttttttctaatagcaatagtattctttttctctctttctctctccctccctcactcccttccttccttctttcctttctctttatttcttccttcctcctttctaccttctttttttccctttcttcctttctctccttccttcttttcctttctttttttatttaactaatattaagtgttttgttgttagtggtaaaatgaaagttactgtgttaagctctggggaaataaaatttaacaggccctactccctgttcctgaggtggtcacaatctaaagttctgagagatggacagaggtgaattaggctatagtgttcaaaccatatcttaagtcactacacatattaagccaccctctggataacaaatacagtcatcacgttttgtcagggaaactatacaagtttccatgtcctgtcttattatcttcataacacaccttgattggcattcttttatttttaacctaaatttttgataattcttggcaaagaagaaaacatttaatacataacaaagtaaaactccgtgcctgtatctgtgattttaggaaataatttagtagtattacgagattttcttcaggcaatgcagactcctctcaattaatttgaaattaaaggttgtgtcatgtactttgaaagaagaagttattcttagatctttactgaggctatatgttacatatattagttaaatgtccagaatatgtgagaatagttattttatttcatgaatgggcacctgtgcttcttttctctatcagtgctttttagttttattatttattaactcttgccattcctcttctctctctatttgctcatcccacaaatatagaactcctttgaaattaaaaacagaagacattaaaaattatatgtgaaggcaccaatgcatatggaaattttagataagatgaatctggggtagggtaaaagcagaggtctaagacggatgagatgttgggagtagatctttctgcagaaccactttcagagcaatacagaaaactgagtactttcaggccttgaactatactctcttacattttctatagggaaagaagacaaatgtttccctccagaaccactgttctgatacattctcatatgctggagcaaagctaaggtcattaggcaggggattggaattgctgatccaattgttctcagccattccctaaagaaaattattaaaatatatatatatatatatatatgtatgtatcctggaaagagtcctgtgaatatttttaaaatttatacataatattttacatatttatggggtaacatgtggttactttttatatccatagaatgtataatggtcgagtcaggctgtttggggtatccatcaccttgaatatttatcctttctgtgttgctaataggtcaagtcctgagaattaagtaaacgaagacatttaaaacagataaaataatagttaacatattctgtgttctcaaaaaatgccagatgttgtttttgttgttattaatgttgtccttgtaaccgtatcatttgggaatatctgcctgagaggaataagaaggtgtagcttatgaacctcatcataatgtttaaatgtatcatttaaatcaatgatattttgtgtcattgattttacagttcatctagggccatatcctcatggtacctgcacatattactgcaattacatgtaacatagctctcagtaaactaaacacatttccatttgtttaattgagaatcaaaggccttttcctttaaatatgactaaggtctatctgaaacaaaattttctacaattgtcagcattttagaaattaattccttaaaattcactcagaattactaaaacaagtgaagtttttagttattagtgctgtaccaatgttaatttattagtttttgataaatgtattatagttatgtagtgtgttaaccattagaagaaactgggtgaagagtatatggcaactctggactatcttcacagattttctataaatctaaaagtatttcatgtcttttgcccactttttaatggagttgtttgttttttgtttgtacatttgtttactttccttgtaaagtacggatattagacctttgtcagatgtatagtttgcaaatattttcttccattctgtaggttgcctgtttactctattgataggtttttttgttctgttttgttttgttttgttttgttttgttttgctgtgaagacactcttcagtttaattaggtttcatttgtcaatttttgcttttgttgcaattgctttggatgtttttgtcatgaaatctttgccagttcctaggtccaaaaaggtatttcctagaggaaatatatgtggccaaaatacacaggaaaaaaatgcttaacatcaatgcaaatcaaaaccacaatgagatatcatctcacaccagtcagaatggccattattagaacctcaaaaaattacagatgttggtgagattgtggaaaaaaggagcactttttctacacagttattgggtgtgtaaattagtttaaccattgtggaaagcagtatggcgattcctcaaagagctaaaaacagaactatcattcaacccagcaatcccactactgggtatatataccccaaggaatataaatcattctaccataaagacacatgcatgggtatgttcattgcaaaactattcacaatcgcaaagatatggaagcaaccttaatgcccatctatggtagactggataaagaaaatatggtacgtatataccatagagtactatgcagcctttaataggaatgagatcatgtcatttgttggaatatagatggaactagaggccagtatccttagcctactaacacagaaacagaaaaccaaatatcacatgtcctcacatataagtaggagctaaatagtggaagtgtatagacaaaaagaggggaactacagacagtggggtctacttgagggaagaggttgggcagagggagaggttcagaaaaaaatattgtcaatagtatgtttagtaccaggtgatgaaacaatctgtacaccaaacccctgagtcatgagtttacctatataaaaacctgagcatgggccgggtgcggtggctcacgcctgtaatcctagcactttgggaggccaaggcgggtggatcagttgaggccagtacgtgaccagcatggccaatgtggtgaaaccctgtctctactaaaaatacaaaaattagccgggcatagtggcctgtaacagtaatcccagctactcaggaggctgaagcaggagaattgcttaaactcaggggggcagaggttgcagtgtgctgagatcgcaccactgccctccagcctgggcaacagagcgagacaccgtctcaaaataaaaaacaaaaaacaccggagcacgtacccctaaacataattaaagttaaatatttttcaaaagtatttcaaaataaaaagtatttttagaaaaaaaaagcacattctgattttgttcccagcccctgtgcctgacataaatattcaataaataaatgtttatggaataaattgaagtatattttatttttttttttaattcacactcctctccctcttttctctttttttgggaggtactccctacctattcttttgatctctgagagacaagaaggtaggtaatcatccagtgcctatcaggactcaggatggttcactatagcaccctccaccaccaaagcttggtatataagtttgggttttaaaaccacacacacagatccaaattttagctccaactttttttttttataaatatggcaacacattcaacctctctgagactcagtttgcactatctataaagataggaattgtatttgcttagcagaactgacatgagaatcaaataagatatcaaatgcttggtacatagtaggtaacaaaataattgttagtttcctttcttatgtgttttttatcgattccagagaggtgacttcatccctgaggaggaggaatgactgttatttattatgaagctggaacatgacagcatgaatctttgggaaacactggctttttctgcccagcatcgcaaagggaatgtcagtctttcagcatacccaagtatttgtgtccaataaggaaaactagtcaagcaaaatcagaagagtcttcagtgctcttggcctctgtttgtccattcattcattcattcattcattcatccaaattctctccacttgaatgtctgctgtgtgcagacaaggggctatgtgctgggactaaatgatgatcaaacagacttggccactgccctcacagaggttgcagtgtaacctctgtgatataagacttgtgcatccctctcccaaatttatatgtcagaggcctaagcctttgtacctcaaaatgtggaagtatttggagatagggcctttaagtaggtaattaagttaaaataaggccattgggttggaccctgacccaatctgcctggtgtccttacatgaagaggaaacttggacacacaatgaagcaccaggaatgtgtgcagaggaaaagcaatccaggtatagagagaaggtgttatctacaagccaaggagagaggcttcaggagaagctaaacctaccagcttgattgatcttggacttctagcctccacaactttaaaaaaataaatttctgttgtttaaacaaacaaacaaaaaagcaaaacaaacatgggcagagattcatctaatgatttgggacaattttaaaaatacagattcctaggcctcgtgccaaatctaataaattcaaatctcagaagtgggacataagatccctatttttagcaagactctcgggtgttacttgttcttatcaaagtcccggaggcatcaccttgtttaagataatttaattctattaaaaagaacctattttctcaattctcccaaggatgccggcaccattctagatacgtaggagaaaactttatcctttacatacaattactatctcaaggccatagggcttagttattttgagaaatactcattgagattgggtactataatgcaaaatatatgacatagtaatcatttttaatgaattatccaaacagtaacaatattaaagttactaaccagcattttgattttggctttgctattaaccagacatatatccatgggaaagtcaccaaaccacttttaacttatcttgccttctgaaatatcagtgaaattaacaaatggccatgaatacattttctaaatgtaatcacttgtaaaatgggagaaataaaagtaattgtctcaacatgctttaagttccaagttacataatggataatagtgtttttcttaaaatcctattacatagtaagagtctaataattgttgtgtattatttttgtctcttatttatgctatagttctgcaaaagatatttggtacgttaagtctgcccaggagtgactattacatactaaaaccagaaagttatcttagaagtggtaactaagtttttgtttttcaagttagatatacctgcctgtttttgtttccgtgctttttgtcagacaaggccaaaagttagagcttccaagacaataataaactttctcatcaagttcaaaactctcaaaacagattaaaactactctctccctacctatatattacaatactcacagaactttgatgtttatcataaagacccttatttttggtgttttgtgtcaattttttctcttcccatgataaaggcacatttgtaccaccaagtgggccttgttttcagttaaacaaaagagctcatgttatgtccttgatgtctgtcttcagtctcacagctgtataaaatgctgactatgtcaaagcacattatcagagctttgataattaagtaaaaaatgttcaatagagttgtcacctactcttatttgtttgctttgttttaaatatttggatagcatcagagtcagagttctctacaactagagtcagagttctccagaaatagaatcaataggatgtgtatatgtgtagaaaaagatttatggtaaggaattggctcatgtcaatttggtgcctagcaaatccgaatctgaagtgtgggccaaaggttggagactcaggaaagccaatggtgcagatgaagtctgaaggcagtctgctggagaattatattgctccaggacgctggtctttctgttctattcaggccttcaacaaattggatgaggcccacccacattatggagagcaatctgctaactcgaagttcacttatttaaatgttaatctcattcaaaaacaccctccaagttgacacaaaattaaccatcacagatggtatgtaatagaaaatacaatgtgcaacatctattttaaagcaatatgtaacacacaattttgtaatagaaagctttagattccttaattcttatttcttgttttattcttgactttttgcatgatgaagatcaaatcatatgcacttttgagagtcctgagatacagaggaatatttaaagttagtggcctgagaatgagattacttataaacacagaaacagaaaagaatagatctgggacctgagctctaaaacatctcatcacttagaggtaaagaagtcacagcaaagttgactgaagcaacagcaaatgaggtagtaggacaaaataagactatgcagtgacctggttgccaaatagtgtttcaggagggaagtgatcaatagtgtcaaatgctgtgaaggtaaagatggggactgaataatggccactggatttaataatgtgagcagaactaatagccttaacagagcagtttctgtgagtggtgagaatgagagaattgtgttgccatcagacgttaggacagttggtcttacaactatatatatatatatatatatatatatatatatatatatatacacacacacacacacacacacatatatacacacacatatatatacatatatatactttatttttcaagtaaatttttgattcataaaaaatttgagtagaaagtacagagaattcccatatactccctccccaccaatgcacagcttctcttcactgacaatatcccacaccagagtggtacatttgttacaatcaatgaacttacattgattcatcaccacctaaatttcatagtttacattagggttcactcttactcttgtacattccatggatttggataaatgcataatctcctttgtaatatcatgcaaaatagttttattaccccaacattttagaaagtatgaaccagaaatgtattactgaggatttagaacatgggctgatagaatgtcatctattcattttctccttgcttttatcatgtttgctgtagtcacacaaccttcatatatttccatgcttaatcattctgcttgacttcctggctcatgtggctacagtttataaatagtttgttcaaagttctctaagagtagtcatatggtttggctctgtgtccccacccaaatctcttgttgaattgtaatcaccagtgctggtgggaggtgatcgaatcatggggtcatagaattctcatgagatatgcttgtttgaaagtgtgtagcactggccgggcacggtggctcacacctgtactcctggcacttcgggaggccgaggtgagtggatcacgaggtcaggagatcgagaccatcctggctaacacggtgaaaccccgtctctactaaaaatacaaaaaatattagctgggtatggtggcaggcgcctgcagtcccagctactcaggaggctgaggcaggagaatggcgtgaacccaggaggcagagcttgcagtgagccgaggtcacgccactgcactccagcctgggcgacagagcaagacttaatctcaaaaaaagaaaaaaagaaagtgtgtagcacctcccacttcactctctttctcccgttggccatatgaaaacatgcttgcttccccgtcaccttccaccatgatcataagtttcatgaggcctccccagaagcagaagcctgtgcagcctgcagtactatgagctcattaaacctcttttctttataaattacctggtctaagatagttctttatagccatgtgagaactgactaacacaactagtgattggctcaggaaaactccaggagtctataggatgcgtcagtcagaagatgaaattttcagttggttaaggtaagacctatgtatgaatgagactccacttaataccagtgtactggtttaaaataaaaatctgacatcaatgctttccttaaaggaagagggtatgaaaatatggtactgaaactaaataataccaaataactttgagaatgtttttaccaacaatacattgtataggataattatatattttagtgctacgaatagaattgaatctggaggtgggtattgactgatgagtgaaaggctctgaaagtggtatgggatctctggggtgtcactttcctgattggaaacctctgtgcagctgctgcagtagggtaggcagctccaggtgtgagcacaggtgccggctctatgtaactctatggctggatcaggcacactacatgcagcttccacagctggcactggggaacatggtggcacctggaagcttggagaactgcagagtccaaaggagggagtcacagatctggctcaggagccccagttctgggctacctgaagggctgcagctcttctctcctcttcacccacaatgtggcaagcaaggggcctgtctcaaccctgtttgcattatagctcttttagccttgccatttggtgggttccaagttcttgtcctgtgaccaggaaaaatgaggtacacagacaagtagagggtgaacaagaggaagaggtgctttattgagtgatagaagagctcagaggagacccgcagtagatagttcctttccacagccaaggtttcctgataagtgttcagctcctagcagagaggagaccctggagtgggaagctcctctcagaggggagaccctggaatgggaagctcctcactgcaggcaggtcatcctgtcgtctctgcagctctcagcagagagaaggccctgcagttggttgttcctctctgcaggcaggttgtcttgtcatctttccagctctcagcagagaggaggccttggagtgggtagctcctctctgcagctggttgtcctgacatctgctctgctctgcttgagcctgaggcttttatgggccttggacaggagaaagtgcacactgattggtccatgggtgaccacgggtgggcccagaaaaggcaccacaagttcccactctgctctgggtgactagcatcctggcccccagtcttcaggttctccctggcctgaaggtaggacctcaatgggtacctggccccttctgcccaggagcccatacacttcctgctgcagtccatggtgcccaggcttcttgcctcaaggggcacctgcaggccagtgctaagatgctctcagtccccccttggctccctccaacggtgttaattggtgcccaaagtctggagggaactgaggtggccaggggctggcatgtcagaacttcctccagtgtgtgcacccctatttggtctgtgatggtgcctgggattggccctatgttgctctgagatcagagcaggcattgacagtggagagaagccaggcagtgggagcaggcacttccaagtctgcaagggcaggagatggctttcctgggcccccaatccagatttgggcggctgcacctgtgcctgggatggtggggcttctgcctgctctcagtttccacaggctctgtggagcacacagccccagctgcacctacttgcagcctggggtcggagctcaaggtcctcactaggctcagtctgggatccagggcaggtgcaatatctgcacaagcttcccccattgccctggtgctcaggggtggcccggggaagagcaaatcgagaccccaggcccagcagtcaggagtgttagctcagcggtcaccctgacacagggtggacctcagggatgtggccccagaaggtcccacggagagcctcctcccaaggcacaggaacctggcacccttggcagggtgggcagtgtgtctgtgggcaccaaaagtgggcaccactcccactttctgccacgggcccccaaagcagggccccagctctgtgcctggtgcctggcccctgcattcagtgtgcaagtgcagcaccgccccgggcccagctttgcttcgggaccccactctgcctgacctcactgctcccctgtcagtgggcaacctggccccgtcccatcacggcagcccccagggtggatgactgcagggatttggccgactccttcctgtgccctctctgaagtggccgaggcttgccgctgccatcaaaagggcatctgcatggtttcttttgtcactgctttctattgttctctgctgtctcttaggagtgcagcacattttagtcatcctttgaagctgtgacagcttcatgaaaacaatctattgaactgactgaattttattctgtcttccctggagaatatcagagaaagaatatatctaaaaaccattctgcaacacacacttaatatagaaattaaaagtttgataaagtaatgagcagcttgggggaagaatgacacatttgtcaacctcttcatgattctctaggatagcaatgacatgcataattggtgctaagcagggagtggaggagagtggatggaagaataattgattcttaatttattccattggaacaccttcaatgctgtattttccttaagttgtactagaaattttctatcatttctttttgagttgtttaaaagtcaaataatttaaagagtgtctagataaataacttataagacaacaactattggcagcttatttctctggcgggtttctgaggagttgagtggtgtggaaagagcatcatccttggagcagaaggcttggtgttgagaactcagtttgctacgtgttagacaaatttaacttggacaaagtctcaacccttactaagactcagctctctcatctataaagtgaaagtatttcccatgctaatctcacaaaactattatgagaaacacatgaggtgatgtgagagaaatctatctgtacgaggtaaagcaccacacaaatacccattaaatagattttacattttggtatacaacaagacaaaaatctgaccaggacacagacctaattatcctagaacaaaatgaggaaatttaatttagatagcaatggtgcttatcttgtaatttttgtattattatttcttctcttcaagggcaaacagatgactttctttgtgtattatacttattctgtttgctaatctttaatttacattctcctaaggcaacagttacctaacctctataactcattgtttagacaactgaatgactttctttcatccttgattttctaatactatcagtacaatgtaattgatacacagggtttgagaaacagtctactaatcaatgataagtcataccaatagtcactgccattgtgtaagggaaggtgatgctttgccaaaatcccttgaaagagaaaaagatacagggttgggcaacacttcaaggatctttcctgctgatgctttggacttcagtcaagaaaatatttaaatcagtccctaacaccaatggtaatttaatttttatggacccacagggaaagagattatgcacacacacacatatgagtataaaaacttttcagttataatattctaaagatcggaaaattataattttcaagcctaaattatacgaaaatcacaaggccatatatattactttattttaatgaatatgttgaaagtggaagaatagaaagggtgcttttgaaaagaggaaagagatcacagaaatacaattgaaaatgaatgaagggaaacaaaggggagaacatttggtttcatatcacaatgggagtctagcagtgatgtgaacaggaacaccctgaattttctacttttcctttctttgtacatgctgtcttgtgtttttgtggttcttaagtgagaatgcttgtcttccccagaagtctgagccacagaagattctaaagatagtagccagtgctcattatgtctaggtctagctcaacagtgctggtgatactgcttctacctgcatcatagaacttggttacatttttcttatatttacatacttagaattgtgcatctttggctaatctctaaacttgtggaggctgaacagtgtgttttattctgtttatatcccttattacgctaactcagccttatgtatataaaatattcacagaaatttcctggaaaaatggccttgagacaagatatatctatgcggttaaaatatgagcttggagatcaactttacagaagaggatgtgaaggagcccagtattctgaggagagcctgcatcaggatgtcaggtgatgctgtgcccttctctgcatcctgtcaggaagaggtgcagaaagactgtctcattactggcaatgtgaacttaaatcaggtgggtaagttgctgtctgccacattcttctactgtaaagttaccatttttcacattatgttaatctgtattttgtggggagatactttgagcctgggcaaatataccttttttgtcatactctcttctattaaatttaccatccaatgatgattttctgggttttacttaatagatattttctgtttccataatttcatcctcatttattaataagaattttacagttagcaagtgctgtctcctagtcactatttattatatggtttggtttcaagaagggtgaacattggaatgcatcaaacatgttagaaaggccaactttataaaaatattgtgtcaaatgcttgtaataacttactgcctttgattctctacatatgtattagtgtgtgggtgtatgagggtagcatatacaggtgccttgggcacataggtccatttgctcttgaaatcatgatggacaaaaaaagaaattaaagtcacgggtttgatatatccaaagggaagtacaactaaataatgcagacctgctactgggtgacatcatgtaacatgatgagagaggctaattcagaatattgtatcaccacatagtcaatagacaaaacaaaacaaaacaaaaccaaggaacaattttgagggaaaattggataaattgtgggttctcagaaaacctttctttgagttcatttttatttcatctctaaagtagtgaataatattgagtctaggtctttcttccataggtactgatatggtttggctatgtccccacccaaatctcaccttgaattgtaactcccacaattcccacatgtcatgggaggaacccggtgggagataattgaatcatgggggcgggccggtcttttttgtgctgttctcgtgatagtgagtaagtctcacaagatctgatggttttaaaaacaggagtttccctgcacaagctctctctcttgtctgctgccatccacataagatgtgacttgctccttcgtggcttctaccatgattgtgaagcctccccagccatatggaactgtaagtctattaaacctcttttttttcccagtctcaggtatgtgtctttatcagcagttttacaacagactaatacaggtaccatattctaaaagtatgaattcatttcacaaaatcacactctaatcatattaaatggcttccaaatttaaatgaacgatctttgcttcttagaaaagaattgtattatgagtcttggttagttaagatacaaaagtacacactttcttatagtacaaatagccttggtgtaaagcctaacaaaaattgccctctgggctaaagaattttctcacatttctgcctcgcaatggcatcaaaatcatatgagagtctttttctggccaagattgtaaagtcaatttaaaagattttgttacggtatcattttcccaaagggagtagtccttctgaaggtattactccagatttcaaaactgctaattggtgtggtgctgttggctaaacctaccatcaattatgaaataaaaatcatatttgatgagtttttttaattcattcaaagtgctttgaacttgctctaacagatagccacagtgacagataatgtggattggttactcaaaagctctttatcactccctctgccttgaatttccctactgaagagactagacagctaacttaagtcactaattcagcttctctggaagccacagtagcctgattaaagtagtgctttgttttctaatttcccgctttattgaagcgtgactgacaaataaaaattgtatatacttaagatatacaatgtgatgaattgatatacacataaaatgtgaattaattacacaatcaagctaaaaacatttgaaacgcctcacatacatacttattttgggcatgagaacacttaagattactctcagcaaattgtaagtacaaaattcattattatcaactattgttaccattgtgtacattagatctccagaatttattgatcttataacttaaagtttgtacccttcaccaacatctccccatttccctcactcatccaacccctagtaaccaccattctactcttctgattttatattccatatataagtgagattatacagtatttgttgacctgtgtttgccttatttcatttagcttaatgttctccagtttcacccatttttacacaaattacaagatttcattttttttaaggataaagaatgaattgacagaagtaggcttcagtagctgggtaataataaacttcattgagctaaataattagatacaaacacacatacatattgtatttatacatacatatgtatacaaaattttatttattcattcatctattaatgagcacttaagtttattccatattttggctattatgaatagtgctgcagtacatcagagtgcagacgtctctccaacatagcattttcatttcctttggatatatatctataattgggattgctggatcacatcataattttatttttaatttttgaggaacgtctatatgatttttcataatggctgtaccgatttgcattcccaccaacagtgcacaatggttcctatttctcaacaccctcaccaatatttgtgattttttgtcattttgatgatagccattctcaaaggtgtgagatgatacgtcattgtgcatttgatttgaatttcctaatgattagtcatgtggagcacctttttataaacctgttggccatttgtatatcttctttatgaaaaaaccattgtgttcatttgcccatattttaattaaattatttatttttttgctattgagaggtatgagtcccttacatattttggatattaaccttttttggatgtgtggtttgcaaatatttttaaaagccacacagaactaaaatatgtattagaattagtagacaagcatatcaaaaaactgttttaactttatttcacatattttaaaggttaagtacagaaatgcaagatataaagacaccataaataaaacttctagagctgaaaactacaatgtgtgagatgtatacaataaaaaatacactggattggcagaataaaatgtcagtaaacttaagaacaaacaataaaaactattcaaaatagaaaacaggagaaaatggaattttaaaaatgaaaagaacataagtgagctgtaagaacatttgtatgtggccaaaatgacatgaaattggagtccctgaaacgtcatggagaggaatcagactacatttaattatatactttaatagtgaaattttcccaatttaagattatatagtcataaatataaaaaagattatatactcataaatataaaaaattcaagaaactccaagtacaagaaacatttaaaaattcaccaaaaaaattctggggaaaagcatggaatagagagcagccaggatggattaatagaagcagctgcactctgtggctcccactgagaaggatgaaaactgcgagtgaactctgcatcttcaattgaggtaccaaagttctcttactgggactgactaggtggttggcacgaaccactaacagcgagcaaaaatgggatggaggaagggcccaccggggacgtgcatggggcaaaggaaacttcctcctctcgacaagggagacggtgaaggattgtgcgtttcctccctgaaaatcagacttttcccatggatccgtgcaacctgtggattaggaggtcccctcctgagcccacgccaccagaaccttgggtcccaagcaccaggctgtggagactcacagcagctgctcaggtggacggccactttaagcaggcactgacacacaggagtatttgcatgctctgactctgggaactcctgtgaggcagaagatctgtccactttcatggggagggggctgaagccagggagccaagcagccttgctcccacagaactctacaagctaaaacacactggcttgaaatccccactagccagcacagctggctaaagactgcctaagaagactgagttcccagggggatgggcagctgtcatcaccgtggctccagtcagccactttcccctgccaccagtgccagcaagaaggaggagtctaaatctatagcaactccccacagtacagcacagaggctggatcagtctgtggccagactgcttctttaaataagacctggatccactcctcactcactgagcaaggcctccctatggaaatctcagcatccccaaccagggatttatggacagaactctgataactctgagaggagaccctaggaggaggagcagctgtagtattgtggatcagtgatcttagtcttttctgcctgctcactctggagggtcagggcagcccagatgatggggattcccccagcacagcacgcctgccctgccacgggacagacagactgcttgtttaagtgagtctctgatctcacttctcctgactgattgagacctcccaacaggagtcttgagacacctcatacagaagcattccagctggcatcaggtcagtgcccctctaggacagatctcccagaagaaggagcaggttgacatctttgctggtctgcagcctccactggtgatatctccaggggtggaaggaacccaggagattagggtctggagtagaccccaagcaaaccagagcagccctacagaagaggggcctgactactccaagaaaaacaaacacaaagtaacaacatcaatgaaaaagaccccacaaaaaccccatccaaaagtcagcagcctcaaagatcaaaggtagataaaccaatgaagatgagtacaaaatcaacacaaaaataccaaaaactcagaaagccagagtgcctctttacctccaaatgctctcaacatgtctccagcaagggcacagaactgggctgaggctgagatggatgaattgacagaagtaggcttcagaagttgggtaatgaacttcactgagctaaacaattatgttctcactcactgcaaagaagttaagaaccatgataaaacattacagaagctgttaaactgaataacaagtttagagaagaacataaataatctgctggagctcaaaaacacaacacgagaacttcgtaatgcaaacacaagtattaatagctgaatagaccaagtagaagaaaggatatcagagcttgaagactatcttgctgaaataaggcacgcagacaagattagaaaaaaaaaagaataaaaaggaaccaacaaaatctccaagaactatgggattatgttaacataagacagaacctatgactgatagaggtacctgaaagagatggggagaatagaaccaagctggaaaacatacttcaggatatcatccaagagaaattccctaatctagcaagacaggccaacattcaaattcaggaaatccagagaaccccccccccaccaagtaagatatttcaagagaagatcagccctaaggcacataatcatcagattccccaaggtcaaaatgaaggaaaaaatgttaagggaagccagagagaagggccaggtcacctataaagtgaagctcatcagaatagcagcagacctctcagcagaaaccctacaagccaggagagattggggaccagtattcaacattcgtaaagaaaagatgtcttcttttgagaagtgtctgttcatatcctttgcccactttttgatggagttctttttttcttgtaaatttgtttaagttccttgtggattctggatattagaccttcatcagatgggtagcttgcaaaaactttctcccattctggatgttgcctgttcattctgatgctagtttcttttgctgtgcaggagctctttagtttaattagatctcattcgtcaattttagcttttgttgcaattgcttttggtgttttcgtcatgaagcagagagccaaatcataaatgaactcccactcacaattgctacaaagagaataaaatatctaggaatacagctcacaagaaatgtgaaggaccacttcaagcagaactacaaaccactgttcaaggaaataagacaggacacaaacaaatggaaaaacattccatgcaaatggataggaataatcaatattgtgaaaatggccatactgcccaaagtaatttatagattcaatgccattcccatcaaaccaccattgacaatcttcatagaattagaaaaaactactttaaatttcatatggaaccaaaaaaaaaaaaaaaatcccggttagccaagacagtcctaagcaagaagaacaaaactggaggcatcacactacctgacttcaaactatgctacaaggctacagtaaccaaaacagcatgtactggtaccaaaacagacgtatagaacaatggaacagaacagagacctcagaaataacaccacacatctacaacaatctgatttttgacaaacctgacagaaacaagcaatagggaaaggatttcctatttaataaatggtgccaggaaaactggctagccatatgcagaaaactaaaactggaccccttccttacgtcttatacaaaaatcagctcaagatgaattaaagacttaaatgtaaaaccccaaaccataaaaaccctagaagaaaatctaggcaataccattcaggacataggcaagggcaaagacttcatgaagattcttttaactgaaaaggatatatggatggcagataagcacataaaaaggagattcaacatcactacatttcagaaaaatacagattgaggcaatgataagatattcctacacatccatctagcatcaaaataaaatgtagtgacaataccaaaagccaacaaaactgtgtaggacactggatttctcatatactgctgatggagatataaaatgttacagctactctgaaaaattatttcagtttctttaaatctaaacaaacaactcatacaaccgagtgattgtgctattggcaatttgtccagagaaattaaaacttacatgtacacagaaacatatatatataattgtccaaataagctttatttgtaataatcaaaaactcaaaagagctctaatattactcaataggtgactggttaaagaaactgtggtacatgcatatggtaaaatactaattaacaatgaaaagaaacggacttttgatacatacaacctgcatggatctcaagggtattattctgaatgaaaacaagctggcctcaaaaagtaacataccgtatgatttcatttatataacattctcaaaataccaaaattgtagagatgcagagcagattagtggttcccgatggctaggcatgttgggatggtgggtgtgtctataaagaaattgcatgagtaagatatttaccgtgaagtaatactcctgtgtcttgattttggtggtggctatacagatctaaacatgtcataaaatgacataaaactatgcacaaacattttaccaacatcaattttctagtttgaaaattgtactctaattttgccatatctaacaatttggaaaaactgtatgaagcatacctttctgtacatttttgcaagtttctgtgaacctacaattgtttcaaaaataatacacaggaataataatatacagaagataaaataaaatacataataatatacagaatataactcttttcaattgcacagtgggcatttacacaaatagatgatattctgagccataaaacaaaccttggtaaatttacaaatattcaggttatacgaactatgttctctgaccacaatatgtaatttctacactcatataaagctccaataatcaacattgagtggaactggcataatgatagatagatagatagatagatagatagatagatcgatagatcgatagatctatcaatgaaataaaatggaattttaagaaatatactcacacatatttcaaaaaataatttttgagaaatatacaaaggcaatacagtggagaagggaaaatctattcaatacattgtgtgggcataaatggttatccatatgcccaaagtggaatttgatacatacgttgggttacacacgcagacctgcacacaaatagcaactcaaaatggatcatacctaaatgtgaaatctaaattgtaaaacttctacatgaaaaccactgtgaccttgggttagacaaatatgtctcagttatggcaccaaaggcatggtccacaaaagaaccaactgacaatgtggatgtcatcaaaatgagaagttcatgcttagtgaaatactccattaacagctgaaaagataagctacagaccaagagaaatcatttacaaaccacacattgaacaaggggcttgcatataaaatatataaataactctcaagagtaattgataagatattaaacaattcaatataaaagaggaacaaattagtacagacacttgactaaaggagatagagggcgaataatccttccagaaatgcaaaataaagctataaaaccatcacatgacacatctatgaaaataactaaaatacatatttttaaaatgataataccaagtgttggtgaatatatgcaggaactgctactctaatgtgaactgactcaacctcttagaaaaacagtttggcagtttaaagttaaacagataccagtcatatctgtttcactcctatgtgtttacacaaaatatatgaaagtgtatatctatataaacatttgtacatgagtgtttacagcagctttatttattatatcaccagaattgaaacaattacagggtccatcaacaggtgaatgaataaacactttgttgtatatctataaaattgaatactactataaaataaaataaatgtattattgttacatgccacaacatagatgaatccaaaataatgatgatgattgaaggaaacaagacaacaaaattacataccctatgattcattttatatgatatgcttggaattgcaaaccaatatatagtgatagaaaagttggtggttacctggaaacaaaagtggggtggggagggaatgatagatgggttacaaagggcatgagaaaacttttgggggtgatatgttctttatcttgatattgctgatgttttcacagacatatgtcaaaatttattaaattgtagagtttcaatatatgcaatctatagtgtatgtcaatgatacttcgataaagcttttaaaaagaaacatttaaaaaattaaacctttaagataatttagaggaggtttgccaacaaaaatcagcaatgcagggacctctgaaaattcagcagttattcaataaaaactgtgaatctagaagctgattgtaattttctactcctggaaaatggaaatgataattagccctataacccttatcaggtaattagaaatatgtgctcttcattgcaaattaatttcatttgagaagtgagctacaaagatacttctattatttgaaatgcagtttataggctaatcactgaaagcacaaattttagcaggaacaaagtaatgctcatatttggaaatatgatgatatctaaaaagatgagaccatgtagaaaaaaaagagatactacatattaaaattgtgatatttattcacaaaatagtgtttcacaaatggaaaatctctgagtagaagagtgagaaatgagaaaaaatagatatttgcctaagaaagaatcagaaaaggaaggaggaagaaaagaaaaatatatgcataagccaaatgttataatgtttaataccagagaaaatatatgttgatgtttgtttgagttattgacaaagcaaatacactttaccaaactaaaagtttgtataaactatgagaaattgtcaattgagaaggtttttatgtgtattcaaatatgtcaagtcctaaaagtatattaattcaatagaaaaacaactagctaaaactttaaattgcttcatgggattgactaagtgtacctgtgatatttcagtgttgtaagtagtatgaaaaagatcatactaaatatcctttttgtacatattcatatagttgctcaaagtggacatttctatcatatgaaggagttaatatattcatctctcaatatgatacagaccaattgtcccaaatagctaaataatccacaaattgatcctccttcacaaattaatttaggcacatacaatagtttatctataatttttcagaaattatatctaaattcttgctgtatataatttttaattgacacagaaggcagaattgaaagaggaaagtgaacagaatttctatacataagagataaaagtggtatttatttcctttttccactggtgagaggctcttaaaaagcatttgaggtgtgttccccatagtacttataaaaacttatccctgtccaaactaaaatatcagtattccttcttcatgtaaagaacagcaaagcacatgaagaacagaacaaaacaatgggatataggttcagggagggctctagtcaactgttcacaccaatacttattgttttatctaaataaaaggtttatcttacgtatcttttgaaaatggcacgatgtacataaaaaaaatctgctttctctgaggcacatacatacttctctgttttcctttatatatttcccttccatacaatgagtcactattatttttaaaaaactcatatattttaaaaagtggttaaaggatagacaaccaatagaaaacgaattagaacaatgataagacaccaaattattgcctggtcagattccattgaacacaagaagtcacattgtgcaaatgaagtcccaagggaacaaaaaatgccacctcaaaattcatttttcagagttgctttccttcaaatgtctttttgtggcatacttttatttgcctgtttgtgatccctgaaggcagcacctgctgcacaaatataaaatgtccctctactaccacattcttcatttggttagttatgcaattacacacacaacttagcaaccatttattggatgtgtactatgagccaggcccaggcatcgtactaactaatggggatataaagatggaagaaatacagaaaccaatctctcctccccaagagttcccagcctatctggaacaacaattgtggggtcatgaaatacagttggtaaatgaaaaataagtatggctgacttttcttgaacagttccaatgtgaggcttactgcgttaaccgctttctacatgaactcagttaatctagccaatagactgtgggtggatacaatctggggcctcattttacagataagaaaattgagatttagagaaagggatttgttcaaagaacagataaactgtggagtttccattgaaaccaggacacgctggctccataacccatattcccagtctctggcccagaggatagaacacaagccccatgcaatcctagtgtctcctagatattcattaaggagtcattcaagttcagtctacaacaaaagatttatttgggggtatagggggcacaaaaatgctgacagtgtcttcctggcagagggaggaatcaatctaaaagggtcttagacaacagctttgaaggataaaagaagtcactaaattgtgagatgagagctttacctggaatgtggcatggcattggttggggaaaatggaaggggaggaggaaatctgagcgccaataggtgactgcttaggaactgggtcctaagccacttaactttcatcctggcctcacctgtcctcagatgaggcactgaagagatgggtatggctgccccatgatttctgctgcctgtgcttagtaattttacccttctttggggtgctgtagctgtaaccgtatcccatgcttcttcggctggttatcactgctgattttccatggcccctgaggtgccaaagctctattctgtggataacttagggagaatttctcttcccttctgtgttatatactgtgttgggtgggacttggggaataacaaggccccaatgcattctgctttttatttcataaagaggtgttttactgaaattagctctttgagaatttaatcacatttttgtccctcaagttcagacatgaattcataaagggctgctctgcagacacatctgaatatcattctacactggatttagaattattcctccactaacagataaaggttaaacatacacggttgattaaggattcctttagaaacattatcttcaagaaaattcttaagtccctcttgtaaacaggactctggtggtccacgtgactagacaggcatgaatcctgtgatgtacaaagcataggtttaggcctcctgtgccacccttgaaatacatatattgaagttgaggtaatctggaccacacctaccagcctcttcctgcactgttcccttgtctaacattcccagtctcctagcatcctctgctcagcattggcaatacaaaacaaaaatattgcactttttgacagcaaacactttgcaaatacaagaagggcacaaagcaattataataaaacataaaattttaagtatgcgcttggtagaggaccagcctaaagagggaataatcaactgtctgttgagaggggcacgcattggataagaaatgcaaatgtatgtaccatttaactagagtcttgaaggatgagtcagggaaagttaagacacagagatggagagtggcaggtgtgggtatgtctaggcaggttagggtgaattttcagctacctgagagacaaaagggaagatccaaaggtacaggggagatgctcaataaatattgaataggtggaggaattaaaggatagctggtaacaaactatattctataacatcttactgtttctgaaatgtgtttgcttaaatactttatatacttttcacaatactcataaaaaggcagggtttttaggtcatatcttgcagatgacaaatttgaagtctgaaaaggctaaatcactgtcacaggagcgaaacaactaaaatgctaccaagaccccataaccatgccattgccacctcaatggccccagagcctcagaaatgacacccatcagaagcaacaagaggggcagaagtggtcccctgactttttgacctgtgtgtgttgtgtttcaggttctattttagttcttagtttagatgcaatgtaacaatagctttgtttgaaattttctttgctgttaagattcccgacatcacaacctgccatctgagaggccagagcaatttgtttagatggtctagctttgagagaattattgaagccacacctgcattctgaaatgctgccatgaagccttagctgtaatctgaaaacaaattctaacactgaaatctgatgtgataaaacaggttactaccttttcgtaaacagatcatgcacaacactattctattggaaagtggtgaccttaatttttaccatccaggtaaaaacaaccccctcttgtcttctaatatatgctttattcccactggatattggtattgccaccctttgtttaaattaaatcttgaagacatcaccaatgattatagtcatgaatgtcagcattaacgccagcaatagttggtaacaaaagccaacctataggagtttgtttgcagaaagggagaagtctggtttaggaaaatgaggcagagttgcttgatatgcatttcaatattcacaacaaagattgatataatacaataaaaaattattgaaacctggagggacattattaataagaaaagttattaagttaccttcccaaacactcattatcaactttgccagaaaagtgcacatattataaacactgataaaaatgttacatgatccgtgtctcattatgtccaggatacagcatgaagaaagaaaatgtgaaagttaactgaaaagtcattgcaggaggaagattccattgaggctactaagtggaatggcaaaatgatccatgtgacaaagaaacatgactaaattctatatattttttttttcaagacataatctcgccctgtcacccaggctggagtgcagtggcacaatctcagctcactgcaacctccatctcccgggttcaagctattctcctgcctcagactcccgagtagctgggattacaggcacatgccactacgcccggctaatttctgtatttttagtagagatggggtttcaccatgttggccaagctggtctcaaactcctgacctcaggagatctgcccgcctcagcctcccaaaatgctgagattacaggcgtgagccacctgacccggccagaactaaattctcaggggaagattgatgacagttactttgaaaatatatctcttttatatgaattaacattttcagtttcaaaaactattttacctgtcctgaatagataaagtgcaaaactacactgttatttcttgctcttcagatgtgttgtcataataatatgtatctcataccaatcccatagtccactgaatatatggaatatagaaattttctgcaaaggaatgcccatcaaaaagaataggtaacaaggcttctaggcctgaaagcatgcctacatctgtacaaaaaaaaatttttaagaaaatatcactttttaggttggctagagtaggggaattatttttaatatcattatttccatcatatatgttagtataatatgcaatgtattatttttaatataatatttttaagattattatttcctttcataatgtgcttcaaattctgctatatcacaagccacaatcatttatctatagaaaactggagctaattaatttgaatttgatgatgatgccaatagcaattataatgcagtgatgagtcttggcttagtccttgaaatgagaaagacaacagcaatcaactcccttaaaaaacatgtatttaacaattactttacgtttgctgcaccctaaggacaaaaaaaaaatgttccattctagaaagagcagagcagaattgagaaaaatgggccccttctagactccaaatattactgtcattttattacaaagctgatttttttggccacaaatgttcattctacttttgtatttaaaatgagagatttattattatatgcatatgtttatttatttggaattatattttattcatgacacacctaataactaaaaacattagttgttatcattaaagttaaaattatcttacatagatataattacaaaatctcgatcaaatatgcttaagatgtttttctccttattttcaacttagaaataaatttcttagttttccataagctctctaatatctagttctccatttttctttctattctgtagttttatttttcagttttctcaactagataccttaaaaaacccattactatatttaaatgaagaaaataaagcactcattctcagaaaaaaaagactttattttgcattacttgatttcataatttcagtggttgcagctgttgaatttcatcacctactagctgaccaatatcagtcatagtaaaatgtcatgcagctataccataaaatcacatgtggtatatatatagatagatatagatatagatatagatgtagatatagatatagatatgaattacaatctgacaaattatttctctcttttcttttttccttctggttttctttcctcccttccttgcttctttcttccctttcttccttctttttttcccaccttcttttcttccttcctcccttccttgcttcctgtcttattttcctcccttccatctttttcgttccattgcacttttcttccttcatttattccttccatccattctttgttgttcaccactctaggatgcagtctatattggtttatattccttcatttgttcaagtggttctgggaaacctgaattacttaccagttcagttaaagtttattttagtggtgctttcatcactccctcataccttgacactttccaggaatgcaccttggtgaatcactttgtgatcaaattctgagcagtgacaagcacatatctaatcaagtgaccctaacatagcaggtgagtgctctaaagaagctatattcaacatgatggaacgatagaaaaagaggaggttaaccctatctggcagaacttgagaggcttccagaaagaggtaatatttgatcttgaatggaataatgaagaggaagtagtcagacagacaagatagggtattccatttggaaggaaaccaggagaaatgactctaatccaatcaacaacatcaacagcaacaacaaaaatcattgacttagttaatatagttgtaaaattttattgttaaatatatatttcatagccaaagtctaatcttatttagtcgctggtggagttaagtaagacttataaaaagttcgttttgaaaccatgttccaggaaagctatacttagcctgaaagagcaggcagtgctgctaaccatcataatgttgttcacatcatgctgttcctgtcagggtagactggattgctctcagggtgatcaaaggagaccctggaaatgccagtgactcatgacggtaagatgttggggaaatatcttgaaaactggcatgtattcgtgtgctctgatttgtgagacttgtcagaaatctgaaattgctttctttctgttgtaatgtcaggtgatttgtgctgggtattatttgaaacatttaaacatttttcatacctgtactaatagtgatgaataccctcagccatatgtgatattgtctcctaggaacaaggaaggagtattcatattcatttcagatgctttttttttgccacactattgatatctacacctaattattttacaaatctcccaggttgcacacattatgagtcttttttgtataaatacacttttatattctattggttgcctactttttatgtttctataaatatagactagaaccctattcatagaacagatgtgtaggtacataaaaatgtgaaaagtgttattgattgctatatttccttaacattactgatatggaaattgaaaatcataaatccaggaataaagcaatccaaaaccatctgaatgcaatgagatacaaatgctttaaagttgtagaactttatagccaaaagttatcttaaaatgatttacttcagtctcctattattgaatataggaaactgaggtcaaatgaggttataacttactccagattcctcagttattgaaaaatcctggagttagaataccagtttcatgactccgagccacatgttgtttcagttgatctattgtatatactcccatataattcattttttctttaaatatattgataaaatcagaggtttagaagggccttcaaatatcatttattcctcttgtttttccagtggatagaatccttgttttctatacagacagtaagctattaactcataaagatagggaccatgtaaattagagtattattcaaatgctatccccaaattatcaactttctgcttaaataagtcaaatgaagttaacttatcaagtgaaaagtattacattttaacataaatgttactctgatattgaattaaaattcaatcaaaatgccacataatgtacataaatgatacaagaaagtttgtcagtgacatatccattctaaagtaaagggacttcattaccatgctgaaaagagcagtatcattaaaggatgttgataaattgtctccattgccaaggattggtcagtttttaagtcaactcacctataaaaagtttaacctataaaatgagacattctccagataaccccatattctactagacttatatccagtcaaatgcatatagctgacattgctacaccattcaacaagtgtactgagaccatactttgtggagcactgagtatgaatgcattttcacaaattgggctttggtctctaccatcatatgcttcatgaaccattcccctctgcatctctgagggagagctttgatgagataaaacagtctgggttccaatcgctgctctggcacatgctaactgagtaggtcctttctacctgcaatacttttgtttgtaaaatagaatgaaaatacctctctcataaagtttagggaacataaaatgaggtggtacttataaaatacccaagtgcagtttctagaatataaggcagaattgaaaatatttaagtacgagatattgtgattcactttgattcaaataaatcaataggaaaaatgtttcgatagcatttaatggcaaacatttaggaaaggtcattgtttttgacataaatgcgtttgataattcagtatatcagaatacagggctcttcattcatctttactgaaaacataatagagaaggttggaaaatatttacagagcagttaccataatgcaacaaatacatattttattctgtcactgtatagtagattttgggcaagtttgttgcaaatgaaagaaacccttctgtaacattttgttttcattttaagatttttatttttattttcactgcactgtaatccttagcctcaagacaacaattacaacaaggagcttgttatgcctttttatggcaaatgttatatgttagagtattttttatagaaaattggattaactcatagaaattgtaaagtacacactagcactctgatgtttagcttattatctattcctatctttgctaaatatgcaacatatctatttacttctctatcagaaagctttaaatttatcctttcaagcctatttacaaaaaataaatttttgaatcaaatacactaatttctaaacaaaacatatattatttcttacacaatgaaaggtaagcaaagaaccaatgtcgactatagctagtaaagttagtgctttcattacatattacatattcaccatttgacaaccaccgtaaggctgataaaataatgaaagaagaataattttgccttttcttaggtgaaaatgtttaccacaccagggctcagaattgagttacctgtcctgctggaacctgaacttttcttttaatctctatccctacattcctgtaataattgcctataaagactgatgtccttcctaaaatctgggacatgtaatataatctcgctagatgtcttactagatactggtattctagctagaaacccagctttatggctggtgcctaacaactgttgagagatctccccacgtctcaattcctgttgctttatccacatctctgaacaaggccttgtccaaattctctggaaatttgctagtcacagaagcagtaaccaaacaaggcttttgttttactgtgcctcaattatatcccatagttaatgaaaacgtatgaaatatctttctaattatttgtgccttcttcaatttcttttaatgttttatagtttatgatgcacagatctttcaccttcttggttaaatttattcctaacaatttttgcagctattgttaatgagattgctttctagatttctttttcagatagtttgttgttagtacatagaaatgctactaatttttgacggtggattttgtatcatgtgactactgaatttattagttctaataggttttggaggagtctttaagggtttctacgtataaaatcatgtcatatgtaagtgtggacaatttaacttatttctttccaatttagatgccttttatttctttcttttgattaattgctctggctacgacttccagtactacatggaacagaagtggtgagagagggcaacttcgtcttgttcctgatcttagagaaaaagctttcatttttcacacttcactataatggtagctgtgggcttgtcacatatggcctttattatgtggaggtactgtccatctatacctaatttgttatgagtttttattataaaagaatattaaatttagtctaatactttttctgcatcaactgagatggttttgtgttttctatcttttattctcttaagctggtgtatcataataattgatttttgtatttcgaaccatccttgcatctcaggggtaaatcccacttgattatagtgtgtgatgcttttaatgtgctgttgaattcagtttgctagtgttttgttgagaatattttcatctatgttcatcagggacattgaactgtaatttttccctgtagtttcattgtctgactttggtatcagtataatgctggcattgtaaaataattttgcaagtgttctctcctcttcaattttttggaagggttttagatgaattggcattaaagttttctcatatgtttgatagaattaaccactgaagctaccagatcttgggcttttctttgtttgaaagtgttttattactaatttattctccataattgttaatattctgttcagattttctatttctttatgacttaattttactaggttgtaagtttctaggaatttatttcttcttggttatccacttttacctcatgtaactgttcacagtaatctcttataatcttttgtatttctgtggtatcaatgaaaatgtctccttttttattaataatttcatttgtttgagtcttctctcctttttgttactctagctataagtttttcaatttggtttactgttacaaataactagctctagttcatgggtcttttctattatttttctagcctctacttcatttatttctgctcttatgcttattcttgtttcttctgcaaacttcggaattagtttactctttttctagttccatgggttgaaaaatgaggttgttttgttgactgtgggtttgtcatagatggctatcattattttgaggtatgtttcttcaatacctagtttattgagaggttttaacatgaagggatgttgaattttatcaaaagccttttctgcatatactgagataatcatatgaatattgtctttatttatttatttatttatttatttatttatttatttattggagacagagtctcactctgtcacccaggctggagtgcagtggtgtattcttgggtcacttcaacctctgcctcccaggtttaagcaattctcaagcctcagcctcctgaatagctgggattacagacatgtgtcaccacacccaggtaatttttttttgtgggcggggttgtctttagttctgtttctgtgatgaaacacatttattgattggtatatgttgaaccaactttgcatcccagggatgaagcctacttgatcagggtgaattgactttttaatatgctgctgaattcagggtgcaggtattttgttgaggagttttgcatcgatgattttcaagaatattggcctggaaccaatccaaatgtgatggcatttgcaatgatctggatgagattggagactattattcctaagtgaagtaactcaggaatggaaaaccaaacattgtgtgttctcactgatatgtgggagctaagctgtaaggacgcaaaggcataagaatgatacagtgggccgggcacggtggctcacacctgtaatcccagctctttgggagtccgaggcgggccgatcatttgagggcaggagttcgagaccagcctgaccaatatggtgaaaccccgtctctaccgaaaatacaaaaatttgctgggtatggtggtgtatgcctgtaatcccagctactcgggagactgaggcaggagaatcacttgaacctgggaggtggagattgcagtgagctgagatcgtgccacggcactccagcctgggtaacagagtgagactccgtttcaaaaaaacaacaacaacaacaaaaaaacccagaatgaatgttacagtggactttggggacttggggagaagagtgggagggggtgagggataaaagacaacatatatggtgcagtgtatactactcgggtgatgggtgcaccaagatctcacaaataaccactaaagaacttactcatgtaaccaaacaccacctgtaccccaataacttatggaaaaataaaataataataattttaaaaaagaatattggcctgaagttttcgtttttggctgtgtctctgctaggttttggtatcgagataatgctggccacatagaatgagttggggaggagtccctcttcttcaatttttgggatagtttctgtaagaatggtaccagctcttttttcatacatctggtagtattcagctgtgaatccatcaggtcttgtgtgtgtgtgcatgtgtgcgtgtgtgtgtgtttgtgtggttggcaggctacttattactgattgaatttcagaacttatcattggtctgttaagggaatcagtttcctcctgggtcagtcctgggagggtgtatctgtccaggaatgtctccacttcttctaggttttctagtttgtgtgtatcttggccactgccctcttttttcataatgttagtattcattgctataaacttctcgggactgattttgctgcatctaataagttctgtaagttgtgtttccattttcatttgtcttaagaaatgtttttgtttccctttggatttcgtttttgagcaatttgttgttcaggagtatgttatttaatttccaaatacttgtaaaattttaatttttcctccttttagtgatttatagtgtcatatcattgtagtcataaaaatacttgtattgtggttctccagagagacagaaacaataagaaatggatagatagatggatagatagatgatagatagatagatagatagatagatagatagatagatagatagataaatagacatatcagaggagatttattaggggaattgtcatacatgattcagggtttcagaagtcccataataggacatctgcaagctgaagaatcagggaagctggtagtgtggctcagtccaagtccaaatttctcataaccaaagaagccagtgatgtaactctaagtctatggcccaaagcctgagagcccaaggggctgctggtgccagtctctgatttcaaaagctgaagaacctggaattcagacatctaagggcaagagaaaagtcaggtattggctgcagaagagagagcaagaatttaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctgatatccagaatctacaatgaactcaaacaaatttacaagataaaaacaaacaaccccatcaaaaagtgggtgaaggacatgaacagacacttctcaaaagaagacatttatgcagtcaaaaaacacatgaaaaaatgctcaccatcactggccatcagagaaatgcaaatcaaaaccataatgagataccatctcacaccagttagaatggcaatcattaaaaagtcaggaaacaacaggtgctggagaggatgtggagaaataggagcacttttacactgttggtgggactgtaaactagttcaaccattgtggaagtcagtgtggtgactcctcagggatctagaactagaaatgccatttgacccagccatcccattactgggtatatacccaaaggactataaaccatgctgctataaggacacatgcacacgtatgtttattgcggcattattcacaatagcaaagacttggaaccaacccaaatgtccaacaataatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataagtgggaactgaacaatgagaacccatggacacaggaaggggaacatcacactctggggactgttgtggggttggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaataaaataaagaatttaccttttctctgacattttgttcaatgagcatgggactgcagaggccagcctggaatttggggtggcaggggctgacccagcactgggaaggcctaaagcctgtattaagggttcttgtctggtgcctaggaccatggagaccaacctggagttgaggctgcagggcccagacaggtgctgtcaccagtctcgagggaagggtgggcttggattctgagttcatggggacagtttgaagcattgggctaccaaggctggtctggaaatagggcaagcctggagattgaggctgagggagctggcctggcttggcatgggcctgaagttggggctcactgtggctaatctggtactgaggcgagtctgaaggcttggtctgtggtactagcttgaagccttgggcattgggagctggcctaatgccagatttcaataagcaggctcactgctgtggtccagggcaagattaggaactcacttcactctccttcccccacatggagggtatctcttccagtaatgtgctgcctgtactgggagaaggggtgattcaggtaatgtgaaactgttttttcctaccctcttccaggtgtctttgttttatttctgtactacaaccaagtgctataatctcacatctggattacttggttcttttgaaggtatttcatatatgggtagttgttcaaattgatgttctacaaggggatgagcactggaaagtccttttccctgctatggttctcaatgaagcctgcactgtcctagaactagagacatgctctatattttatatggtttcacaacagacaaccaggcccttttggcactgtttatctgacaaaatttaatcctaatccatttttcaggaatctcccattggaagaacaaagaaaataaatatagaagagtgaggaaaactgtttgctttttttgttgttgtttaaaaaagcattagaaatactagtcctcatttctttcagacccaattcacttcatacttactaaatcagaatctcctttcttacaagatccccagggaatgcatgttcccgtctcaaggggatgtgaacaaggggagggataaggacggctcaaaaattccaagggcttttaccagtttgcacaggcagagggaagccaaaagctcaactagtaaaacatttcacccttttgccggcatgttttttgggcttctgtgttcccttcccctgagcccaatcctaagccaaccggtttaaggtttgggaaattaactctttccagcttggaggacgcaactgagaagagtgtcccatagtacagagacacaattacctatcagtgaagagaggacagaggaggagaaaggaataaaaagaaggtgtttttttcaaaggagtcccagggtttcaggatgcattctaaaggggtacagactgaagatgagtggctacctgtctagaaagaagggagcaggcatccctggttcccttcttttcctagcagatacctggggataaatgagggagaaagagaagagtgtcctattttcattttccatccttgcatccacgagttctggcaaccttggcaggtgctgccatgggtgtcaaagtgacttgcaccctggaagcagggaggcctacagaacaggaattacccgctcttacctatgtctctttcccacctgctgtcagtagccttagagttctctagacctcatttatgccatggatattaacatggcctttatccatgaaacaggaagcttggggttggcttaattggcaggaatcagccacactcgcctgcgctgtgtcttttaacttctgttgtcatttgcatctggatccctcagatccagttttctttcctagggctttgacctgaagcttgaaattgagtctggggcaaaaaaatgcctctcggtgggggcagagcttgcatggactccttgtcataagccaaatgctaaggtgaaactgtggaaactgtgagtccttcttcaacaagggagagaaaattatgaattgtgacatacccagataactggtagctttcattatgcttgctaggtttttggtgcatggtgcttggctttggttagctccctttgtttaactttcccaaaaggaaacctccaggtgatgggcatcctatttattccaatcacctggcaggatttgctggataattgctcagagctagaatactgatccagatttttacgttacccatccctcttgttctttctaagctgcagccaaagattgctggttggtccacaggaacaagcagcattagtctaaaacataggtgaaaacttaaaaaacaatgaatgagtttagaatttagtgacacatgtatgataagttttggaacataatttctctctttacagtcgtcatttttgttaacaaacaaatgatcataagactgagttgttaaatagactttagtcttatacttggcccgattatttgcctgaagtgcagcaagaataattatttctacataggccttttggattggttttgatggaattctgttccacaaggaatctcatataagatcttttaaagccaagcccaaccatgggtttgtatactcaaatacctgtgagttgggtgatcctgtcctcttaaggttccaagataagtttggagctcctagacctgttagaaagtgacatcctttactgaccacaggtcaggaaccctgtccagggactgtgtaggtaagagtatgaggccagttttcccaatgggcttctattagctctgtaagtcaagcttgactcctatagattcttatcacactgatgcaaacaagtatattgtcataagttaagaatactcacagagagtttccaaattctagagaaaccaggcagagagaaacaaacatgcttcaaattttgttcatagaagtatgccttactcaattattaaaggacttaaatagttcaaaataagtttccttgactatgaaaacaaaacatggattagcaatattccaacaaaaagtcaaaaagtttgcttcagctttctgagttcagtccattaactcttgttttgcttgatatttgtgaacatttcagctcttcatgagccctatacgttttcctttattccgatgttacaatttacaaagttatcagaggcctgtatttgagagtacctgttaaaagttctgtagcttattttaaaccatcttttgaaaaggattcaaacaagacaattgcctgtgaataacaaaatgttcagggtagttacgcttagaaacacaattgacaaagaagtttggttatctctgtggtttacagtaacttaacataaaaactatgttaattatgatggatagcatatactcagacattagaattttagaaattccatataattttggaacatatattagcattattcaccaagatataacctaaagaagattgagcatcattttggcaatcccatgtacttaaacatgtcaaataatcctgtttacctctgttttctggacacttcaggggccctctgaagtattcaaaagccaggtgtcagggaagacaattttgaaactgaagtttgatttgaaaaaggctgttaaatgttcaaggtttaaaacacttgacattatgaaatagaattccagattaccgtaagttatttattttgccaaaatgatgactcagaaacttcaaagaagcaaaaaccttgtacaaccctctaaaaattttgccaaagagcagattagcaccttaggagaacattgttatgcttttatttcaatgctcaatttgcggaaaaaacacataatacccttttttgaattgagtcaatatgttcacagagagaacctcttctgcaagattaatttccacaattcttccaccacttcattgaaccttcagcttttttctaatttaactcaaaacaatcctttaaccctaggcaaaagtttacatttccatgccttcttataaccttgtactaaaaaatacattttactgttcttacacaccttgaatgtaaatctatttctagtagtttcaattaactcatatcaatttttaactttaaggtgaaacagcaaaccttgcacctgacctgcattttaccaatggtctttagggttgcttttacttcttaaagattaaagtcatgtggactgaaaggtaccacaacattaaacttccctttaaaaaatgttagatccaagtgtttgtctttctttaggccaaattaatcagagctctttttacagacatcacacacagtacatacatagacaggcagaagcaaatccagtcactgggtggggccctttaagaggcaggggtaggaaaacatgcagatatcaaaccagaaagaagcttattccctaaggtaagattgctaaacaaagcctgccaccagacttacaagccatgccctcaggatgtaaaaccagatggaggcttgatttcacaaataaaactttgcagaaaatattaacagtaatagttggggaagcctggcctagtaaaacatcttctaaaagaaaaaaaaataactttaaaagttaacttgctgatgaggtagagaatgggaaagaaaagaaacagttgaaaattgtttggggaagaacctcttattctaatgcaagtggttcctccaccagggagaaaagtttaattactgtaattactgtccaatggagctgaatctcttggctggggaaggggaaggctgcactggtacctggctgggacccagccagctggctgtgcaggacccttggaccatgcgtcccaggcccagcagggagcggggagcggtggggacctgctgctcactggttcctcccaaaaaaggaagaaaaaggccatgagaatgaaaaggctcagaagcgagagggaaaaagaatttttggtttgcatctcactcaccgcttttcaagctcccacattgcacgccaaaaatgttgcaggacttttccttagttcagttaaagatggagtccttgtctgtcccatggccatgaaaatttagtctcgcaggtggtttgaatggtgagtaaagcagcatttaattgagtgaaaagggaaaaaaaaagggggaaatagggacttccgcaagactcttcgaggactccctcccacctggctcagtgagacatagcatcttatttgatcttaacaacgaataaagtattaatgagttagaaaagttaacttgtaggagattatagtaataagaagtatagcagaaacttattgcaattaactgtatctgactcaaaaaatcctgctatttccattatgtcacaatgtttcaccgcatacttaaatatggcctcacctacagtttaccaaaatcaattttcattgttttcttgtccatctctacataaataagagtagtttaaaattatatgttacttaactgttttataaagcttattcacatattttaatttgcaccactcaatagttctgtgaaattggcaaaaatgtgactattttctcctttttaaagattatttgaaatttatattggttaacaaacttctgtagagtgaacagctactaaaatggcagtgtccagacctgaacctaaaagttacgagcctgaacctttgaaacctaaaatagatcacactgacttaaacaattatgtgtgtttatttggatattgtagtgtttttttaaagcatactaatttattaaattatttttattatgagctaaagtacagcttaagaaatggtcaaaatgtaaatatctataatttgtgataacattcaaattacaggtatgcctccccagagaaagagacattcctcatggaagagcctagatacaagaaagaattaagcaaaaaatagtaaacacatatatagatgcatattctgttaaaacatttacaatgtctaggagtttatatatagaattaaatgcagaaaaacatcagtatacaaattgtgatgtgataaagtgtattaagcatcttgcaattgaagtattgattgtccttattttttaatcaactttattgtgaaatgtaaaacaatatagaaaatccataaaatataaatgcatagtttaatagaaagttgaaaagtaaatacctatgtaaccacgccattttcctaccattcacagcctcttgcctctcccctgtcagagtaaagcttactctgtctattacggtcatcattttatttttgttactataaaaatttggtagttcaacttatggtcaatatttgtaaacattttatgtgttaataaaaaatgtatactgtgctgttatcggttgaaatgatttgtgtatacttatgcacacacatacatattaccattaagacgtgtttgttaatggtgttcagatctgctataccctggttgattttattttgtgtgtaattattaccaaaagaagagcatgctaaagtctcccacagtgactgtggggtttatccatttctcattataattttacatatattgcctctgtgtgtgtgtgtgtgtgtgtgtgtgtgtgtgtgtgtgtgtggattttgagactacgctattgttttatctacctcatgaaatgaatcatctttatgaactggctactgtaatggtttttttacttagcagatctatattatgtctgcttcataggcatatataaatgactatttttctttctttttttcttccattatggtcaccacccagatgacattactgcatgtattatggatgaattttgttctgtttttctctaacactaaggttgtatccctttttgattctagattcacctcttcaggtattctgggtcctcacttctatatccttccttccttctttccataatgactagttgtcaaaagaatttaatcccctaaataaaagaaatacaaagtctctcatggttgttggtggtaggagctaggtgagaagagttgctctgttttctattaagcttcccagattctcactttgtagtacaaccttgacctgtagttttcccatatattttctgctctttgatgcttttaatgttttattagttgtatccaatataaagttgctttttattggaagggtttatctaaataatgttacttgagttaagcagagcttctggaacttaagaaactgaacaacaagtttgaaataatccatgatgataaagaagctaattgtctctacctttatgaatacagctaattggaagaacataaagaactggaaaaggaaataaagagaagtgttgatgtaggttcagaagaaacggatgctcctaggtagagccaaagaattcccaatatatgaagagaaagaatcacagacataacttattccccactttccatgtggacctctaagagtgcaacatgccaatatcggcagccttagagtagaaataatgcaggtgtaattgcaaagatattctagggcttttctaagtctcttgcatcactaaatttcttttttaaaaaattcaatatgtaataataaagaggaacaggaaagtaaagcccaaaatatcacatgtaccctatacatatatccaattattacgttcctaatatcctaaatatcctgatttgatcattacacactgtatgtatgcatcaaaatatcacatataccccatacatatatataggaaatataccctatatacaatcatattcatcatctcaaccatttattctctgtgttgagaacattttaaatcttctcatagatattttaaaatatgtaagatatgactgttaactgtaatcaccctactgtgctgtcaaacattagaactttatgtttgtattcattaatcatatttatttgtaaaacaattggctcttagaaaaaggcaggttttgaacatctggagatgtctagtgtccctggaaagaatgtggaggtagtctgaggagggcacaataaatttgaagggactcaatgttttagatgaggaggatggcatatgtccctggtagatctgacatcaaaggtcaggacagccagcagacataaacagatggaattgatgaaaaagtcagaggtatctcatagtgggcagaaaatgctataaaccaaacacaaaacctaatgtgacattttaaaacaccacaccatccacagcatttgtagccaagaggaaaacagatgaagatgaaaatttagaattttctccctaaataataatgagaaaaatccagaaattgctgcttttaccattaagtttccagtttatgttttctttgttctgcaaataggaaaatagatagcaaagtttgatactttaattgatagcttaagctacatctttgaacacaaaattttatgactgtgaaatttattgtaccctaaatgggagctgatcttatattccaaagaattttaattccctttcaaaaatttattgttgaagtgtgagtcacacaacataaggttaaccattttaaagtgagcaatttagtgcaatgtgatacattcaaaattttgtgcaactaccacctgaatctaattccaaaatattttaatcacaccccaaaaaatcctgtagccactcagcatttgcttacaattcttttctccccactgcttctagtaactaccagtctcttttcagtgtatttatttagtttgtatgtttcatataaactgaatcatacaaagtgtgaacttttctgtctggcttatttcacttagcataatgttttgaggttcatccacattgtagcacgcatcaatacctcattttttaaaagataaataatattttattgtatgtacaaatgtttcttcatctgtttggacatctctggcattttgctattgtgtatagtgctggtacagacatgtaagtacatatatttatttaaatacattttttatttatcttgggtaaatacttcagagtggaatttttggaacacactggaattctatgtttaactttttgaagaactgccaaactgttttccacagtagctgaaccactttacatttccaccagcaatacacaagaattccactttcttcacatacatgccaacacttattttctgttttgttgagtatagccatcatagtgggcatgaagtggtatctcattgtggtttaatttgcatttacctaaagactaattatgctgatgttgaacatcttttcatgtacttgttggctacttgtgtactttctttgaatgcatatctactaaaatttttgcctattttaaaattgggttgtttgattttttgttattgagatgtaaggtttcttacatattctgaatcctagacttatcagatataaagtttgcaaatactctctaccactatgtaggttgtcttttcagtttcttgatgatgttcttgatgcataaacattttaaattttgatacagtccaatttatgtacgttttatgttgctacttatgcttctatgtttactcatgtagttatcttccctggagtgtttatttcttcttgtagtttcaagttattgtctattgtcctttcacttcatcctgaaggtcttcctttaacacttattgtaaggatagatctattagcaagaaattctcttaaattttaattatctaggaatgtttaattttttttatctttgaaggatagttttgctggagatagaattattggttgacgtattttttttttctttcaaaactttacatatgtcatcccactctcttctggccttcacaatttcctgtgagaaaatgattgataatcttactgagattatcttgtacagaactagtcgtttctctctggctgttttcaagactctccttgtctctggcttttgagaatgtgtttataatgtgtgtcattgtagatctctttggttttttcctacttgaggtacattgaatgtgtagatacatatagtttaacaaatttaagatgttcaggtcataattcatttaagcattatttctatccttttttgtttctcttctccttgtgagacttccctattatgtatattggtatgcctggaccattcaattttcttcttttattctttttgttcctaaaataattttaatcaccctgtcttcaaaatcactgattctttcttctgcctgattaaatatgctattgaatctctctagtaatttttttttcatttcatatatttgtacttttcagttccgggattttgatctagttcctttttataatttctacctctttgttcatattctcattttgttcagacattgtgtgtttttttcttttggtacactttagttattcacaaatggtttacttcactgaacatatttaagactgttgatttaaagttgttgtctagaaagtcaagtagctaggctttcccaggaacagtttctgtcaatttattttattcctgtgaatgggccatacttttctgggtttatttgtgtgccttttaatttttgttgcaaactggcatatagaatattacgatgtgataactctggatatactatctttccctttctcctgggtttgctgttgttgattcttgagggctgttgtctttttctttagtgatttttcaaattgtatttgtaaagcctctcttccatgttatgtgtggtcattgatgtttctgtttgatatctcaatgggcagtggttacctgacagtgatttccttaaatgcctgaagccgatgataaaaataacactctcctagtttttgcagcttagctctgagctgatgcccttcttagttgttactcaaagttgcctaaaaatctaccttagcactcatatcctgcttatttgaagcacaaatctggcagaggtgaaagcctacatccttttaggtcattaataagcatgtatttgatcctgagcatgcatgttcacagtggcctttcagaaactttatttccccagtacgtttccttcttagcctccaccttcatagattatttggtctgcctgctacttgcccacactgccatcacttgcctcagaaggtataaattatatctttacatattttgataactgccatcactgtccaaaaactgcttcattccaatagagggatgcaaaacaaaggtcagcctcactgctagtctatcagggaaccaccaaaaaaggtcaacatgtatattcatgatgtgaatgtgttattttaaagtccatatcaggcccttggcaccagcaaaatgcaccaagaatgcagggaggtatctactgggctactgacctactgaaaaatggaagatggtaaggagatgatcaaaagtgctacaacactgtcttatcaaatttcaactctccttttattcatatagcaattctgtgttatttaaaattttggattagatttttcagagttatggagaatttgattctatcactccttttcagcttgttgtttcagtggaggaaacaaatattttgtaccttactctgccgttttccatgatgttaactgaaagaattttggtgaggcacatacctggctcaaggacaaataccaatcttggatgggaagtgaagtcatcaacttgagtccaagccacatatcttatgagagaaattagattgactcccagaattcgttactgatttgcaaacattggattttaatgagattgagtgtattacagaacacattacatccactggactgttagcagaagaaaaacaccaatggaaagctacgaaaaaagttatcataaaagcctctatgtggattcttaatttctcttgtaagtatttaacttcttctggaaaaaaaagaaaagtgagttccaaatcaggtttaaaggtattatctgaaaacctgtgctttctggaaaaaaagcagaactccatatctacactaaaaagttaagtttctaggggctggtaaagcatagacatgacaactaaagctatcatgataccacaagcattctactttctgttttcttttcaaaaatatgtaataaactatactcattaaaaatatggccaaaatcaaccttgagcaaaaataataaagccagggtcatcagactacctggtttaaaaatctactacaaagctatagtaatcaatacagcttggagctactggcataaaaactgacacaattggaagagaatagtgagcccagaaatatattcaaatatttatagtcaatggattttagcaaaaatgccaacaacacacaatagtgaaatgacagtctcttcaatagatggtgctgtgaaaactagatatttacaagcagaaaaatgaaataagaacttcatctcacaccatatatcaaaaaaattcaaaataaatacttaaatataatccatgaaatttcaaaactactagacagaaacatagggacgaactctatggcattggtctaggcaaagatttttttcatatgacccgaaaagcaaaggctagaaaagaaaaagtatacaagtgagattacattacacttttaaaagcttcttcaaagccaacaatcaacaaagtgaagacacaacctactaaatgggaaaaaatattttcaaaccatcatctgataagtagttaatatctaaaatatgtgaggaactcaaataatagtaagagaacaatgtgattttataaaatgagacatttatcacaagaatacataaaaatggacaacaggtatatgaagaaagtactcagcatcactaattatcagagaaatgcaaattaaaaccacaacaggatggctattgaaaatggctattatcgaaaagacaatagataacaagtgttggcaaggatgtggagaaaagggaaccatagtacactgttatatgaatatatgaatatgaatatgaaatatgaaaagggaaccataatacactgttatatgaatataaattagtacagccattatgtaaaactgtatgtaggtacctcaaaaaataatcaaataatccccttcctgggcatatatccaaagataaaaaatcagtatgtcaaggagatatctgtacacccatgtttattacagtgctattcacaatggcaacgatatggaataatactaaatatccatcaatagatgaataaagaaaatgttatatatattacatatattatatatatatatatatatatgtattagtctgttctcatggtgctatgaagaactacctgagacttggtaatttataaaggaaagaggtttaattgactcacagttccacatggcttgtgaggcctcaggaaacttacaatcatgatggaaggcacctgttcacagtggggcaggagagagaatgagtgaatgctgagtgaagggagaagccccttatgaaaccatcagatctcatgagaactcactcactatcacgagaacagcatggaaggcaaccacccccatgattcaattatctcacaccaggttccttccacaacatgtggggattatgggattacaattcaagatgagatttcagtgggaacacaaaactaaaccatattcattccacccatggcccctctgaaatctcatgtcctcacaattcaaaacacaatcatgcccttccaacagttccccaaagtcttaacacattccagcattaactcaaaagtccaagtccaaagtctcatccaagacaaggcaagtctcttccacctatgggccagtaaaatcaaacacaagttagttccttccaagatacaatgaggatacaggcattgggtaaatacacccatttcaagtgggagaaattggccaaaacaaagcagctacaggccccgcgcaagtccaaaattcagcagggcagccaaatcttaaagctccaaaatgagctcctttgacttcatatctcacatctgggttaggctgctacaataggtgggcacccatggctttgtgcagctccacccctgcggctttgcaggatatagccccactcctggctgcttctacaggttggtgttgagagtctccggctttcccaggtgcacagtggaagctgtcaatggatctaccattccggggtctgcgggacagtggtcctcttgtcacagttccacgaggcaatgccccagtgaggactgtgtcaggactccaaccccacatttctcttccacactgctctagaaaaggttctccatgagggccctgaccctgcagcaaacttctgcctcaaaatccaggcattcccatacatcctctgtaatctaggcagagtttccatatctcagttcttgacttctgtgtatctgcaggctcaacaccacatggaagctgccaaggcatggggcttgtactctctggagccacggcctgagttgtacctcggccccttttagccatggctagagcccaagtccctaggctgcacacagcagagaggcccagggcccagcacacaaaaccatattttcctcctaggttttcaggcctgtgatgggagaggctgacatgaaagtctctgacacgtcccggagacatttttccctttgtctttcagatttgcatctggatccggcttgaatttcaccccagaaaatgggttttttgttttctatcacgttgtcagtctgcaaattttccaatcttttatgctctgcttcctcttggatgatttgctgcttagaaatttcttcttccagataccctaaatcatctctctcaagttaaaatttccactgatctctagggcacgggcgaaatgctgccagtctctttgctaaagcatagcaagagtcacctttactccagttcccaagaagtttctcatctccatctgagaccacctcagcctggacttcattatccatatcactatcagcattttagtcaaacccattcaacaagtctctaggaagttccaaacctttccacatcttcctgtcttctgagccctccaagtttctaagaagttccaaactttcccacattttccggtcttcttctgaacccttcaaactgctccaacctctccctgttgcccagttccaaagttgcttctaaattttcaggtaactttatagcagcaccccactctctgcagtaccagtttactctattagtctgttctcacactgctaagaagaaatacctgagagtgggtaattaataaaggaaagagttttaattgactcacagttccacatggcttcaaaggcctcaaaaaacttacagttatggcagaaggcacctcttcacagtgtggcaggagaatgagtgaatgctgagcgaagggggaagcctcttatgaaaccatcagatctcatgagaactcactcactgtgatgagaacagcatggggtcaaaccacccccttgattcaattacctcccaacaggcccctcccttgacacatggggattatgggaatacaattcaagatgagatttgggtggggacagaaaactgaaccatatcaacatacaaaatggaatactattcagctttagaagagaagtcctgtcatttgcaactgacagcaacaatatcaatgaacctggaggacattgtgttaagtaaaataaaccagaccaaagaaaaagtccaataccaaattatctcatatacagaatataaaaagagtataaaaagcaaaagtcatagaaacagagagtgaaatagtgattgattaccaaaggctagggggaggagagagaattggggagttgttggcaaaaggacacaaaatttcagttaggaggaataagtttaggagatttattgcacataatggtgactacagttactaacaatatattgtatatttgaaaattgctaaaatagtagaatttgagtgttctcaccacaaaaactaagtatgtgaggaaatgcataatttaaatggcttgatttagccattttacactgtgtacatatatcaaaacatgttataaaccataaatatatataaaatttacttatgaatttaagtaaatatatatcctccaaaaaagaaacaaagaaaacaaatttacaagaaaaaacaaacaccattatccccagtaacaccattaactcttaggaacaaacaccatttaacgctattaaaaagtgggcaaaggaaatgaacagacacttttcaaaagaagacacatggctgggcgtggtggctcatgcctgtaatcccagcactttgggagcctgaggcaggcggatcacctgaggtcgggagttcgagaccagcctgaccaatatggagaaaccccgtctctactaaaaatacaaaattagccaggcatggtgacacatgcctgtaatcccaactacttgggaggctgaggcaggaaaatcacttgaacctgggaggcggaggttgcagtgagccgagatcacgccattgcacttcagcctgggcaacaagagcaaaactccgtctcaaaaataaaaataaaaaataaaagaagacataagtgaagcctacaatctcgtgaaaaaaagctcaacatcactgttcaatagagaaatgcaaatcaaaaccacaacgagataccatctcataccagtcagaatggctattattaaaaagtcaaaaaataacagatgctggcaaggttgtggagaagaaggaacgctttgttagtgggagtgtaaattagttcaaccattttggaagacagtgtggcaattcctcaaagacagaaagaattaccattcaacccaacaatctctttattgagtacatatgcaaaggaatataaataattctattgtaaagacacatgcatgcatatgttcattgcagcacgattcacagtagcaaagacatggaatcaacctaaatacttatcaatgacagactggataaagaaattgtggtacatatataccatggaatactatgcagccatagaaaataatgagatcaagtcctttgcaggaacatgtttggagctagagtctgttacccttagcaaactcatgcaggaacagaaagccaaataccacatgttctcacttataattgggggttaaatgatgagaacacatggatacagggtggggagctacacacatcggggactaccagagggtggagtgtgggagggggaagaagatcaggaaaaataactaatgcatactaggcttaatacccaggtgatgaaataatctatacaacaaaccctcatgacacacttttacctatgttacaaacctgcacatcctgcacatgtacctatgaacttaaaacaaaagttaaaaaataaaaaataaagaaataaaacattagcattaatatggaaggttaggcaagcttgaaagttttttgagttcaaagggacgtcacaagtagagtcacttcaccactgagagagcctgtgaattgttcttacctgtgttttctcagagccagaaaattaatggcaagagactggactatgactctttacacaggagcacagtcatacatttgttttggaattagaccattttacttgtatttaccaagcaaaggacattctatgctgtatcctcaaggtcatttaaaactgaacactacctattccatgactaatctttcttttttgggatgaaagatggaaccattgctagaaggtggtggagtttccttgggtaagcaactgtcaactcctaatgataggatttgagaacctgcctttccaatggaagaagtgaaaatttcactcaggatccactacaagatgacaaagggtagaggtgttataatatctataatatgtttaaaatacttctaagtacatatgcaatatatacaatatatataattctatatatgatattaattgtgcattacttaaaagatttagttcaagctaacttaggttcaaattatatcatacttaagaactatgcacagtctaggcatggtcagctggtgctccaatgagtagactacattcaaggggcagctacttaaattgcctctgtttgttgtatctcgatcaaccacctagactttgctaactaacatattaaatgtcacaaatgaattttatttatgtaatagtagcatgttgactagaataatgactattattaatagactcatgggggaaatgaaaagtgattaagatttatggactggttgaatttagtgtaggagatttgcttacccctgcacaaagaggccaatagactttttcatttaaaatggagctcaatgcttgatctctatatagttatgtgccccactactaatttaagaatatgattcttaaagttgtcctcacattagaagtacttgaaatgcttttagaaactactattgtcaaagacacacctcagcacaattaaatcagaattctttggaaggattccaggtgtcactggtttttaaacttctttggtgattgcaatgtgtaaccaagaaccactaatctgagaggacgtgtggtcttaactatgataaggattgcagattccggcctttgcaatggttttgggtctgtctagagtgaccttttcatgaaaggagatagttggctcacctaatcagactgaaagctggacttcatggaacacacagaatgggttgtataaaccattctttgcctgcttgataatcagtttttgatgtatctgtctacacatgtagtagcatttaagactgaatttaccctgacagagaagttttttgaggaagcaacaacgcttagtcatctccaactttagagcagcatagtctatcaaaaataaactaaggattacacaagaccaaattggcctgttacatatcattggttgctggggagcattatctgttgcccctttaaccatgggctgttttgcataagatagtcaatattttggagtactaaatcctcgacagaaacttaattaccatatttattaagagtagagacattcaataataagtaatttgtctttgatcagcaaagcaaaattgtcctaaatagagaaatatttactttgtagtaacccaccacaaaagagaaagtatgccccttattatctttgtaactaaatttagcacttgaatttagatcttgagcttttatttgaacttagtggtcaaaaatttaatctttgaaattgaaggtaaatttagtaaattctggtttgaacttctacttctttaagtcaagactttcttagtgaaggaattcccccattctccctttctttctatttgccctagaggttttttatggttcagggagatttataaataacctagtacttgggaatatatgtaatttatgcataacttaacaatgaaacaaacaaaaactggttttggctgagatgtataatcttatttgatcttttttgatatctatccactgcctctgtgactcaatgtccatatgcccattattctgtggtgcccagtttattgtggatcaatgtgtcttcattttcctagaattctgagatgtctccaagtctcccatccagttttagccatttctatatctttctgaagggtgtaggccactttaggatgctcccacaactatcacattgaggtacatgcactcacaatttattactataaaattcaggtgacaaaatggccttgtgacttctccaggggtctttcactaactcttctttcagtttgggttccactaaattatttctggattttttatcgtacaacaagctgtaggataggcctgggacatttcatccacaacttaacttccttgattatctttgttcattattttgctttccctaaaacaaatacatgggttctttgtcaggacagggtcagaaaccttttgagttgggtgcagatggcacacaatcaaagtgtgcctctttcaaggctgattttattggaatgctaggctttcacaatctttgcgtgttctatgagctttaaaaaaatctacccagaaactcacttgagttctttattcttaggtgaattagcccttccttgactcaagtaataaccactgacccaatgggtagagggccccagattttgtttttaatgatggaaagaaaaaccttggttattatcaaaatattatcttttgctacacttgtagcaaaaacttgtggctaattgaatggctggacttggaataacataagctattagcttatgtttaaagtactttgttgtgagaaaactgaggctttgacatgttaaattacttgactgagaacccattgctaattaatagcaactctgggaacaaaaacaaaaacacagtatttttgtacttctggaacctcaagaacttagacatgagaaatgaaaagtcactagctcaatatcaatgattcacaaacatggctgtgtgttagaatcaaccacagagctactgaaaaatataatgacgctcccacagaaagtatgcagattcagcagggtaaggtgtggtccatgcctctatatttaacaataatgtccacacataatttctatgctttataaaataaacaaagctgaaaagcatgtgtaatacacatgcaatctacctcaaatgttactatccttggtcgtcttttcatcagctctttgctggtttcctgaacatggatggtagccaagggaggcattagctctgatatatgcacagtttgcggcaatgattttaacactttgtgttcttcaaaatcctctaggatacttgtttttttttttttcaaacctgttaggaggactttcatcaaaaattaaagaacaagtgttggcaaggatgtggagaaaagggaacatccgtacattgtcagtgggaaggcaaattgatgcagcaactatggaagacagtaaggaggttcctcaaacaaaaaaattaaagataggactattatacaatccagcaatcccactcctggatagaaatcaagtgctcaacatcattaataagttattggaaactgtgacctctagaaaactgaggtataattaaataggatacttcttaaaaatgtaattacaatgtgccattttgaagttgcatggagtgccttatagacatttgagaatggataattaacaaatggttgtatactagaatttgatctaaggcttacttttattatgatgtggaagtaaggattgggaccctacttaacctttactcacttcaaaccttttggcttttttcatgtatctaccaagaaaaagttaataggtgagtatgaccaagttaatatggatcataaggcttatttatccagcatttgcctccaatagttgaacttctcttttttggaggctgaaaaccatctatctcctggctttggaccataacctggcagtgagtaggaagtcagtatacttgtctactgggggattttccatgatgacctgtaaaaacatttcccaaaatatttttgagtttgttcctggaagtacaaactgtcttccaaacttgcaaaatgagctgtgatgtttgctcagtggagattttttaaatcactgaattttctgattgataaatgtctgtttggagaacagagaatgtctgccaaccacaatctgcctctcaataattctcagagaacacagacggcaggaaagtttggacctcaaaagctctggaaacccaggggtttctgttgagtttaattactttgcaggtaagacagaggacagatgtataataccacttccagcaacagagtgaacttcagtatcagctcaaaccattacttcttggctccttgtataaatccccttgaatacagagacaggaggccaaaaatctgtgtggtgagtgtacttccagacaaggcaggtgagaacccttaggagaaatgcccctatcaggacaattattagggcagcctcattaccaatgaattgacatcagtgggaggaaaacctgagagaggaggaagaataataatgatataaataaaacggaggaagcactggaaactaaaactgcaaaattaaaggtgatcctggaaggaaactaaggaaatcctatttcagctaagaacaacgatttgctttattctctgctccagatccaaagaagcttaaaaatattagaaaagttagacacataagaagtgacacctacaaagcaccaaaataaacaaaacaataagcctttttaatgaaggaaaacagcttccactttgtgacggggctgatgtctccaatactgagtttattcattgggatagaggcactgattgcagaaagtttctactgaatgtcaaaagcctgtaaggggtaaccctacaagtcgacatcaaccatagaagagacccccaactctttcagagctgagacctcaaattactggaggaggaattgactcaaatcctgaatcacagggaaaataaaggtcttaaatgggaattagcataacttatcatttccagcacacctatctgactaccatttcttcaaaacgtaataggacagtagttctcaaagtgtgatccttggaatagcagcagcaacatcaactggaaacttgttagatacaagcagtttcaggctccatcctagacctacttattcagaaactctgggtagaggcccagaaatctgtatctctgtgtgtacagtgtgtgtgtgtgtgtgtgtgtgtggacatatatatgtcaaaaataaagacccaacactggcatgtttctaatttaaaaattaatttggattttactagtttttttttaactaatgaactgtttttctgttccatcatccaacacaggataccacattacatttggtcttcatgtctccttggtctcctctgaattgtgatagcttcttagactttccttgtttttttaaccttcacacttttgagtcaattattttgtagtctgtccttcaatttttattcttctgatgttttactcatgattatattgtgttataggtgtttgaaatgaataccacagagatgaaattccattctaacgatattatattagtatgtacatgctatcagtatgacttatcactggttatttcaaccttgatcatctaactaaataagtgtttgccaggtatcttcactgtgaatttacttgatttctcactgttatccttttctttggaaccaagtcactaagtccagcccactctcttggggagtgggaagaatttagttccaccacctgggaggtctatgtataaaatatttgaaattcttctggaaggaatatttatcacccacattttatttatttacttactgactcattcaatcaatcattttttatatctgaatagactcaggtatacttattttacactggagattttctatttatctagaaattttttttgagttgacttgggtgtcagaggtatgaggtacatttcaaggtatgttttttgtttttttgaacaatttaatttttgactatatattatatatatttaaggtgtacaatttgatgttttaatatatattatgaaatgatcactatattagggctaattaacatatttatcacttctacatagttaacattttttaatcctttgactaatgtcatcccatttccctcttcccccagctcatagcaaccaccattttactttctgcatctgagtttgactactttagattccaatatacatgatatcatgtagcatttctctttctgtatctttcttatttcacttagtgtaatgtcctccaggttcattcatgttttcataaatggcaggatttttgcttttgttgtctgtgctggtgttatatccagaaaattattgccaagaccaatgtcaatgaagtctttcccaatattttcttctgggggttttatacatcttgttttatgtttaagtctttaatccatattgagttgatttttgcgtatggtgaaacaaatgtctaattttatatttttcccatatggatattcagttttcccaacaccttttgttgaagagactgtctctttccttatggtatattcttggcatcctatagaaggtcaatcgacaaatatgtgggggttctctattctattttgtctatatatctgtttttatgccactatcataatttttattaccatagccttgtaatataatttgaagttaggaagtgtcaggcctccagcttggttcttgctcaagattgccttggctattggggtcttttgttgctccctatgaattttagaattgtttcttttctatttctgtaaataatctccttgggattttatttttagagacaaggtcttgctaattttcccaggctaaactcaaactcctgggctcaagtagctggaattacagatgcacaaatgttttaggctatcattgggattttgatagggattgcattgatttttagatcaccttaggcaatatggatattttgttaatatttctaatgtatgaacatagatatctttctacgatttgtgtctcttgaaacttgcttcagcaatgttgtgtcattttcagtgtacaagtcttccacctctttggtgaattctcaagtagtatttttttgtgggggatttttttttctcaacttccatttaaaaaaaatttttttaagagatggtggtcatgctatgttgcccattctagtcttgaactcctgggctcaagtaatcctcccgcctcggccttccaaaatgctaggactataggcgtgaaccatcacaccaggccctcaatttccattttaaatagtttattatcagtgtatggaaacaccactgatgcttgtattttgatttagtatcctgcaactttattgaatttattaggtctaacaattttttttttttggtggtgtctttagtattttctatgcatctgctcatgtcatctgcaaacagaactaattttactgatttggatttttttttaatttctttttcctgcctaattcctctgcctaggacttctagtatttattatgtttgaagatcagtagtgagagtgagcatttatttcttgttccagattttagcaaaaaaggtttcagtttttccctattgattatgatgctatatgtgggtttttcttatatgacctttactgtttttatgtaagtttcttttatacttattttgttgagaggttctttttttaatgaatgtaaaatttgcctggtgctttgtatgcatctattaagatgttcatgtggttttcattctgttaatatggtgtgtcacattgatttgcttttatttgttaaaccatccctttatcccaggaataaatttcacttgatcattgtgtattatccttttaatgtgctgttgaatttagtttgctaggagttttttagggattttcacatctatgtttatcacggatattggcttgtagttttcttttcttttgttgtatttgcctggcttaggaactaaggtgatgctacattataaaatgagtttcaaagtgctccctctcttatttttggaaaagtttaagaaagagtggtattactttttctttcaatggtaaaatttacttgtgcagtaaatttacttgtgattctgtctccttgctttttactgctctcttcttgttttctatttctccttaattcagtctcattaggcttaatttcattttttttacacatggacattaattattactgcatcatttgctgaaaatgtctatctttctccattggactgccttcgtgcctttgtgaaaatcagttgactgtatttgtttaggtctatttctaagttctctattctatttacctatgtatctattatttaaccaatactacactatcttgattactgtagctttatgctaactcttgaatctggataatgtgagtcatccaactttgttctctcatttttcagattttttttattttagcaccttcatcatgccacattcattttagaataagcttgtcaatatccataaacattcagcttttcaaattctataaacaatatagagtgttgtttgaaataacattgattctgaaactagggaaaattgacatttttacatcagtgaatcttgcaatgcatgaacaagggtatatttctctatgtgtttagaatttctttgatttctttcatcagtgttttgtagttttctacataaaaatcctgaatataatttactagacttatattgaagtacttcattttatcatacaattgtgaatggtataattagatttaatttaaatttcagtgttatttgctgggttatacaaatacaatttattttatattaaccttacatgatttatagtgaccttgcatcaagtgaccttgccaaagtcacttgtcagttcttagagttttgctgtagactctttgggattttgacattcacattatctgaaaataaggacagttttatttctttctttccaatctagatctcatttattttatttttcttgccctattattctaggtagtacttccaataaaatgttgaatagcgagggtcagaaaagaaagttttgccttatatctgatcttagtgtgaaagcattcagtctactctctggggtattgttagctctaggttttacttcattttataattttgtatctcctattaggttaaggaagctcccttatataactcgttcttgaggatttttaccatgaatggatatggcatattgtcaaataattttctgcatctgttgatatgattatacgggttttatatttaatgggctaatatgctgaaataaattaattaatttttgtatgttaaaatgttcttgaatatctgtgatgaaccccacatggtattatcatttcatatgttactggatttaatttgcagatattttattctgattcttgcatctatgttagagatattggtaggtagttggtgcttttaatgtatttttatgcttttggtctcaggatactactggccttgtaaaatgaattgcgaagtattatcttccctcttattttctgaaatagattgtatagaaatggtatagtttattttttaaactgttggtaataatattacagtaaaaccatttgagacttcagtttcctttcttggaaaggttttaactacaattaaaaaaaatagatttagggctattcaagttacctatttattttgagtgatttttgatactttgcgtttttcatgattttggtctatataaaggcatacagttaaatagcatttccttactattactttaatgttagaggaatcagtatttgtcccctttttaagatttctgatattgtttatttatgttttacattattcatttatttatttattttctgtagagataaagtctatgttgtgcaggctggttttgaactcctgagctcaagcgatcctccctccttggcctcccaaagagctgagattacaggcgtgagtcaccacacatggccacctcttttactcttgattaatataggtcaagttttatttttattttcatgttttcaaataattcactttagttattattcatcttttctctattgatttcttctctaatttttgttacctctggttcactttgctttgctttgctagttggctaagatgaaaacttgcaatctgcatttaaacaaacctctaatgtttgcaaacttttagaatggatggattacatgatcaacttcctgtttttctgttatgtggtcccctgaagattgatcaagcccccaaactttatttcacaatgctgttattttagtaatcatggatgacaggacctccttctacttttacacaatgccactttatacacatgccctaaaccaaatatacacaggatattccaataaaatgttaagcttttggtggaggcggagcaaggtggctgaatagaagctttcactgatcgtcctccctgcaggaacaccaaatttaacaactacctacacacaaaaaaaacccttcataaaaaaacaaaaattatgtgtgcaataactgtacctggttttaactttatattgctgaaagatgctgtgaagaaggtaggaaagacagtcttgaattactatcaccagccctcctccatcttctggcaacagcctcatggcatggagagagaacccatgcacttgaggaacggagagcacagtgattgtagggaaattacccatcctaatggtcagaacttgagtttcaggaagcattgccactgcaggataaagcactctgtgaacctaaataaactagaaaagcagtctatgccataagggccacaactactagatagacccggggctgtgctgggcttggggccagtgaacccggggggcatgcgacctagtgagacaccagccagggcagctaagggagtgtttgtgccacccccgccttaaccccatgcaacacagcttgcagctgtaaaagagactccttccctctgcttgagaaaaggataagggagagtaaagaggattttgtctttcaacttggatagcagctcagctacagtaggaatgggcagaagtgtgaggcacccattccaggtcttagctcctgcgtgacatttacagacagatgctgggccagaaggaaaactgctgccttgaaggcaaggactcagttatgaaaggattcatcgcctgccctctaaagggcccttgggccctaaataattagcagcagtaccaaggcagtactccctgtgggcctctgaggagactcagagctgtgctggcttcaggtgtgatccaccacattcctagttgtgatagctacaagaaaagtctccttctgcttgagaaaagcagagagaagattacctgattccaggatgtggtccttggacagcatttctggacctgcctgggccagaagggagcccactgccctgaaggatgaccattcaccacaagctgactgaagaaccttggaccttaagtgaacatcagcagtagcccaccagtacaccctgtgagcctatgctagtagtggcactgaggagagactcctctgcctgtgaaaaggaaagggtgaaagactttgagctgtggtttgagtgccagcttggcagcaatgaaaaagagaaccagatagatttctaaggttagcagtaccaggccctggctccaggacagcatctctggaacacctgtggcccgagggaacttgccaaactaaagggaagggcacaagcctggctggcttaatcacccgcaaattgcagagtgttggggctttcagtgaacataggcagtagcaagatggtggttacagcagagcttgggtgagatgtggcgctttgctggcttcaggtctgacccagtgcagtcctagtggtcatggccataggagttctttttcactgcttccccagctgcaagtatctcggcacagagagagagactccatttgcgagaaagttagggaagagaagaagagtttctgctaggaaatccagataattattccatatcttatccaagattaacaaggcggtacctctatgcatctgaaagagtcacagtgttactgggctaggggtccccctgaatgcaggtacagctgcaatgaccgaacacttagatcacaacacctaagtccgtttaaatacatggaaaggctttccaagaaggataggtaaaaacaagccaagactgcaaagattaaaataaattcctaactcttctatacccagacactgacaaacatctacaagcaccaagattatccaagaaattatgacctcaacaaacaaacttaataaggcaccaggaggcaatcctagagaaacagagatatgtaacatttcagatagagaattcaaaatagttgttttgaggaaactcaaagaaactcaagacaacacagaaaaggaattcaggattctatcagataaatgtaacaaagattaaaataattaaaagaaatcaagtagaaattcaggagctgaaaactgcaattggtatattgaagaatacatcagaatctcttaatagtagaattgaccaagcagaagaaagaattagtaagctttaagacaggctatttgaaaatacagtcagtggagacagaagaagaaaagaaaaaaaaaaaaagaagcacccctatgaggtctagaaaatagcctcaaaagggcaaatctaagagttattggccttaaagagcaggtagagaggaaaatagagtagaatgtttattcaaaatgataatagagaatttcccaaacctagagaaagatatcgatattcaagtacaataaggttacaaaacaccaagctgatttaacccaaagaagacgaccttaaggcacttaataatcaaattgccaaagatcaaggataaggaaataattctaaaagcagcaagagaccaaacctatgactctggcattcctgaaagagacaaagagagagcaagcaagcaacttggaaaacatatataaaattattgtccatgaaaattttcccaagcttcctagagaggtcagtatgcaaattaagaaaattcaaagaacccctgtgagatacaatacaagacgaccatccaaaagacacatagtcattagattacccaaagttaatgcaaaagaagaaattatgaaggaaactagagaaggggcagattacgtacaaaaaaatttccatcaggctagtagcgggcctttcagaagaaacctaacaagccaggagagattggaggcctatattctgcacacttaaatgaaaaacattgtattcaataatttaatatccagccaaactaagctccataagcaacaagaaacaaaatcctttttagacaagataatgataagggaatttgttaccagcagacagccttacaacaggtccttaagggagtgctaaacatggaaattaaagacctgtatccaccaccacaaacaaacaaaaaaaaatttaaagcaactatactacaagcctatataacaaccaactaacaacatgatgacaggatcagatcctcacatatcaatattaaccttgaatgtaaatgggctaaatgccccatgtaagagacacatagtggaaagttgaaaaaatatgcaaaacacaactatatactgtcttcaagagacccatctcatgtgcaaccacacccgtagtctcaaagtaaagggatgaagaaagccctttgaagcaaacagcaaatacacaaaaaaaggagaggttgctatttttattgcagacaaaacagactttaaaccaataatcatcaaaaagagaagcaaaggaattatataatgataaaggtttcaattcaacaagaagacataactatcttaaaaatatatacactcaacagtggagcacccagcttcataaaacattcttggagacaaatgaagagacacaaattattacacaataatagtggaaaacctcacaaccccactaacagtgttagacagatcattgaaacagaaatctggtagtaatcctagcaaaaatattccaaaaactctgggaggggggactcttccctaccttattgtatagggccagcattgttcttacaccaaaacctggcagagacacacataaaagaaaacatcaaatatccctgataaacataaacacaaaattccttaacaaaatactggcaatttgaatccagcaacacatcataaagccaatgcaccatgatcaagtgtgctttattcctaggatgcaagtgtggttcatcgtaggtaaatcaataaatgtgatatatcacataaacaaaactagaaacaaaactacatgatcaactcaatagatgtacaaaaggcttttgataaaatcaaatactccttcatgttaaaaaccctcaccaaactagaagttgaaggaaaatacctcaaaatactagatatatctatgacaaacccacagccaacaccatgctgacgagccaaaaggtgaaaacatttctggtgacaaccaggacaagacaaggaggcccacttttatcactcttcttcaacatagtactggaagtgtcagtcagagcaatcgggaaagagaaacaaataaaagagatacaaatgggaagagaggaagtcaaactatttccctttacaggtgataagattctatacctagacaaccccatagcctctgctcaaaggcccttcaaacatataaatgatttcagtgaagtttcaggatacataatcagttgggcaaaaatcagtagcattttaatacaccaataatgtccaagcagagagccaattcaaaaatgcaattccattcacaatagccacacaccaaaaaaaaaaaaaatgtctaggaatacagctagccagggatgtgaaggatatctacagcaaaaattacaaaacggtgctgaaagaaatcagagaaaacaaaaataaacaaaaagtaatcccatgctcactgacaggaagaatcagtattgttaaaatgaccatactgcccaatgcaatttacagattgaatcctatttgtatcaaactaccagtatcattttccacagaattaggaaaaaaaaattattctaacatttataatgaaccaaaaaggaacctgaacagacaaagcaattataagcaagaagaacaaagccagaagtattatgctacccaatttcaaactatgcaacaaggctacagtaaccaagacagcacgatatttgaagtggtttggctgtgtcctcaaacaaattgcatcttgaattgtagttcccataatccccacatgtcatgggaggaacccagtggaaggtaattgaatcacgcaggcagctaccctcatgctgttctcataatagtgagttctctcaagatctgatggttttataaggggctttctccaccttcactctcgttcttctcattttttttttttttttgagacagagccttggtctgttgcccaggctggagcacagtggtacaatctcggctcactgcaagcttcgcctcccgggttcatgccattctcctacctcagcctcctgagtagctgggattacaggcgctggccaccatgcctggctaattttttgtatttttagtagagacgggatttcacagtgttagccaggatggtctcaatctcctgaccttgtgatccgcccaccttggcctcccaaagtgctgggattacaggtgtgagccaccatgcctggcctcattcttctcatttttgccaccaagtgaagaatgtgcttgcttccccttatgccttgacgataattttcttgaggcctcccacccctgcagaactatgagtcaattaaacctttttcctttataaattacctagtctcaggtatttcttcatagcagcataagaatggactaatacagtacattggtactgggtagtggagcattgttgtaaagatacccaaaaatatggaagcaactttgtaactgggtaacaggcagaggttggaatagtttgaagggctcagaagaagacagaaaaatgtgggaaagtttggaacttccttgttgaatagctgtgaccaaaatgctgttagtgatatagacaatgaagtccaggttgaggtagtctcagagggagacaaggaacttgttgcgaactggagtgaaggcaattcttgctatgtttttgcaaagaaactggcagcattttgcccctgccctagagatctgtggaactttgaacttgagagagatgatatagggtatctggtagaaaaaatttataagcagaaaagcattcaagagaaagcagagcataaacatttggaaaatttgcagcctgacaatgtggtagaaaagaaaaacccattttctgggaagaaattcaagccaaatgcaaaaattggcataagtaacaaggagctgaatgttaatcaccaagacaatgagaaaaatgtctccagggcatgtgagagaccttcacagaagactctcctatcacaggcctagaggcctaggaggaaaaaatggtttcctgggccaggtccagggagccctgctgtgtgcagcctcaggactgtgtctcagctactccagccatggctaaaaggggtcaaagaacaactcaggccagtgcttcagagggtgcaagccccaagccttggcagcttccatgtggtgttggttctgcagatgcacaaaagacaagaattaaagttggggaaccttcacttagattttagagaatgtatggaaattcctgggtgtccaggtgtaagttttctacaacagcagagccctcatggagaacctctgttagggcagtatggaggagaaatgtggggtcagagcctcccatacagtgtccccactggggcactgcctagtagagatgtgagaagatggtcatcattctccagaccccagaatagtagatccactgataccttgcaccatgcacctgtaaaagccacagacactcaacaccagcccatgaaagcagcctgaagtggggctgtaccttgcaaagccacaggggcagagctgcccaaggccatgggagaccacctcttgcatcagtgtgacctggatgtgagacgtgaaatcaaagcagatcattttggaaatttaaggcttaatgactaccctattggattttggacttgcatggggcttgtagccctttgttttggccagtttttcccatctggaatgggtgtacttatccaatgcctgcactcccattatatctagcatgtatctaacttgcttttgattttataggctcataggcagaagggacttgtcttgtctcagatgacactttggacttggacttttgagttaatgctggaatgagttaagattttgggggactgttgaaagggcatgaatgggttttgaaatgtgaggacatgggatttgggaggggccagaggcagaatgatatggtttggctgtgtccacaccacagtgtcctcactagggcactgcctagtagagctgtgagaagatggccactatcctccagaccccagaatggtatatctactgatagctgcattgtattcctggaaaagctgcaagcactcaatgccagcctgtgagagtagccgagggggtgaactttgcaaagccattgtggcagagcttcccaagaccttgggaacacaaacttcacaccagtattccctagatgtgggacttggagtcagtggagattgttttgaagctttaagatttaatgactgccctgttgggtttcagacttgtatgggggcctgtagcccctttcttttagccaatttctcctttttggaaagggaatatttacccaatgtttgcatttccatttatctttgaagtaactacttggttttgattttgcaggccaatagggggaagaggcttacatcgtctcagataagactttggacttttgagttaatgctgaaatgagttaagactttggggattattggaaagggatgattgcattttgaaatgtgagaaagacaagagatttgggaggggcctgggtgaaatgatatggtttggatctgtgcccccacccaaatctcacactgaattgtaatccccaatgttggagttggaaaataatgggaggtcattgaatcatggaggaggattttttaggaatgttttagtatcattgccttggtgtgttctcataatagtcagtgagttctcaggagatttgtttgtttaaaagtgtgtagcacctcccccaccatcttgctcctactccaactatgtgatgtgcatgctcccccttcaccttccaccatgattgtaagcttcctgaggcaaccgagaggccaagaaactgccagcatcgtgcttcctgtacagcattcataactgtgaaccaattaaacctcttttttttaaataaattacccggtctcatgtatgtcttcatagcaatgtgagaatgaactaatataatattccatgttcatcaattgaaagaatcaatattgttaaaacattcatgttacccaaagcaatctatagattccaagtaatccatatcaaaataccaacgacatcttcacagaaatagaaaaaaataatcttaacatttattacaaaactttgtattattacaaaatacccacagtagccatagctatctagagcaaaaagaacaaaactgcaggaatcatgttatctgacttcatatgatacctcagagctatagtaaccaaaacagaatggtagaggcacgcagatcaatgaaacagaatagagaacccagaaataaatcaatacatctccggtgatctcatttttgatgaaggtatcaagaacataaattggagaaaggatagtctctttaataaattgtggtaggaaaactggaaatccacatgcagaagaatgaaactatacccctatctgttgccatatgcacaaatcaaatcaaatggattgaaaatttaaatctaagacctcaaactatgaaactactaagaagaattcattaggaaaattctctaagacattggtctgggcaaagatttattgagtaacaccccaaagcatgggcaactaaaacaaaaatgaacaaataggaccaccttatgttaaaaagcttctgcatagcaaaggaaaaatcaataaagtgaagagacacagagtaggaaaaattatttgcaaacttgccatttgacaagggactaataaccagaacatatagggagctcatacaactctatagaaaaaaatctaataatctaattaataagagggtaaaacatctgaatagacatttctcaaaggaatacatacacatggcaaagaggtttatgaaaaggtatttaacattattgaccatcagacaaatacaaattaagtctacaatgtgatattatctcatctcagttaaaattgtttttttttttaattattttattgttgttgttgttttaagttctggagtacaggtgcaggtttgttacataggtaaacatgtgccatggtggtttgctgcacctaacaacccatcacctaggtattaagcccagcaagcattaactcttttccctaatgttctacatccctgccctcccatgacaggccccagtaagtattgtttccctccctgtgtctatgtgttctcattgttcagctcccactattaagtgagaacatggcagtgtttggtttgctgttcctgtgttagtttgctgaggataatggcttctagcttcatttatgtccctgcaaaggatgtgatctcattcctttttatggctgcatagtactacatggtgtatatataccacattctctttatccaatctatcactgatgggcatttgggttgatttcatgtctttgttattgtgaatagtgctgcaatgaacatacacgtgcatgtatctttataagatcccactattaagtgaggacatggcagtgtttggtttgctgttcctgcgttagtttgctgaggataacggcttctagcttcatttatgtccctgcaaaggacatgatctcattcctttttatggctgcatagtactacatggtgtatatataccacattctctttatccaatctatcactgatgggcatttgggttgatttcacgtctctgttattgtgaatagtgctgcaatgaacatacacatgcgtgtatctttataatagaattatttatattcctttgggtacatacccaggaatggaattgctgggtcaaatggtatttccagttcttaatctttgtggaatcactgcactgtcttccgcaatagttgaactaatttacaatcccaccaatggtgtaaaagtgttcctatttctctgcaacctcgtcagcatctgtttttttcaacttcttaataatggccattctgactggagtgagatggtatctcattgtgcttttgatttacatttctctaatgatcagtgatgttgggctttttttcatgtttgttggctgcatgtatgtcttctttttagaagtgtctgttcatattatttgctcgctttttaattgggtcttttttcttgttatttgtttaatttcattgtagattctggatattagacctttgtcagatggatagattgcaaaaattttctcccattctataggttatctgttcgttctgatgatagttttgtttgtggaaactctttagtttaattagatcccatttgtcaatttttggtttcattgcaattgcttttggcgatttcatcataaaagttttgccaatgcctttgtcctgaatggtattgcctaggggcaaagagatttatgaaaaggtgatcaacattatttatcaacagagaaatacaaattaagtctacaatgtgatattacctcacctcagttaaaatcgttttcaataaaagatagtaacaactgctgaaaagacatggggaaaagagaaccctcacacactgtagtacaaccactagggagaacagtttggaggtacctcagaaaactaaaaatataactaccataagatccagcaatcctttggctaggtatatgcctcaaagttaggaaaccagtatatcaaagatatatctacactcccttgtttattgtaacactaatcacaatagcaaagatttagaatcaacctaagtgcccataagcagataaatgtagaaataaaatgtggtacacatagacaatgcagtaccattcagccttaataagtaaaatgagatcctgtcagttgcaacaacatggatggaactggaggacacaatgttaagtaaaataaaccaggcacagaaagacatacttcacatgttctcactcatttgtgggagttaaaattaaaaaaaaattgtacgcatacagatagagagtagaaggatgattaccagaggctaggaagtgttataaggaggaagtgagggaaacgggaatggttaatgggtacaaaaatgtagttagatagaataaataccatctaatatttgatactcaagagtgtgactacagtcaacagtaatttattgtacatttttaaataacaaaaagaatatgattagaatgtttgtaacacaaagaaatgataaatgcctgatgccaagaccagctcagtcgcagagaccctaacccagcggcactagaggaattaaagacacacacacagaaatatagaggtgtggagtgggaaatcaggggtctcacagccttcagagctgagagccctgaacagagatttactcacatatttattaacagcaagccagtaattagcattgtttctacagatattaaatgaactaaaagtatcccttatgggaaacaaagggatgggccgaattaaaggaataggttgggctagttatctgcagcaggagcatgtccttaaggcacagattcctcatgctattgtttgtgatttaagaacccctttaagcagttttctgccctgggcaggccaggtgttccttgacctcattctggtaaacccacaaccttccagagtgggcatcatggccatcatgaacatgtcacagtgctgcagagattttgtttatggccagtattggggccagtttatggccagattttgggggacttgttcccaacagcctaagttgatggataccccaattaccctgatgtgcgtattacatattgcttgcctgtatcaaaatatttcacatattccataaatatatacacttaccaagtatccataaaagttaaaaatttttttaaaaataaaaatctactgttctggcaatattccttattctcatcaaggtcatcatcatacaaggaagctcaaattcattctgtttgcctcattctccctattttatgttgggtgtttttaaatggagtcaattctcttcctttatatcttcatatcctcaatcctgctgaacttttcctaatgctggccctaattatttctcccttgttctatgtaattacttctttacctctttactgcattcaccttatttaacctcaattctttttcagactactgaatcctccaaactagtttgctaaaataaaaatctaatcttatcactttcttgttaaaactttttagttatccatcatttcctgcaaaggactggaatttctagctggcagaattgtatatttatgaggagtctctcacttcagctcttactacttgcttcctttgtcatcctaggatctagctgctactgagctatctaaatttctatatattttcatctccatattttgcacatgttatttctcagcggattaccattccccagctcctgcatgagtgaaaccttaattcccctcctgacccagttcaataatcctcttttctattatatttattttctactgcctccaatcttcagacacagttgattcctctttcttctaagccagatgtgtacccagaacacattgttatgagtggaagtatctgtatgggtctgtagtaacttcagtccttgcctcctcagaagaaataagttgactgaggggcataaagcagaaaaagagaccaaggcaagttgcagagcaggagtggaagtttatttaaaaaggctttagaacagaaaagataagaaaattcgcttgaaagagacccaagtgggtgttatgtaggtccaagagaaaaaagagagcaaaagaagacagcaaaaaagaaggagcctttaaccttgatactgggactttatagactcacctttttccaacatgagtcttcccttaggttcggctttctgcatgcccacagctttccttaccctttggaagtgagcatgagccgtgtgtttagggagttatatgcctgcccgcccgagccttcctttttccagtggcatgtaactgatggcatccactttgctgtttttgtctcttaacatgcatgcccaagaagttgcttcttcctgaggcctgcattcaattaacattttgatgttaacaggtgtggactatcaggaagtagcctctccctggcactgctgaattatcattttttagaggcagtgtgataattgctgaaacatcaccagacatttgtagtgggtgaggggagagccctctcctgcttccctcatgcctaactacctgtaacaacatcattctattttaatgattgttttacctgttactctaactacactctgaaaactttgagtggaagtatggtatcacatgttattaccaacacaaaacatgccacttggcatacagcaaatggttaatcaatggttgcttaacaaatggagaaactgaacatatgttgtttctgtttcagtggaaatattgagtgaggtagaagatgggatatgacttttatgtgctgctatgggctaaattgtgttcccccaaaatttctacattggggttttaacctccagtagttcagaatgtgactgtaattggatatggggccatacagaggtgattaagttaaaatgaggccattaggggcaccaatctaatttggctggtgtccttagaagaaaaagaattgtaggccaggcatggtggctcaagcctgtaatcccagcactttgggaggtcaagacgggtggatcaggaggttaggagattgagaccctcctggctaacacggtgaaaccccgtctctactaaaaatacaaaaaaattagccaggcatggtggtgggtgcctgtagtcccagctacttgggaggctgaggcagaagaatggtgtgaacctgggaggcggagcctgcagtgagccgagatcgagccactgcactccagcctgggtgacagagcgagaccctgtctcaaaaaaaaaaaaaaaaaaaaaattgtagacatccagagaggcacatggacacagagaaaaccatgtaaggacacacagatcaccctctgcccctctgcaagccaagaagcgtggtctcagaagaaactaagcctgccaacaatttgatcttgggtttctggattctagattggcaagaaataaatttctgttgtttaagctacctaatctgtggtattttgacacccttagtaaacgaatgcatatgtgcatatgatagtagtaagatttatacagttttatcccttattgtgttagcttcctatggctgttgtaacaagttaccacagactttatggtttaatacaatagatatttgttcactcacagttctggagggcaaaagcccaaaatcagtattcctggtcccaaatcaaggtgcttacagggccatgacctctccaaaggctgtagaggagaaactggtttttgtttcttttagcttcttgtggccgtcagaattccttggtcttgtttatctaatctctgactctggggtcacattgtctagtcttctgcttgtaaaatttccctcaacttctctcttatgagtacatttgtgatttcatctaggggctacttggataaacgaggatattctcccaatctcaaggttctaaatttaattatatctgcaaggcctattttgccatatatggtaacagtttcaagggatttaatcataatatcttctttgagcattattcagccaaacacacctgttttatttatccttttctttctcactctcattattttattctttctttcccttctctttatactttttcttcctctgtctcttctctctcttcctttctttttgagcttccttcccaatttctttttctctctccctctctcccttcttctgaaaatggtaaggtataagaggctgaaaggggctaaattatttttccaatttttttcataaggtaatggcagaacaatgacaaagaaacctctcaagccaggtctcttttcactatattacataagtgctctctagattcatgtaaaatcaaagagagccaagctgtcatcatgacattgaatgaagctcctcattactatctatgcactgctctgcaattactacatcttaaaaaattagtggcacttcatattctattctatctcaggcatagaaaatgcttggctgtgatggtcattaaaaggacagacatgagtaataggaaacaggtttcgttaatatgtgtgtcaaaaattacaatatgcatggattgtcaacacaataagtgtttctcaaaattggccactcttaatttcagttactaacttggtctttgtcatccttcagctggattctcacagcaccaaaatcaaaatgaaaatacttttaaaaatctgtcagttcattttgttttgctatacaatgccataaatgtgcaagttttacccctgattaatcagttatcttgatgtaatgtaaacatattcatagttataatcttattttttatattgacaagtcaatatttcaggaagcagaacacttcactaccttgagggctttgacagcctctctgtatcctagaaacaagttacttagcctcagtcctacccagtaatattaatactaataatagatactctgtagtatttcacaggggattatgagggcaaattaaatgtcattcaatgtatttagcatatcactctaccatgaatacttgttaaagaaagagaaagccggggtctagttccgagaactagtacaaagcctgtatttcttttattttttatttatttattttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtcaatgtgatctcattgttcagttcccacctatgagtgagaatatgtggtgtttggttttttgatcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtaattctagttctagatccctgaggagtcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcactgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagcttcctacatatggctagccagttttcccagaaccatttattaaatagggaatcctttccccattgcttgtttttctcaggtttgtcaaagatcagatagttgtaggtatgtggcattatttctgagggctctgttctgttccattgatctatatctctgttttggtaccagtaccatgctgttttggttactgtagccttgtagtatagtttgaagtcaggtagtgtgattcctccagctttgttcttttggcttaggattgacttggcaatgcgggctcttttttggttccatatgaactttaaagtagttttttccaattctgtgaagaaagtcattggtagcttgatggggatggcattgaatccgtaaattaccttgggcagtatggccattttcatgatattgattcttcctacccatgagcatggaatgttcttccatttgtttgtatcctcttttatttccttgagcagtggtttgtagttctccttgaagaggtgcttcacatcccttgtaacttggattcctaggtattttattctctttgaagcaattgtgaatgggagttcactcatgatttggctctctgtttgtctgtcgttggtgtataagaatgcttgtgatttttgtacattgattttgtatcctgagactttgctgaagttgcttatcagcttaaggagattttgggctgagatgatggggttttctagatatacaatcatgtcgtctgcaaacagggacaatttgacttcctcttttcctaagtgaataccctttatttccttctcctgtctaattgccctggccagaacttccaacactatgttgaataggagtggtgagagaaggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgtatttcttttattttttaagtgaagtgaaacggtaacctgtgctaacaggaagcaatgtgagcaattgaccaacttgattttccctaatgcatattcttacttttaattgaaattattgaggcctgactttgttcagcaatactgaataataacatctgaaggtcgactcaaattttgctgtattgttgatttttttatgtttatattttttatataaaatatattttatatttatatttttctatttacttgcttgtatatgcctgatttattagaaattgtgcttagaaaacctgttgtaactttttttacctttaataattattttcacttcacgcaatttaatttaaatgattggaaggagaaatcctgcaggcaggtagaataatttgaaggccacttgcttattatgcatgttaagttcttatgagtgataatcaagaaagtgataaattataagcaaaaacataatgctgacctttaaaattctgacccacaattatctattagctttttattggccttgtaacacatgagaaataaactgaatattttctaagtactagaactttagatggaatgcttaggacataaaattatatctaacaacaataactggcaaattccctgcagtctttctcccattttgtaggaagtgctgaaactatcaccaacaactaaaggaaggagcaaaaggtataataagaaaaatgggtagttaaagataattcaccaatgtaatctgcttttgaaattgtttctatgatttgcaataatcagagagcccagcgaagttaagtcttgatcttggaaaagataaaattactcaagcaatttaaactacgggaaggttgaatgagactttggtaagggagtggagctaaccagcttataatgttttgctgagttttgtggggtccaacaggaagttatcctgtggggaactaatgtgctgtaactctgtgtatctgattgggtttgtattaatcaaattacccttgggcatgcactggggtttcctccactgaacatatctagagattgttaaaaccctataatcaaagcttttctagtgggcagccaggttcacattaggaagcagaactgtaattccacacagaaactagtagaaatccatttctccatttctctttgactcagaaacctatcatattaaatcaactttaagttaatcacttctcctccctcatagtctaagaacttctgaaaatgttatcttgtaaatatatggttatattgagttatttaatgcttcattgcaaatgactttttggtttcctataatgttaagcaatcaaatttatattaactcactaaactaaatcactgcttgctttttattttcttttttggggggaggggcttttatctaatccatcagtttcaaatactaaagtgtttgaaaccattaagcccaagagccatgaatttagattgctttgttgcaaatcctgtttctaccatttactagaaaggtgctttcaggccacattgttaaactttctcagttttcttatttgctaaattgggaaagtggtatttgtaacccttattgagagagttataaaaattgtattatgtattgtgtcaagcttctggaataattttttaaatgttagctattataattattcagtttataaaaactatttcttttctctctgtgacttgattcttaccataaaatataaaatatccatatcctgacactagtgtcctatagagattacctttataccaattgcctctcctgcgtctttgaaacctatcttgtgaatttccttatctggtgtgaaaattcactgaaaaacacaggatataagttggacttgactttgtaaagtcaagtttcccatttccacttagaagtaattgttttgctcagattagtagtgtatttagcatatcactctaccatgaatacttgttaaaagaaagagaaagccagggtcagtattggaggtcctcttttcattttattattttatgtgtttttattttgattttctgttctgtgctgagcactgtattagaatactgtacttaatcctccaactaaaacaaaataaaacaacaacaaaaatctatttttttttcttaaagatcttagggactatactagaaacccatattgaaaacatatgggcacaaagaggacatcactgaccgcagtatccaggtgaaaagtgggcagtggtgcagccaggcctcaaagacagcagaaacagtggcacgctctttgccaggctctgtttctctgtggtgatctttttttctaactttcattttaggttcaggtgcacatgtggagatttgttatataggtaaattgcctgtcatggggatttggtgacagattatcttattacccaggtaataagcatggtacctcataggtagtaattcagtcctattcttcctcccaccctccaccctcaggtaggccccagtgtctgttgttttcttctttgtgtccatgtgtattcagtgttcagctctcactcataagtgagaatatgctgtatttagttttctgttgctgcgatagtttgcttaggataacggcctccagctccatccatgttgttgtgatggtctttattatcttctgtaagctagtttcttttacatgctcttcatcttggccctggcagttcttgtcctcacagattcaccaacagagatgggctaaaaaaaagcccaagtcccagagaataactctgacaccctggcatagagtccatatctgtctttgtgtcttggaaggtggacaactgtgattgtcagtctctattaaaatccctcagttgcagtgaagaaggagatggtttactagaagattagaggtgatgcttctaaacaatgggggagggggaggtagttgctgtggagattaaacaatacacatggaggtatggaggtagctttggtgtccatctgactgaacttacattatgaattcccaattttcagtccttctgcccatggagaagtaatgtgctactcgctttttgtttgtttgtttgtttatttttgagacagggtctcactctattcactctaattgcaattgcccaggctgaagtacagtggcatgattttggctcactgcagccttgacctttcctgggctcaagtgattcttccacctcagcctccagagcagctgggactacaggcacaagccaccatgcccagctaattttttgtatttttagtagagacagggttttgccatgttgcccaggctgggatgtgctactcctatgccttggtctccttacatgaaaaattgaaatacacaggatcgagtgcctcaagcacagtacctatcatgtattaatggcactgtaagtaagacttcttattttaattatcatgtcctttgtgttggctaagtgatctcaatatctctattaaagaaagctaatataacttttttattttgaaaacagagggctggatcaaatttctttgacgggggcaggtctttgaaatctactaactttatgacaggagctgaaaaatagtcatgatagtcgttattatcaaagttgtttgtagcgtgggagatagtcagtcttgttttccaagaggtaagttaccttccaagggaaaggggcatttctgggtttctgttggaaggtgtagccatatagacagtttgttgaattcagattggcaaaatcttgtggatttctcaagcctttaccccagacccttacaccaatgatagggtagggtctgaggactttagagagctcttggccattttcatgctgaactttcctgatgagtctcttgggaagctgtttaggtaaaggtttcagagaacataaggcttctccagagaagttctctgagcttgttggaagtgaggtggcagtggcctgagaaggagacagcaggattttactactgcacacatccaatgtaagataatattttaaaacccatatttctcaaatgattaaatacttaagttgctcacaaatgtctgctgagaagagctttagatatttctaggcttgaaaagaccatcaggttcatttgtgttgggcacaattcatcctaggtgatcacacacagcttttctaatgattagaatactcagaagcatgggatgctgttaatgagggcagtgtgcctttaacataggcataatttaaagtgaaagggtgtttcctttttcaattgcaaaagactgaactatggcttatactctgaacgttaataagtattctgtgagataaaaatatatttgaaagtgaatttccccattttccatgcctatgtatagttgaggcaaaaaaggtgtggatagattttaatattatcaaattggtcatttttcaagatgggttttaaccagatattgttccgcttcaaggcaaaattttaaaacaactttgtttacagttaaatatgtagttttatatttggatataataacttttctttaaagaccagtcccctgtaaaccagtccttggttaaaattactgcttggatcctgcaggattttcttcctcctatctttcttccaatacaattgaatattgattacgatgttttccatgtatgtatctattcaagtcaattttgttaacctattccctataggaaggataaaaacattttatagaatgttgcatgcagcattcattctaatttccttcatgtgattgattgcaaatattcctttgcttatataacatgtttcatgataaagtgaaatgtgaacacttacagatagatcactttccaaaagctactatgagcaactatatgccaataaattgaaaaatctagaataaatgggcaaattcctagatacataaaatgtaccaatatcaaacgaataagaaatctaagacctgaaaagaccaataacaagtaacaagatagaagctgtaataaaaagtctcccagtaaagaaaaggccaggatgtgaggacttcactgctgaattctaccaaacatttaaagaagaactaacaaaaaacctactcaaactattctgaaaaatagaggaggaaaaaatacttccaatctccttctacaaggtcaatattatcctgataccaaaaccagacaaagacaaatgaatacaagaaaattaaaaaaaatatctctgatgaatattgatgcaaaaatcttcaacagaatactagcatatctgattcaacaatgctttagaaagatcatcaatcatgacgaagtggaatttatccctgggatgcaaggatggttcaatatatgcaaatatatcagtgtgatacatgatatcaacagaatgaaggataaaaaccatatgatcatttcaattcatgctggaaaagcatttgataaaattcaacatccgtcatgatacaaatcctaaaaaaactgaggatacaagaaatatacctcaacataataagagccatatatgacagacacacagctagtatcatactgaatggggaaaaattgaaagcctttcctctaagatctggaacacagtaagaatttccactgtcaccagttattcaacatagtactggaagtcgtagctacagcaattagacaagagaaaaaataaagggcatacaaattggaaaggaagaaatcaaattttatttgtttacagatgatatgatcttatatttggaaaaacctaaagactccatgagaaaactattggaacttataaacaaattcattaaagttctaagctagaaaatcgtcatacaagaattagtagtatttctatatgccaacagtgaacaatctgaaagagaaaagtaatcacggctgggcacagtggctcaagcctgtaatcccagaactttgggaggccaagtcaggtggatcatgaggtcaggagattgggaccatcctggccaacatggtgaaaccccatctctattaaaataaaaaaaaaaattagccaggcttggtggtgcatgcctgtactcccagctcctcaggaggctgaggtgggggaatcactcgaacccaggaggcgaacattgcagtaagctgagattccaccactgcactccagcctggcgacagagcgagactcaatctcagaaaaataaaaagtaatcacatttctaatagccacacattaaattaaatacctaggaattaacataacaaatgaagtgaatgacctgtagaatggatactataaatcactgatgaaagaaattgaagaggacacaaaaaatggaaagatattccatgttcacagataggaagaatcaatattgttagaatgtccatactacccaaagcaatctacagattcagtacaatccctctcaaaataccaatgatatttgtcacagaaataggaaagacaatcctaaaatttatatggaaccacaaatgaccaaagcaatcctgtagccaaagcaatcctgagcaaaaaaacaaaactggaggaatcacattacctaacttcaaattatactacagagctacagtcatcaaaacagcatggtactggcataaaaacagacacattgaccaatggaacagaatagagaagccagaaacaaatccacacatctacaataaactcatttttgacaaaggtccaagaatatcaactggggaaaacacattctcttcaataaatgttgctgggaaaactggatatttatatgcagaagaatgaaaatggatccctgtctttcaaaagtgtgaaatcaaaatagattaaagactcaaatgtaagacctcacattatgaaactactataagaatacgttaggaaaaatctccagaacattggtctaggcaaaaatttcttgagcaataccccataatcacaggcaaccaaagcaaaaatggacaaatgggatcacatcaagttaaaaagcttctgaacagcaaaagatacaatccacaaactgaaaagacaacgcacagaatggaataaaaatattggcaaactacccatttgccaagggattaataaccagaatatataaggagctcaaataacattatagagaaaaaagtaataatctgatctaaagatgggcaaaagatttgaatagacatttctctaaagaaaacatacagaaggcaaacaggatacgaaaaggtgctcaacatcactgatcatcagagaaatgcaaagcaaaactacattgagatataatctcaccccagttaaaatggattatatccaaaagacagggaataacaaatgctgatgaggatgtaaagaaaggggagcccttgtatactgttgctggaaatgttaattggtagaaccactacagagaacagtttgaagtttccccaaaaaaactaaaaattgagctatcatatgatccagcaatcccactgctgggtatatacccaaaagaaaggaagtcaggacatcgaagagacacctgcacttctacgtttgttttagcactgtttagaatagctaagatttggaagcaacctaagtgtccatcaacagatgaatgaataaagaaaatatggtacatatacacgatggagtactattcagccataaaatagaatgagatccagtcatctgcaacaacatggatggaaatggagatcattatattaagtgaaataaggtcagcagagaaagacaaacatcacatgttctcacttatttgtgggatctaaaaatcaaaacaattgaacatatgaacatagagaatagaaggatggttaccaaaggctgggcagggtagtaggggcctgggattgggaagaagtagggatagttaatgggtacaaaaaaaaatagaaagaatgaataagacctactatttgatagcacagcagggtgactatagtcggtaataactgtacattttaaaataacttacatggtgtaactgaattgtttgcaacttaaagaacaaatgttaatgtaccccattcttcatgatatgcttatttcacattgcatgcctgtttcaaaacatcttttgtaccccataaatatatacacctattatgtgctcacaaaaaaatttaaaaaaaagataattgcttgttcataagaagcaaatgatgaaccataagtcatcaagacagccctgcaaatacctaccaaaaaatagaaccagcaaataaggctgtctcttccttctctcataaggaaatttaatactctattcttgggaaataaaattgtatcttggccaattgattgcagtagcatatgtttttactcaggtgatcaagcctttttcttaaagagtgtataaatgtagtatatcaatattatcataagcaaacttattctttcttgatattttttttttcttgggaactttctgttccttcatggcaagagcactttgaaagttttccttaaccctcagccatggcttctcattctccagagtgacccagatcatctacttgtttaacacatattaaggaccaggcactgggcagccttgtctttcaagatggtcagcatagagaagagaacatgtggaataaaatctgtcattgtagtgctatgtaatgagcctaagacagaggatctccagactcagccagaggactgtgaagatgcttatgaggaaggggagcatcaagcaagctggttcttaaaggaagagaaaggattagccagaaaagtcagcataaaggcagaggaggaaaataatttccagcaggtggagaagcatcgacaaagacatggacatttgagggactttagcacagtgaaatattcaaacatagactagcgggtctgaagcaagtagtatgtgcatgtgtgtgagtgtttgtgtgtgcacatgtgtgcccatgcagcagtggtggtggtgatgatgcagtggaagtctgtagctttacagattgcttggctcaatacagtgttcaaatattttctgggcatagggagcaatctcactgcaaacgaggcacatgaaaacatttctgttctcccatgaatatgggcatcacaatagaaaaaaaagagataagtatgtgattgtctttatatgggtaaaaatccagagaaagagggaagaagttaagaactgaggtagaggggcagtttctaagcccttcttatgctggatctttgcagtgtgcttccttattattatcattatggtaatcattattttgggacacgctgcatgtttacactgctcttaatgtcaatttcaacattcagtcaaaaatccagaaataggcagaccagaaattttaaatatattgcattccccaaatcccattcctagctaataactcactagaaatgggatttgaggaatgctatatatttaaaatttcaggtctgcctatttgcgtttgcccatagaagtagtgttataaaaggcagaaaaagtgccaggaacatgtctcaagtgcatttggcccgtggtctgtttgagaaacagtgattctgtatccctacagccatgtaggtcttgattataactaagcctatctcaccaccggcatggaccacaggcacatccaagtcaacatacatacaaccaagtcctcatcttccatcatacacctgactgcagattgctcaacccctctgcccctgtcctaattaacagaatccctattcattcagacacctagttgggaacacttacggtcattactccctcctagtccatgttccatgagtcaacaaatccactagattctatctgaacatcactttaatccattacttcctcatttcctctcgctgccctaacccaggccctcatctttctccccgaatgaggacttcagtagccagactttcttatgttaagctcagagtaaccttactaagatgtactcagttcatgtctgaaatcattccagtggctcaatattgcctttcaggtggggttcaatcttattaataccacacacaaggcatctctgtgcacattgacttgtgcctttcattccagtcccaagcaacagttgactgccttctagaggcactgactacaccctaccttctctacatttttgtacatttctctcaatttacctctcattatctccttgtcatcattcagaaatcagactagacaccacatctgaaaggattctttgtccatttaaccattattaatcaccaatatattaaacatattatgcttgacctgaagatataatgataaataagaaaacagtacctgacctcaattttgcttggctataactgattaaatagacaattgaatacaggtaattagattggggaaggagactgtactggagcacttggcagtacttaatccaaaatgaacagaaagcttctcacagaaagtgacgtctgcttcaagacctgaagaataaataggattgtccagatgaagagaaagaaagggagaggaaaagtagtgctctagatagaggtaacagcctatgtcaaggtgtaaagttagatacagcaacataatttgcaggaccagtgcaaaatgaaaatattggttcccttattcaaaaaagcaggaaaaaatatgttcttaataatattaagttataaaagcttttcctttccccagatgtttctctctcaacttgtcatggtggtttttgtgtagagcctcataggtgcccagaggcctggcaagatattagaagcaaatgtggcccattgggtggaggtcccctctcccacaagcagccaaaccgaagaaactttgtttgtttgggggctgtgtctgagaaaaggtttcagttcctgacacatgttccattgtgctatggagtttcacttacaaagcacaaactcaaagataaaattattaagaatttcaagatgacttctggaatgatggcacaaacagctttatagatcctattccaggtgaaacaactatagcatctctggatattgctggatattgttttaagggcatgtattcaagtaaaaattatgtcttcaagaaaaactaccaaatcttattaagtaaagtggaagtctatggcatttgagtcacaatgtcctccctacttcccatttttagctcaatgtggtggaaactccactatggtaggttgcagacaagaacatagggttctctctctcaccaggttcctattgagggctatgatatctccctgaagaagtgcaggccaccagcatttctcaaccccctcagctcaaagttgcagaggttttattccaggaaagagaaggctaagatgtcgaggctcccttttttcacccagatcccactcctagggaataactttattccagacctggcaggtcaagaatagtggggcttaaatcaccaacactccagatcacttattgggttgagtttctatgctggaaggagtaaaccaaacagaccagagatgggtgcctgagcccagtaccctgtaatgaagcacaagtgtcactctgagacaaatggaccatattccctgcccgggttctacattagtagtgggttttctcagggaaagaagcaggcaataagaacagaggtcagaagctctccctagaataagtgacttcatttgcaacagaatgtgcttaggttaaggctaaaggcactacaaaaagaaaaaaaaagatagtggtggtaataaattactaagaagcagcttgctcaatgagagcagcaacctacactctaaaccagttagaaatataccagagaaatataggaaaggagatagctaagaataaccctcctggagttagaacaaacctcaaagattacctctacaaaaggaacacaatttaatgggatcagatggtggtgcaatctatgcctcagggtgctattgataacaatagcaagattaagtagcaatttgtgaagggtaacagctgcatgataatcaaactgaagcagatagcttagcaaagagatctgggaaaaaaataaagagagctctgctgaaatcactgtcatcttagggtaaatgtgtatattcctagggttgtaccctctgaagagcggcatcacaggatgtaacctgttgaaggcatgagaaaaacttcactaaaatagtctagctatttcactaaagttaccaaagaaataagcaaaaaacaacaagccttagagaggtgaccagtatccaggattgttatgatatgttacctaaaatgtttactacccaagaaaataaacaagaaaatgtgatgcatacatttaaaaaaaagtgtctaaaattttagtgaatggtaaaagaatgaattcctttccccctgtgatcaggaactaaataaaaatattcactctcaccacttctatgtaacattttattgcctctaactagggcagctaggcaaaaaaatgaagtaaaggcattcaaattggaaagaaagtagtaaaactatatctatttgctgttgatatgatcttgtgtatagaaacatctaaggaacccactacaaatctattataattaataacttatttcagtcattttcaggatataagatcaatatgcacaaatctattttatttctatacactaacaatgaaacttctgaaaattaaaatgagaaaacaatttaatttattatagcaagaaagaccaaatatttacaaatcatatacctggtatggttcttgtatccaaaatatattttacaacttcttacaagttaacaataaaaaacaaataacccaattagataaacaaaaggacttgccttttgttatccattagagcagccatttgagaatactgagaagtcattgacatgacttaaggattgccttggctatagatagcatcaaaagtggaagtagtgagatcattcagagggctattacagaaaaccaaggggagaatgaagtagtttggagtaaaggtgacagctgtggaggtgctgaaaagtagtcacattgagattttatttatttgtttatttttatttatataaattaatggggtacacgtgaaattttcttacatgtatataattcatagtgataaaatcggggtatttagggtgtccatcactcaagtactatacatttttcttaactatagtcaacctactctgctatcaaacattgaatttattccttctatctaactgtatgtttgtatactttaacccactacgcttcaccttcccccttgctctccattcacccttcctagtctctgtcatctatgaagatatatttaaatgtaaaactgaatactgatgaacatttaagatggatatttttctggtaaatttcttaatattagtcattcatataactactatttgtttgtgtttgtatgtgtatttataagaactattctataatcttatgttgccagactttgttaggtaagaatagggcactacttgtacagactaattgataaggccccagaatgctggatgaactatttcagagaaagagaaattatccctaaaataagaacttgtgtctttgtaatagaattgaggattacctaggcaactggcttaacagtagtgactaagaagatagaattctggaagcaaaactgggcttttctccttactgctatgtaaccttggctaagttaattaatatttccaaatctaaaagcatattctataaaatggatataataaaaactttgtaaactttctgagaaaattatatgtgtttgtatattttaaaagcctggtacagaatagaaagcccatagatgataagaacgtaagtcattctaatacactaatagataaaggatatttggattgtcaatcattctctatttgtacaggcaaatgtgtacatattgtaacataatgaagcaattcattttttagaatcctattaaattatgtcattaaatacaatagaataataataattagtacttcacctcattgccttaatacattttaaatgtattgtttaatatcctgaatattgagagagagaaacagaaattatttggaagcacaattatattcctgcattacatgaaagaactccagagatttatctatacaaaacagataaaaactatacactagtatttcagaaacattaaaaacacattaaaactttttaaattagttcaagtatttttagtttagtttttccatattaaaattatatagaagaggtcacaggacatgtttccatttaactgtgtcttcttcaatgtctttcttttttaaaaagcagtaagtaaaattttattgtactaatttatttatttttcactttttaaaaattttactttaagttccgggatacatgtgcagaacgtgcaggtttgttccataggtatacatgtgccatggtggtttgctgcacctattgacctgtcctctatgttccttcccctcatccaccaccccccaaaaggccctggtgtgtgttgtttcccatcctgtgtctgtgctttctcattgttcaactcccacttatgagtgagaacatgcagtgtttggttttctgttcctgtgttagtttgctgaggatgatggcttccagcttcatccacgtctctgcaaagaacatgatctcattcctttttacagctgcatagtattccatgatgtatatgtaccacattttctttatcaagcctatctatcattgatgggcatttaggttcgttccatgactttgctattgtaaatagtgctgcaataaacatacatgtgcatgtgtctttacagtagaatgatttatattcctttgggtatatacccagtaatgggattgctgggtcaaatggtatttctggttctagatccttgaagaatagccatactgccttccacaatggttgaactaatttacattcccaccaacagtataaaagcattcctatatctccacagccttaccagcacctgttgtttcttgactttttaataatcgccattctgactagagtgagatggtatctcattgtggttttgatttgcatttctctaattatcagtgatgttgagcttttttttcatatgtttgttagctgcataaatgtcttctcttttttttttgagacagagtcttgctctgttgccaggctggagtgcagtggtgtgatctcagctcactgtaacctccgcctccccgattcaaacgattttcctgcctcagcctcctgagtagctgggactacaggcatgtgccaccacgcccagctaatttttgtatttttaatagagatgggatttcaccatgctagccaagatggtctccatctcctgaccttgtgatctgcccaccttggcctaccaaagtgctgtgattacaggcgtgagccacagcacctggccataaatgtcttcttttgagaagtgtcttttaatatcctttgctcactttttgatggagttgtcttttcttgtaaatttgtttaagttccttgtaaattctggatattagacctttgtcagatgggtagattgcaaaaactttctcccattctgtaggtggcctgttcactctgttgctagtttcttttcctgtgcagaagctctttagtttaattagatcccatttgtcaattttggcttttgttgcaattgcttttggtgttttcatcatgaagtctttgcccatgcctatgtcctgaatggtatcgcctaggttttcttctagaatttttatggttttgggttttacatttaagtctttaatccatcttgaggaagggatccagtttcagtttcctgcatatggctagccagtgttcccagcaccatatactgaatagaaaaccctttccccattgcttgtttttgtcaggtttgtcgtaggtcagatgattgtagatgtgtggtgttatttctgaggtctctgttctgttccatcaatctgtatgtctgttttggtaccagtaccatgctgttttggttactgtagccttgtaccatagtttgaagtcaggtagcatgatgcctccagctttgttctttttgcttaggattgtcttggctatacagtgtcttctttgtttccatataaaatttaaaatagtttttttctaattctgtaaagaatgtcaatggtagtttaatgggaatggcattgaatctgtaaattactttgggcagtatggccattttcactaaatttattcttcctgtgcatgagaatggaatgtttcttcatttgtgtcctctcttatttccttgagcagtggtttgcaattctcctttagtctttctttagtcttttgtttttatttatttatttatttatttatttttgagacaggatctttttctgttgctcaggctggagtgccgtggcatgatcatagctcactgcagcctcaaccttccagttttaagatttcctcccacttcagcctccctagtagccaggattgcaggcatgtgccaccgtacctagctatttattttttaatttttttgtagagatgaagtcttgctatgtttaccagtctcttcttcaatttctttcttcagtattttatagatttcagtgaatacatcttttagtttcttatttaaatttattcctaagtattttattcttcttgatgctatcataaatggggttgccattataacctagcaatccttctgccctattaaaaacgtctaccatatgatccagcaacccactactgagtaaatatccaaagaaaattaaatcactatgttgaagagaggtatgtacccccatgctcattgtagcactattcacactaacaaaggtatggaatcaacctatattttcatctatggctaaatgaataaggaaaatgtggtatatacacaatggaatgctagtcagccttaaaagaaaagaaaattctgtcatttgtgatgacattggtaaacctggaagccattaaattaagtggaataaaccagacacagaaagacacataccacatcatgtcatttacatgtggaatctaaaaaatgggaaataataaacacagagagtttaatgatggttactaggggtaggtcagggggaagaaattgggagatgtgggtcaaagggtagaaatttgcagttgtgggatgaataagtctagagatagaatgtacagcaagaggactatagttaataatattgtattgcatataataaaatggacaaacaaagagaagaaacaaaaaactatcaatatcaggaataaaacaagatatattactaaagtctctgcaggcatctaaaagataataagggaatatatgaatgactgtacacacataattttgataactcacatgaaattgactaattccttattatggatttgtttcctggagatcatttgatcttgtaggatggtgaggacatatcttaggaggatatctgcataaaaattgatattaacgtgagtgctaatcctcatttccttaaatcagcttactaaaaactatttccgatatctacatcctctgttattttcttttcaagtgactttacagtcatttaagaaagctatatatagatgtagatatagatatttaattttaaataaaaatacacgtttaagatatcatagccttaaatggaaagaaagaagaaagaaaaagaaaaaaaggaagaaaggaaggaaggaaagaaggaagaaaggaaggcacaacaacttagtaataatgtatacttgaacaataaaatgcaacatatagactcagaaagcagagaaaggcactctacaaagaataataggctcacctgactggcattatttagcagtcttctgtgatttgcattgtcagcagactctatggtaccatggcaaaaacagacctctatattattcctttatttatttatctgattggttggttggtataaaaagctcatactcaattttttattttcacttttatattgtctttctgatcttgcccagattggtatccgagtcttcttttccattttgacaaaatgttaacaccatctattttcaacaaataccacaaatctaagatttctctgaaaacacttaataaaactgtcactattccgattcctctattttaattttcctttccttttcttacattctcatcttcctaaataatatttgccttatttacaaactataccagtggtactgatttttattgataatttaacattgttgcctgttgttttttataccttctaagaagtcatctataaatcatttactaaggaagactatagcttacaataaaataatcaaatatttccatcatttaaagtcccattttcctactttctttttagaggaccgtcatttgttcttctttgcttgatataataaaaaaagaacagtcagatatattttcaagtggaggataagtcatccacctatcagagacttcttcagagaatagcaattgtgtctctgcctcaatgcccatgccaaagcttgtggccaatgtagcagtgtcattttcctttccccttttcatatcatccttttataaaggctgtggaaaagtgaaagtgcaaaaagttagatctcttggcatacactgtgctactgtttcagatagttgctcccttaattggcctttaaattctaaattctgcagtgggcaagtcactgagattctacagtgacagtattggccagccagcgaatatagttataagagggtccagtgcctgcctttgtgacatgcagtgttgaaggctttcaaactggagctctgcctctccatctatacccacatgaatacactaaaaacttagacagtaaatcttgtcaagtttcatagaggcacatatctcaggtattgagttttagatgtcaggtttcccaagtaaatagttaaagtgttttgaagctgtgaatttcagtcttagtcataaatatgtgttatttcattagaatactggcagaaatcccaggtataaatgagcaaatgaaagccataagcattaaaaaacatttagtaggaagagatatctatatgtttatgctgaaactgagggagttctcttaatcattgtatagatagttaaataatgttgatagcttttgaaatttcttcttacttaggtaactgataatggtaagaagaaaatacctcaaacaaggacaaatgagaactatttcttacacgtttacttttcacttctattacttagaaaatggagggcatactgggattcaggctgagttatttactacctcaactcactggacaattgccattctttcactatagttttagttataagagcctagaataatacagaatgaaatatatcttgacaattctccactgaaaatgggcttgtatttatattcaactgctttgatttgaagtcccttgtagagctcctatccctttaaaagtacagttaccaccaatctaggtattactttaaaaattcatcctttcatctttcctgccctgaatgtattgatgtttgactacaaacttcattgtgttttgagtctctccatctgacccctaaacgtgaagaaggtgcacagaagaacacaaaaaaacaaacaggaaaaatcaaaattctagagaaacacaatatgaaatgattctatgtttcaatgtgtacaacaataaataatttattcaaactgcactactatcttgggcatctgtgccttttttcagttttataatatggtgtgtgcccttaaacataatcttctgactcatagtaaatatattctttatttatatattcattcatttattttttaatcttctagcatacttgtcttggataaccaatacactctatcttattttcatggaagcagtgcctgatcaaaaagtgttctaatgatctaagtaggtcaatccagtaccttttctggattgatagggagatgacaaaaaaaataggaagaaatgactcttacctctggaattgctaagcacagaggatgagaatttgtaactgttaagaagcatattttatctcatagaagagacctatctgaagaatgaagttaaatgaaattagcaaagaggaatggtagatggagtctgggaaagctctggcatatactggtttctactgtctgactttgggccctgggtactgcaactcttcaattttataaccttcttcagttaagctttaggagtagcctagttccattttggttttttgcttgtttgtttgtttgtttaaattattttgagttgatatccatcacttacaactgaaaaacttctgttttactttaggatctccaatttccttttgaaaattgatttctagaagtatcattgtttgctcaaagaatgagttttaagacttggtgcatattgccaagttctattccatgatataatttacactccattaataatgaatgagagtttgccacagataggtttctgaaattctccaaatgatgacatatatctgggtttgagactgcttataatctaagtcattattttatttatttctccaatatttattgagcacctacagtgtgccagggattttctgtgatctagaatataaagatcaggatgttacttgacctgtcttaaatgaagtcatactcagtgtgagaagcacatggcttcccatctaaatatatcaggatgtgatcaatgacatggtgactttatggataaaggatcctagaagtacgggagaggaagcaatgatctgagatcagtagaaatggtttcataaagcagattaaaattcactttaaacagaatatttgaccacgatacaagtggaaagggtagaagaaactgcaggagaaaaaaagatgcataaaagggagtagctcattatagatgaataatgtagtgtttaaagaataatgtaaaaagcatctgaaatatctgtgaatttgactactctagggatctcatataagtggaattgtatagtatttgtccttttgtgtctggcttacttcatttagcatattgttttctagtgttcagttggtatggagttaagggatatgattcatgatcatcaggagaactcaagtgaagaaagattgggtctgtgcactgttattcaaaatgaacaatatttgcatctaagggaagagtatgggaagaccacactgggaagttagtgtagttattaaagctctccttggcacatcaaatgctgggcatgtgcagctgacctgcaatgagaaaacctggccatcatggattttatgtataccctagtctagaaaaggatggagctggatatatagatgagatccatcaatgcatcaattccaggcaaatactggccaaaaaaaagggcaaaaactaaacatatgcttaatttattgcatagtcctgaatgtaggacagagggtctcagattatgggaaaatttctacaggacgggatcatcgaagactccctttggttgagatcttctacagtcagtgcatctcagagagagggatggaaatcagaaaagccaaaaccatcaaactgttagaagaaaatgtagcggaaatgcttcatgacaccatttggcaatgacttattggacatgacaccaaaagcatagaccacaaaaggaaacataggtaaatgagacttcattaaaatttaaaacttttttgcatcaaaggacacaatggacagtgaaaaggcaaaccactgaatgagagaaaacatttgcaaatcatatatcagataagggatttatatccaaaatacattaaaggaaaactcccgcaactcaaaaacataaaaagaagcagtccagttaaaaaatgggcaaaggatttgaataggcttctccaaagaagatatgaagatggccaataagtacaggaaaacatgttcaacatcactaattattaggaaatgcaaatcaaaatcacaataagatgccacttcacatccataaggatggctattattaaaagcaaaaccaaaaaaaaaaaaaaaaaaagcaaaagaaaattgttggtgaggatgtgaaggaattggaacttttgtgtatccctggtgggaacgtaaagtggtataacccttgtggaaaacagtatgattgttctcagaaaactagacatagaattactatgtgatcccataattcctcttctgggtatatactgaaaacataaataaaaagcaggaacttgaacacatatttgtacacttaagttcatagcagcattattcacaatagccaaaaggtaggaaaacccaaatgcctttcagaagatgaatagatacacagaatgcactatatacataaaatagaatattattccgttttaaaaaggatagaaattaggacatatgctacaatgtagatgaacttcaaaaacagtatactaaatgaaataagccaaacacgaaaggacaaatactatacaattccacttacatgcggtccttagagtagtcaaattcacagagacagaaaataaaatgatgattaccaggagacagcagtagggaataatggggagttattgtttaataggtacagagattcagtttgggatgatgaaagagctctggatgtagatgggggtgatgattgcacagcagtatgaatgctcttaatgccactcaaatggacacctaaaaatggttaaaatgacaaattttatgttgtatatatgttaccacatcaaaaagctaaatatttcagatgtttcacaagctggaaaaaatatatatcatgtttaaaatttatattgttaattttgggccatcaacatgatcaatatccttggtaatccttattatatataatataacagatcacccgaaagagtacagaaataagactggtccttttttctgtaatatgaactttctccacaatgtgccctgttatccaaatgattactccaacgattactcctgaccacttgtttcttctttaagacagaccaagttacaccaagatacataaccacagccaccctcacattcccctccctagtccttggcctttctcccaacaagttgattcaagatagtgtcagctctgtctgcttccttcaatgaccttccagtttatttatggccattatgtccctttccccacttaatattacctttttcccctgacgcaaagtgaaaactaggttttcctctggaaaaattcctggagaccctggttttataagtttgatggtccttagaataacctttcatttagaaaaaaaaaagacttcataaaccagctacacattttgcaccatacatatttggggagaatcattttctttcattttattttttttcctgttttctctaataaaacataattatatggaacatgactgtatcacatccaggaatgtttcctctctcccctcattggtgctgacttcttgtcagagttcagggaaatctacacactaagttgccccacagaaaataaactctctctttttggtggttctttgggtgttctgacatttaaaaataaaggtagaaacttggtccagtagtcaggacctccataaagaagcatatagctgatgtttactcaaatgatagtctcactgaagaggttttaaagcaatttgtaaggagcaaaatctaccattattttgttttcttcttttggttcttgttaaacaagaaatgactcatgagatattcatgatcattgcactcctctaagaaagggatagtctgttaccaatatttacatagctgcacgaataagcaaaggcaatttatttttaaatgtacactattctaataataattactatcatctatactgtcctattacatgactctcaatttaagtgtttttgtgtattcccagataaaattttaaactcttctgagaaagtaatagtctgtttctgagtttaaatttttttttttttttgaatcggagtttcactttgtcaccctggctggagtgcagtggcgcaatctcggctcactgcaagctccacctcccgggttcacaccattctcctgcctcagcctcccgagtagctgggactacagatgcccgccaccacgcctggctaattttttgtagttttagtagagacggggtttcaccgtgttagccaggacggtcttgatctcctgacctcgtgatccgcccacctcggcctcccaaggtgctgggattacaggcatgagccaccgtgcctggccttctgagttttatttttatccaagatgcctagcaaaggtgtgtgtgtatttatagatgtgtatcatatgtatcttatgcatatacatcttatacatcttatgatatgtatcttacatgtatacatatcttataaaatatatatacatatgcatatatctcacacatatataattaacattttcatacttaatgtgattctcatttttaacatacaattttttttagaaagtgaaaaccaaagaaaaatcatttagaatcttaaagagacctgtgatggacttttaaacattaatgatgctatgaattcctaagctctgtgtaaaccaaacacatgattaaaaatgcttatttcaaagttgtgaaaaataattggcaggatcaaaagaaaggactctagctcacagacgagtcctcattctcatgacagtagcgtaaaataaaagcactagagcataaggtgatctgatgtaactatgacagttttccccaaggcaggatagaaattcctccctttacatattttgatatcccaaatagggctcacttccccataactcaagaattcctcataattctttcacactgtgttagacacagtctcttaagcagttttatgtggcactcttgaatctagacaggaataatttgctttgatattgaaaggtgaaggggcaaaccccagaaagcaccctcatgaatttcacaggcaggcctctttaactcagttgtttgctggactggccaactcaaataagtgtgtgagaaataaaatcagaggtccagcaagaggctagaaggctggcttaatcctggcccaacagcagtgtggtttaattcagtggaagtaattccacaaatagagacaaaatgacagcaacttgtttggatctaagatttggcttcaagacatgcgccaataggcttgagttgggatgaatcccttgaatttctgtgccatatcctgtggagaagctgacttgacatgctgtcttcgaattcacacattctcaatatttgcttcttttctggcttattctcaaatcagcatcatatacaatgtaaatatcctacttcctattgcatatccttcatgggcctcttgatgacaccaatactcaggacactgtgttagttacactcagagcattagagattattgtcaatgccttctgaaatgcctactcctcattgccattttcctctcttcctccttctcatttcaataagcttaatctgtgcaaagatggttggcttacttaagacctaaaactgcatttcacagtacatattctggctctttcagtactaaaagtcaattatctttgtcttattattccctcttttgttaggggtcagtggaatagttataaggaaaccagggagaatcataaacctatttttttttacattccacattttcctatatgggttactaaatatatattactaattacatcattttgttcatgcaaacaatcaagcaggaaaaaaaggaaatatcaagatgttgttatgcatcgctaattacagatgagagaacatcattaagttgaaaagaatttcactgcaggaaaatggcaaagaaaaagaaacaaagtcgcctaatattgttattattcaacagagacagaaaataaagaaaatggagtttgaacgtttcttcaaaggtattgtagagataatttgatggatatctacaatccaatttgctgctgcttctttggttttttacaatcataagttcaaactgcaccataagtacattttcaaaacagagttcatataatgacaaaatctccccagcatgaacagaaaaagggggggcttgaaaatttcatagtaattggttgtttacatgaaattctttatttctgtcccatcttggctaccttctgcatagtatcctttattcccttatactatcataaactttacacctaagccatctaaacaggcatacttccccagtatgatttcaaaatttggtaatgctgaattaatcttagcttgcattattgaatatatgttcttgtgcctcagaaacatatttgttcattttagatgttcccaggaataaattatattgatacataattcagaataataatttcaggcctcgttgtgctttttatactgattgaacttgtctgctaagtgagaagctttacacattaatagcctcagatctacaaactcagtgaattcatattatttatgaaaaaaaccatagtgtgactggcacaattgaagagaaaaaaaacttgggcctattgaaaataaatgccatttcaatgtgtctatctcttaatcattaaggaataaagtgagtcatctttatttaaactaacagtttttaagtgggatagtggaaaaaattttcttagaagtaatttttttgcacatgtcatgatttacttgactcatgtcttataatgtataatgtaggtagtgtctaaaatttctattactcctcagtaaatatggaaatataactatgaatatttataaaaatgctagtataatttctttagagatcattatgatgaactgagttttgtgggaaaacaagaagagaaaacgaaagctaatgtgatgttattttttctgctaatgcacacaaatctgcccctaatacaagtcagggggttactgaaagatgctgttgtagagagaagttgtttataatttaaatgatatgattttagctcacagaggataggtaattgaaatgtttagatcatttagacacatattttagatattcttctctccaaaagaaagattgtaccatatctgtagagttctaacttttgaatataaatctaatggttaaaaaaggcacttgaaattgattttttagaattggcaattcattaaatcatttattccaaaaatatttctgaacactcctgtatgtgctgtggggctagaatcatgataagatactcagaacctgagttctaagagaggttacagctcaacagtttggagttcgcactagtttttactctttcacggctggtagtcttcccaatctccttgggctaacagctgccttctaagtagtggtgaggtctgtggctgtggcaaagaattttttcttcgggaatacatttcatttggagtgaatctgccaacattaccagcatctctatccccagtagcaaataatagagcagaccaatctagacaacttggagtctaaataactcaagttgggctttattttcttcttaatttggtttgcacatcaagaggaggtgctaacatcctaaggaaaaaaaaattgcacgtgcatcttcctttttcattctatctcctttcattccagctaggtgtgaaaccagaaaatccaagacaggtctcagttcatttagaaagctaattttgccaaggttgaggacgtgcccgtgacacagcctcaggaagtcctgacgacatgagcccaaggtggtcagggcacagtttggttttatacattttagggagacatgagacatcaatcaatatatgtaagaagtacattggtttggtctagaaaggcgggacaacttgaagcaaaggcaggaagagtggaaacagggagggagcttccaggtcacagataggtgagacacaaatggttacattcctttaggtttctgattagcctttcctaatgagacaaatcagatacgcatctatctcagtgagcagaggggtgattttgaatagaacaggaggcaggcttgcccaagcagtttccagcttgagtttatcttagtgattttggggacccaagatattttcctttcacatttcctcccttttctttttaaaaatcttttggggaaagcattttacaagaagtttagtctctggtctcaggtttcatctgatctctcatggctaggacagtatattcctagatgggtaggtcccaaaagctcatttttagcaggttgtgaagcctcatgtcctgtgaagataaagtagggaagaggaagggagaaaacacaacaaacaaaagaacaatcctggaaaaagcaatataggccacattactctgaagtccatacattaataggcaggtatgaaagtggcttatgtatgtaaataagttgctgttattttcttctgaagtttaatttgtctggcttcagttcgcaggttggttccttccaagcctctggtatctatcatttcatcttctacctccatgaaatcgacttctttagctcccacatattagtgagaatatgcaatatttgtctttctgtgcctggtttatttcacttaacataatgatctccaattccaaccatgctggtgccaatgacatattttattgtttttttaatggccaaatagtattcgattttgtacatgtaccacattttctttacccattcatccactgatagacatttaagttgattccatatctttgctattgtaaatagtatttaacaaacttactgagtacatattaaatatgtaatttttgaagctatgttatatttgttttatttatattttaatgtaaagcttataggaattttatggaatgtatttttttaattatactttaagttctagggtacatgtgcacaacgtgcaggtttgttacatatgtatacctgtgccatgttggtgtgctgcacccattaactcatcatttacattaggtatatatcctaatgctatccctcccccctcccccaaccccacgacaggccccggtgtgtgatgttccccttcctgtgtccaagtgttttcatgttcaattcccacctatgagtgagaacatgcggtgtttggttttttgtccttgcaatagtttgctgagaatgatggtttccagctttatccatgtcactacaaaagacatgaactcatccttttttatggctgcatagtattccatagtgtatatgtgccacattttcttaatccagtctatcattgatggacgtttgggttggttccaagtctgctattgtgaatagtgccacaataaacatacgtgtgcatgtgtctttatagcagcatgatttataatccttattacccagtaataggatggctgggacaaatggtatttctagttctagatccttgaggaatcgccacactgtcttccacaatggctgaactagtttacagtcccacgaagattgtaaaagtattcccgtattttgaaactgatttttaaagaggatgaactgaaattcagtaagactgaagaatttgccaaggatagacaactacaaatatagactgattctcaaatatgtgatttctcctctatgttttaatgtgtcagaatttcataaatggttaagctctttatatgtctattaggtttcatctttccggaagctattgcacaccagtctaagtcaaataggagtagctctgctgtatttgttaaggctgagaaaaatactgactgcctgaaaagaacagctatgtcctggaaaaagcaaatgtggttggaaatttttattatagagtaagaggaccacagtaagaagtcatccaaaagtacataaggagtcacttgaagaatcctttattcatcttgatactttgttagttaggcatccactgatggtaagaagactgtggttcctctatttatgaaggctgaaggaatctgtacctgagtttaacaacatacaatttagtgaactccaattttatgtgcaaggtatgaaatatttatatatgtaagtctgagtgttatgatgtttgctttatttattgagtcttttcctttctcagatgtcagggcactaaccacatcatccatgctcctgaaaaacaccatgctgtagtttatgtagtttaaatgtgatgctagctgcttctctgggaacaagaagccttctccttcagctgctgaactggaaaatctttgttgttgttctttgaatggtacctcgaccagaggctcatttttccctcaggaactcgaacacaatggcgtgggaaagatctcttatttttagcttctctgaagacatatgtcctcattgatgacattcagtttctgcaggggaaaaccttcagcatccaccatgctgagaaatgagcaacacaccagacaaaaattgactcagtactaatgaaaatcttcggggaaaacaagtctgctgttcagtagataccattgcattgtacaacacaaatatcattttttttattttggcaatgagaaatctgctctaatacagcattagattgagatggtttccgaatgttgaatatagctcagaacaatgaggatataagaatttagtatagagagggagaaggaaagagtcctcaaggaaaaaacatgtatcagagataaagttttgaagtttgaagctttaaagtattcttactatattgtggccatacctcctttttgtggttgtgatacagcttcatctcatttgttttgtttaaaaaattaaaccatgatttgtagatgacaaatgttttcttgaagtcaaaaccctattgcttattttatcaattattgtttggcttcagcaagttattcactttctttgaaacttagcttctgtggcatattgaattttccaaagatgactacaacaatatcccccaaccccttctagaacatgcccttctagaggccaggcgcggtggctcacgcctgtaatcccagcactttgggaggctgaggcaggcagatcacaaggtcaggagatcaagaccatcgtggctaacatggtgaaaccctgtctctacttaaaatacaaaaagaaattagccgggtgtggtggcgggcacctgtagtcccagctactcgggaggctgaggcaagagaatggcgtgaacccaggaggcggagcttgcagtgagtcgagatctcaccactgcactccagcctgggtgacagaacaagactctgtctcaaaaaaaaaaaaaaaaaaaaaagaacacgcccttctagaacattgccactttcttttcaatgcatggactcttattcccctcttctttaatctgcacgggtttgtgacttatttttaaccaatagggtgaggtagcagtgatactgcttgattattaaggctaggtcataatagataatgctgctcctgcttttttcactagatcatttgctcttggattcctgggccaccacattcaaaattcaattacccagaggcttccatgcgataaggaagccaagtcatgagtgagggcatgttccttctgttagcagtcccagtcttcaaatcctcctagcctagggaatatttgaattttagagtatttgagttcagagtggtatggtgaacccaggtgaaagagcctcacattaaaacagcccctgccctcaatttaacctcaggctttccaactgagacacctgacatcatagagaagaaacaagagtcctctgctatacctattctatatttctgacccacagaatccatgagtataataaaatatgcttatgatactacctttatagtgtttttgtgtacatttgtacctgagtacaattataaccaggacacacttcacataaagttgagggaatacaattagtttatgtatggaaaaacttcctaagctgtaaagttcatctttcttaaatgaagacatttctctttttctgccttgtaactcaaggcctgcagatattacagggccctgtttcctagcaatcttcactttcaaatcacctctccttcatcctaaaggaaccctaagttttttgaaaatagtaatttctgcaaaagtatcacacacactatatatgtgtgtgtgtgtgtataaatgcatacatattttcgtgtttaccattgacacatggatactgataagacaatgtatttactaggaaaacatgtttacaaacacaagtagtcatttagtaatactatttttggaatatatatatataccataaaaaactcatgcattttggtattgaataacttttttcaagagaaagaacttaggttaatgtcagttcagctgacatttttttcactaaaaacatgaaacattttgtagttatatgtaaagttatattatcccaaagatacatcataaatgcatagtctccccactttttttcttctctgtccttttaaagaccctaggagatacagaaggcctcagaaatacatggaacatacgttcttgagtggcatcaggatctctcttcagtttttgaccatgacttgattttctttttgagttggcacagttcttattttctctaaagttgagccttttccacatacaaaaaccccctttacatgtaatagctaagaagtataacaaaatgtcagttactaggtgtcccagcatcctgggaaacccataatgactgtggatggttgaacagacatagtatgagtcctacataaacaatattgaagtggcttggaaaaaggggaaataggtcataataatacaaatcagggcttgatactttccataatgaaatattttacaaatttccctcttctttaattttaaaaggatatttttcttatttttatgcatttttacttatggtatcacataaaattaaaagcattagaaaaaatctaaaagattaaaaatgtgtttttttaaaaaggaaccttaaagtttttaaaaaatcacaaaaaagactattcccaaaagaacttattataatcattccaaaaggaggtatttttctcactattcatcaagctgattagcaaaatatttcagcaaccaggaagtcattttctatcacttcaagtgcctgaaacttagttcaaggtgtgagtaaattgaaaataattgttgaaatataggaaaaaataaaatagattttttcatatgtagaattaccattttcttaaaggtgtcaatagcattctttgcattttagagtaatttggttcagaatgatatagacatgtcatttaccttagaaatcacatggagattatttgaaaataacatttgtcattatattgctaaacctctatatatactctattagacacagcctttccttattcttcgaatttatttttctgcactatagagttcagtcaattctgccaccagactctggtttatgttcgttttgacttcatcctatcttagtactgacctatatgatatcataccttctctgtaaaacctactacaatctgattctcattaataatgtacatatcaggatcctcctgtgtgtttaaataggattttatcctattaagattgaacacagcttagctagtaagtaggtccttttccccataagttgctagagtatagcagttctgatgatatttttatgtcaggtctgccctgacagtagataaacagttactctcctaggccaacagaaaaacttgtcacaatttttaatttaaaatttttttgaggggggacagagtctcactctgtcacccaggctggagtgcagtggcgccattaatttaaatttttaataatggacggtaaatgggttggtttatctagtaaaagattcaggaaaggtgagtggtaaggtccaaaagaggaaaaggaggcagaggtaatttagttcttttggtagatatttatcatactcttacttagaatcttgctatccaaattttcaaaaacacatgattgttcaaagtaagaattttagttagacacagttgcaagatttaaatgagaaacaacgtgcagaagggagaattttcccacttcttcattcattgtttgaggtcattttactgcatctattacaatcactttacatatagtatgaggacttaatatacttccatttctccccttctggtctttctgctcttgtttgtatgcactttactcttacatacattataaagtctacaatatagtattattattatggtttagaaagtgagattctgtacccaaacatggtagaaacacaaaatagccttttaaatcaggacttcaaccttgtcccactaatgcaccattctgtggatgtcccaagttttagtaggaaatgctctcatattctgaatgagatttaaaagatgaagagaagtcaaaagtgaaagagaatgatgagaactgctggatttaaggaattgtgttcttccattccagagttggagaggcaggaaggctgcataggtatcatcttagtttgtgtggtgctgctataactgaatatgtgagactgaatagtttacaagaacagacatgtatttcttacagatctggaggttggaaagtccaagatcgagaggccacatctggtgagaatgtttttgttgtagcaacccacagcagaatgtggaagggcaagacagaacatgtataagagagagaggaccaaacatgcttttataacaaatccactctagcagtaataaactcactccaacaataacaacactgagccctcatgacctaattaactcttaaaggtccctcctcttaaaactgttgcactggaaattaattttccaatacctgaactttgaggaacacattcaaaccgcagcagatgtgttcagtccatgaaattctttgtgctatgcatttataattggtgaaattttctgtatatattccatagttcaataaaaaatgcaaatgtaaaaggcaatatcgaaaaaaatttcaaggagataaaagagagaggaaatattttattttaccaactgaggtgtcagatgtaatagcaatatatgatgatttatcttaaccatctgtaaattaccttgtttcaccaatttatttaatgggaaactcagttttcaaacaaaaagaaaaaaagaggaagtgggaaagagccaagatggtcaactagatgcagccagaaagagcttcacacatgaagacagacacaactatcaagtagactggcacacgctgaacactgagaaagaaaacattgagagtggaaaaatggaggatgcaagccctgggctgaaagaaaagaaagctgagaaccctgcaaggagttgccaagtagcaggactcatttctggccctcggcggctcctagggaatgggtgagtgaaacagccatggagcgtcccactcctaccacagatttccataatcctagctgtgtgagaccacatgactccactgacatttagctggcagggagagttggcaaagacagaactccaacctgtgctgagcgcagatggtttggcactggaacagctgcagtggagcatggacatgggcacccatcccacaaggctgaccatatttttctaggcaactttagactttgttagttgctgaatctgcacagaacagagctgtcctgcctataaaactgggtcaatctgagagtccccctgtctaccagtctctcccagggtccctgcctggctgtacctgcgtagaacacagcctcagctgcccagcctaaatgcttgctagcagccagtgccatacttctttctctagaagacactgcatacctgtcagagtactgttgcaaatggaccactgctggtgtgcacctgctttcagccttcctccaccagcatgcattcacttccagccttcccccctgcctcaccagcatgcatgtgcatgcagaacccccactgccctgccagcatgaatgagcacacagggatgcctgacaccccactggcacacatgcacacaggaacccacaactgctctgctggtgcacatacatgcaagaaaccccactacctcactggctcatttttgcctacagcccccattggagaattggtgccagtggactggaaataccttggcccctcagtggagcaggtgcttaatttcaaggggccagagaacaaagctaagggcctgatcctaggcccccaggattataacacatagcccaggagtgctgagctgaagcttgccccactgaaagcatgcagaataaagccaatcagctgaacccaatctatagcacagtcaaaccttcaagggcattaaagaatataaaagcaaaaaaccctatccagaaaaatagcaattcccaaaactaaagtaacatctgaccacacagaagagaaaaaaaaaataataataacagaaaaagaactctggcaacagtaaaagctagagtgtcttcttaactccaaatgactacagtagctccctatcagtgctttctaaccagactgaaatcctgaaatcagagacatagaactcagaatctggatagtaagaaggctcatcaaaatacaggaaaaaatggaaaccctatcaaaggaacacaataaaacagtccatgaaatgaaagacgacatagccattataagaaagaaccaaactgaacttctcaaaaaaaaatccactacagttaataaaaaatgcaattggaagaaataataacaatacaccaagctgaggaagaatttcagagctcaaatatggctcctttgaatcaatgcagacagacaaaaataaggaaaaaatagttttaaaaaatgaacaaaacctctgagaaatacgagattatttaaaaagactcaatctacaattcattagcattcctgaaagagatggagagagcaagaaacattgaaaatatatttgaaaatattgtccacaaaaatttctgcaaccttgccaaagagaatgatatataaattcagaaaattcagaaaacccctataagatactctacaagacagccatccccaaaacacatagacatgagattattcaaagttaatgcaaaagaaatatcataaaggcagctagagagaaagggcatataacatacaaagggaactccttcaggctaacagtagatctttcagaagaaaccttacaagccagaagggattggaggtctatattcaaccctctaaaagaaaacaattttcaaccaagaattagatatccactcaaactaagcttcataagcaaagaagacagaaaatcctttacagacaagcaaatcctaagtgaatttgttaccaccagacctacactacaagaggtccttaagggaaggctaaacatgaaaacaaaagaacagtgcctgccaacaataacacacttaagtaaatagccctctgacactataaaacaactctacaatcaaatatacataacaaccagctaaaaacatgatgacaggatcaaatcctcacatatcaatattaaccttgaatgtaaagaaactaaatgcctcacttaaaagacacggagtggcaagttggataaacaagtaagactcaactctatgctgtcttcaacagaccaatctcacatgcactaacacctatagactcaaagtaaagggactgagaaagatctattaagcaaatggaaaacaaaaaaagcagggtggttgttcttattttagacaaaacagactttaaaccaataatgatcaaaaaggacgaagaagggcattacacagtgataaaatgattctatggaacaagatgacttagtatccaaaatatgtatgcatccaacactagagcatccagattcacaaaacaagttcttagagacctttgaagagggttagataaccacataataatagtggaagacttcaacacaccactgacagtgttagacaaatcatcgaggcagaaaaccagcaaagatatttgggacctatattcaacacttgaccaaatgaacctaacagacatttacagaatactccacccaacaacaacagaatacacatttttctcatctatacatagcacatattctaagatcaaccacataaagtaattgtggtttatgctgaacagtactaaacagaactaaaacatcacatgagcagaactaaaaaccacatgatcatctcaatagatgaagaaagggcttaaaataaaattcagcatcccttagtgttaaaaatcattaacaatctaggcactgaaggaatatgcttcaaagtaataagacccatctatgaaaaacccacagccaacattatactgaatgggcaaaagctggaagcattccacctgagaactggagcaagacaagaatgcccgctctcaccacttctgttcaacatagtgttggaagtccttgttagagcaattaggcaagagaaagaaataaaacacatccaaatagggagagaggaagtcaaactatcactgtttgaaatatgattctacacttctttctgcccaaaggctcctggaagtgataaacaacttcagcaaagtttcagcatgaaaatcaatgtacaaaaattagtagcacttctatacagcaataacatacaagttgagaaccaaattaagaaggcaatcccattcacaataaacacaaaagaataaagtatctaggagtacagctaaccagagaggtgaaatatctctacaataagcattacaaaacaatactgaaataatgcagagatggcacaaataaatggaaaaccattccatgctcatggacaggaaaaatcaatattgttataatggccattctctccaaagcaatttacagattcaatgctatttctatcaaactataaaggacatttttcagagaattagaacaaatttattctaaaaccatatggaaccaaacgaggctgaatagccaaagtagtcctaagcaaaaagaacaaagctggaggcatcacactacttgacttgaaactgtactgcaaggttacagtaaccaaaacaacatggtactggcatgcaaacagacacctaggccattggacctggttagtgaacacagaaataaaggcacacacctacaactatttgatctttgaaaaaggtgacaataacaagcaatggggaaaggactctctattcaataaatgctgctggaataagtggctaggaatttatctatctcttctaggttttttagtttgtgtgcatagaggtgttcacagtagtttctgatggttatttttatttctgtagggtcagtggtaacattccctttattatttctaattgtgtttatttgaatcttctctcttttcttttttattattctagctagcagcctatcttaattgtttttcaaaagaccaactcctgtatttgtttattttttaatagattttcatgtgtcattttccttcattttggctctgattgtgttatttcttgtcttctgctagcttgtgggttgatttattcttgcttctctacttctttccattgcaataagttgttaagttgagatctttatttttgatgtggatatttagtgctatgaattttcctcttaacactgtcttagttgtgtcccagagattctggtatgttgtatcttttttctcattcgtttcaaaaatcttcttgatttctgccttaatttcattatttaacccaaaatcattcagaagcatgctgttttatttctatgtaattgcatggttttgagtgatttccatagtcttgacttctatttttattgtgctatggttcaagagtatgtttggtatgattttatttctttgaatttgctgaggattgttttatgtccaattatgtggtcaattttagagtatgtgccacgtgggaatgagaagaatgtatattatgttgatttttggtggagagttctattgaaatctatcagatccatttggtccaatgttgagtttatgtcctgaagatctttgttaattttctgcttcgatgacctgtttaatattgttagtggagtgatgaagttttccattattattttgtagaagtctgtgtctctttgtaggtctctaaggacttcccttatgaatctgggtgctcctgtgttgggtgcatatatatttgggatagttaggtcttcctgttgaattgaaccctcctttaccattatataatatcattctttgtcttttttacctttctggttaaaattctgctttgtctgaaattagaattgcaacccctgcttttttctgttttccatttgcttggtagattttcctccatccctttattttaagcctgtgggtatcatgatgtgtaagatgggtctcttgaagacagcataccattaggtcttatttttttcttcagtctgccactctgtactttttacgtggggcatttagcctatttatattcaaggttattattaacatgtgtggatttgatcctactattgtgctgttagttggttactatgttggcttgtttgtgtggttgctttagagtgtcactggtctgtatgtttaaacatgttttatgttagctggcagcagtctttcctttccatatttagtgcctctttcaagatctcatgtaaggcaggtctggtggcaataagctctctcaacatttgcttatctgaaaaggatattatttctctttaacttgagaagattagttggttggatatgaaattattggttgaaggtttttctctttacaaatgttgaatataggctcccaatcttttctggcttgtagggtttcagctgagcagttttctgttagcttgatagtgttccttttacaggtgacctacccattctctgtagctgcctttaacattctttattttcaaccttaaaaaaaatctgatgattatgtgtcctggggatgatattcttgttagaatcttgcaagagcgttcagtatttcctgaatttgactgtttgcctctctagcatggttgggaaagttttcatggatgatatgctgaaatatgttcaccaagttgtttgctttgtccccctcccttttggggatgccaatgattcatagatttggcctctttacataatcccatactctcagacgttttgttcattccattttattcttttttatttatttttgtctgactgccctatttcagagaaccagtcttcaagttctgagatttttttcttcagcttagtttactcaactgttaatacttgtgattgcatcgtgaaatttttgtattgtgttattcagctctgtcagactcattagcttctttcccatacagactgtttcatctttcagctcctttattgctttattttgattcttagtttccttaaattgggttttcctatcctcctgaatctcaatgatcttttttcctatttatatgctgaattctatttctgtcattccagccagttcagctggttaagaactcttctttgagaacaggagtggttgtttggaggacatacaacactctggccatttgagttactggacttcttgcattggttctatctctctatgtgggtattcttttaactgcaatgtagaatgagtacagttaatagacatcttttatggatttttttcacagggctgaagctttgcgcagagtctttatttgcagctgacttcttgtctctcgtttcagaagggggtatgttagcaaggtgtttttggtgttgaagctttggaatgtgatgcaggaggtggcacttagatttactggtcagttggtagactcttgcccagttgtgtggctcccctatgtttcctcatagtttcaactgtgttaactttcaatactctaaaatgtgggttcctcttccccttaatgctggctgtaggttgtgacttgccattcctgggctgcccactgcagctctgggacaatccagtgtttatgttcattccccaacttgaaggtagcagaagggaccttagtagtgggtatggccaaggatcttttgcttgtctgctggaggctccaccacagagagttgcaggtcagcaattgctcagtgcagtcaacccaggatggaaggtctgtgctgtgagtgcaagctgggggttccctgtctggtgatgagcagtgggggatgggtgggacctgtgggagacagactggcctcccctcctttggtgaactgtagcttgttacaggtgtggatgaagcacttagtgtctttgctccttcgttagtccatgggtagcaagggcagttccactgcagaggcagtggtagagaggcttttacttgcccctggggtctctgtccagtgggctgctgaacagctactggcttgacaactctggcaggagagtggctggaggcccaggcctggaggacctgctcagtgaggagatgtgagaacaagcacccacataaccatctcaccacttttctgtaggactcctgtggtatgctgggaaccactctagtccctagtcacctcagattttccagtgcctggaggtatcagcattgaagcctgcaaaacagcaaagatggtggcttgcccctccctctgggaactccatctgagggaggtacattcctgttgccagcttgaacacacctataggaggtggctggagaccttggttaagaggttccccccagcagtaaggaggaaaaagatcagggacctgtttacaaaagcagtctggccacatttttgtagggcagctgtgctgtgctgggagactgctctcacccctggtcagcttggcctctccaaagcccaaagactagaatggctaatttgcccaaagagcaaagagggctgcccaactctccctctgggagctccgtcagctggagaacactggtgggggtggctggagaccccggttgggacatccttcccagtgaggtgaaataggattggggacctactttaaaatgaagtctgggcatgttttcaaagagcagctctgctgtgaaggggaccacttctgcccctgttcagtttgggctctccaaggcccagaggctgaaatggctaagtcactcaatcagcaaagatggtggcccaccccttcctctaggtgttttgccccaggaaggttttaaatctctggctggagaacactagcagaggtggctagagacctcagttaggaggtcccacccagtgaggaagaatgggattagggaactgcttaaaaaagcagtctggtcatgtttccatagagcagctgtgctgtgctgggggatggtttctgtccctggtcagcttggactctccaaagctcaaagtctggaacagctaagttgtctaataagcaaagatggcagcctgccccttcccttggaagctccatctcagggaggtgcaatgctgctaccagtagttggctgcaattccaagtcagtgggtcttatcctgtgaggtgccatggaaatgagacagccagttgggacgtgttccctagcaaaactccattctgcactgggatggagccacagaagtttgtgctttttgcaggagggaagagcccggtccctcctcttcttgtgtagaacctgggattcaaactgcaaggggggaattgcaccagcaggggctctggctttgcagggggcccctgtttccccttttcttccttttcatccaataaaatcctgccctgctcatccttcaaattgtctgcaagcctaaattttcatggctgtgtgataagaacccccatctttagctggactaaggaaaattcctgcaacagaagtggggcctccagactgttgctgctcagccctgtggattcagcctctttcctaggggtatgtatggggactaacctcccattttgccaaagttgcatctacttttgccgggaagcccagaaagcccgggtatctaaggctcctgggtctctgggtgtgcctgagaaggttctcctccaagactctatgtcgttctgtgtgtcagactgaaggctgtggtggagtgagttcacaaggcgatctcctgacctgagggttgcaatgatctgtgggaaagtgtggggtcctggggttgcacattcactcaccatttctctgggcgggggaggttcccacggttccatgtcactcccaggtgggctgtcatcctgccttgctttcctccattctccgtgggttgagttgtttgtttgattagtcccattgcatgtacctgtatgtttcagttgaaggtgctatatttactttccccttctgttcctctccaggagagctgcatacactagttgcttctagttggctatcttggccactttctgccaatttctctgttgttgacaaattatagttgtatatatttatgaggtacaaagtggttttatgatttttgaatatcatacagaataatttaaattaattaatatatcatctcaaatatttcacatttttttgataagaaaattaggaattttttaagcattattgaaatgtatagtactcaattattagctatatccaggatgctgtactatgtatctcaaaaaaatgaacttatcccttctatctaactgaggctttgaaaatgttgtagataaaaataatgcgtgatgggttttctaacctctgagaaatattttgaagaggtaattgattatttatttaacaagagtgaaatcctaaaatcctaataatgctttacacatggctctatgtagttttcaaaatagctctacataaattattctggttgattttgacagcttccttgtaatataggtattggccagcttggttttatacaagaaagaattaaagttctaaaatatattgtgaataatcactgtcctaatagttaattaccaaaaaaaactaaccaaatctagaaccctgggctgcatcctgcagaattctgtactgttttccctacccctttgcctcccttgaaacaagttcagagacagcaaaacaatctgaatcaagaagattttgttaatcacttaaaatctagaattactatcatgtaaacggtcatgatttgtgagagcttatcatggaccagcctctcactgagtgctctgcatgtgttgtttgctacactctttattgtagctccaagaaagactttgattatcatctttaatttacatataaggaaattgaggtttaaagaagttaaacttatttgtccagtgtcttgtagcaaataaactgaagaccaaagaagtaaacccattgtctgtcttgagaggccaagatatgcggtattaaattcacaactaaaaaatagaccccacctttgggtattatatcatattgttttccccttaagggcagaaatttacatactttatctccaaagtcctgtggcgcttggccttaggcacaaaataggcttaatgagaacttactgcacaagaaggtgcaactagttcaaaaaggtgggcctctcatatccctgccttcccactgggcactggcaaagaagatgagtggaatattttaggcaattgattaatggatcaactctaacaagaatgattctgcattcagttatctctgaggaaactgtgagtatgaaatactgatcacatgttaaatcgatttataattgtataagcttgtttatccacaggcgagtcttggagattcttgtttgaggtacatgaactaaatacgctgttgtcttttacctcgggaaggaggtgcaaggcattattttaaaatgtctgcatttcagttcactatagtacctatggtgggtacctatgtaaggccagtcaggaaaccggggatacttctttagcttttcaggaaatcaggtctgacatttgcattcacacaaatccatgtatattcctggcttaaagctcctgtggaaccagatagacagaaagctaatagaggttaactggcaaggaaaaactctgaaagtctgaaataatctctgggtttcaggagagcatgccacatgagttgaaaacaacactaatttattgtagtctgttgcatggaagcagggggctcttgagtatcaattagaagaaagtgctattagttttatttactcagagtgattttatcctatcaacaatgaagcttatggaataaacactttatttatgtaatgtatactattattagaaaaactattggttcattagctcttctaagaggatgaaagcttggatagaatttgtaatgtatggtggcttttagatccccaaatggcaataggattagtttaccctgcagtgttatacgtcaccattactattcagaggagacattcctatggtggatacttgactggcaacaagtgaatatgtcaagttaattcctggaacaggattaataaccccactggcaacatctcccctttgttgtacactttgccgtgcattacagtttaagcaaacgccatttgaatgctttggatcttctgtttgctttagaatggtatggctccctttgactttagaaatggtcctttcgttttcttcctctgaatgttgttgatcatagtcatcatgtatgtcagctcaaaacatgatatcaggggctgtcaaatccagtgaaatagagtaatgtctattaatgaagcttaaaaattattgtaggtggccgggcatggtggctcacgcctgtaatcccaggactttgggaggccaaggcaggcacatcatgaggtcaggagattgagacccatcctggctaacacagtaaaaccccatctctactaaaaatacaaaaaattagctgggcatggtggcaggcacctgtagttccagctacttggaaggctgaggcaggagaatggcatgaacccaggaggcagagcttgcagtgagccgagatcacgccactgcactccagcctgggctacagagtgagactctgtctcaaaaaaaaaaaaaaaaaaaaaaattattgtaattattgtagatttttttccaagatggcagattagaggcattgctagcatacctctcacacttgcaagatcaaactattaattatcactacaataactattgttattagtacaatacagaagtttacattgtaaactttttttcaagaagagagacagtaactgaacaggaaaagcaaaggaatctagggatcctttgaaggaagcaggaggctgcagcctacactgtgagtcaggtgaagggcttcaagtccatagagtgtgagacggagagagtttgcctctgggatacacatccccactagggactctgaaagttcaggccggcccttaccccacccagtgcaggaatcaactttaggagtgctgtggaatataaaagtaggaatagcagtgggaagacccttgcaatcactcccagatcacagtgcagaacaagggcagtcatttcttactgctcctcacagaggatccagcagaggacagccaaaaagttcaggcagcatttggaagttgaaagaagctctcagtgaggtttcacattataacctcaggtggggacaaattccctttttcagagctagggcaggggagagtgaaaagagggccatgagtgcaggagttgcaagcgcaggagccgtgggagaaagatccacaggtacaggatctgcaggtgaaagatcctggtacctggctttacagcagcagggagaggtgtgtcctgaaagacacgattacaattttcatgggcaaagcttatgactccaggcagtggtaagttctgatacaggctgactggaactcagcttgctgctgccagtggaacactgtgggaatggatttactttccccagtgtatagaaactgtgagttttaccaccgtctgctattgcccactccctgcacaaactcttctgtacaccagaggcagcaatgatgccccctgaaacattaatccagtggcctgaggcctgctcccatcccccaacaccaacagaggctgctgcttgccttgcacagagtgcaaacccacccgacccagcccccacctggctttgccccaccacctgcctgatagctcatcatataggagataatctcttgggaactaaatggccccacccattacctgagaaaccagtgtatcccccaggggcaacataaggcaggaaaaaatcccactgctactactgcagctggtgctcttttgcaagtgacacctcctgacttgaggccaaccaacacagtccattacagtatctcctggtagaacaacactgtgccagggaagggcaaaacatttgcaaaaatctcagttattaccactgcctgcaccactatggctaacctggaggttctgagtctgtccacatgaccagttcattactaccataaccagtgttcaacaacgccaaaacactaaggacaacaataaccaaggaatttcacagaatcaacatcactcccctgccatccccagttagaggtgaggctgctacccactgttgggaaacatgaggacaggtcacatcaccagatcccttgcagacattcctcaacaccagcccgaagtgtggcaacgtcactgggcagctagacccagaggaacaacattcacagtagtctggctccaagggactcccactcctaagggaagtgggagggcaccacagcaagggaatactccacgggatgaaagaatatggacagcaggcctcgagtaccagatccttctactggtggaaagctttcttcagcagagacacagttgaagtgctggactctgcagggaaagtcttgagctctatcccaagagtcaaacagtgtttgtgtgcatgaagggtcttggagaaaaggaagtgtatccttctttttccaccaccataggcacagttggagcttctcccatgggagctcagtgtgggtgcaactatagagagtctttctggaacacataagggtgactgcatcttctcaggaagagcaccctccaggttcaggcttccacaagagacagagtccttgtctattgggaacataaacattccaaattcctctctatttggaacataaacatttgtacagatgaacaggtgcctgtccaatctgaaaagctggagcatgggacaagggtcatgtctgaaaggtggataacttccctgttgacctcacaggggagttgaggtggctccaatccttacccctgataagttctcagtgtgactcactgagagctcctccagccacctctgtcaagccgtggacttcacttactcgcctgatttagctacatatgtgtggtagtattaacaatatgtgtaatacaggtaatgacttctgagactgagaattggaaaacagtcccaaggctcagaagggaataagagtttttccataaagaaaaaataatgaaagagatgaaccaattagtccttacgtgaaaaagaaaagaaaaaaaacatgtgagtagtgagagaaggcaactaatattttcctcttactctttcctgagggctcaagtgttcatcatgtgtgggggccgtatttgccaactataatgtgaagagatttcacatgtaatttcaattaattctaacaacaattatgaacttatgtctattatcatttgaattttatagatgagaaagctaaggcattgaagcccatacagctaataaaggacagcgctgggatgccagctttcagaagctttgcggaggttgaacacagatcagaggatatgagatacttgtgtttctaggtaagttctgggaatggtgattctgagtccagcgtaagcaagcgagactgccccatgagcttcagatgatgtgctggagctgagacaaagagaagccctatgtcctcagcactaacaatacagagaagcagagggcttttaacacattggcatttgggcaagtcaaagtcacagggagcgttttaaatttcatatatcattactatcttcctactggttacatattattatctgataattaaaacattaaaatgtacctctagtgctcactgtgggtagtggcacatctgatgtgtcaggatagggaacaacatgaagaaaacggagacacagagacaaaaatattcctaaaaagcctctaagtaccatactgtttgcaccttttatttcatttaatgctcaaagataaacactaaagctaaagaaaaaaacacttatgaaataattattattagcataattcagatttgagatttattttaacttataaaggttgagaaagtttcccaaagcttgtacgtggcaaagccagaattaccttttgagaaataataatcaaaataaatgacagtaagattgtattgatatgagtgattatggattttattatttcccttttctaaatttttaatactgtggttaactaacatttacagtgaaaaagagaaaagcaaatattagatgtaggtctaaatagaacgagcagcattggcaacagccacatcttaacaagttaccaaattcgtttccagctataactggaaagaagagattatcactccacaggaaatgagtttgtgagcacctgcttactgtcgccatggcaatttggagatttttgacctccctgagatgcagtgctaagtaaaatctaccaaatctatactggaaaaaaaatgtgtttaattcctccccctgtaacagtctcacagtcaacaggccagttctccctgggaggcacttgcctcactcttgattaagctgaggatgccgagaagagaaaagtaagacctacttttgatttacttgagctgggcaataatgaaactctggatttgggggcattgtcttggcctagcactgaccagctttgggaccttagacaacttttctaacctgttggaacctcagtttcctcacctgctgcatggggaaggttcctgtgacaaagttgctgttgtcttaaggactcaaggacacattagcatacatagtgtttagcactgtgccaggccctgagaaagtgctttataaatgtggctggtcccattatggactttcatcatttcttccactcctttgacaaacattgattggttgtcaactttatgctcagaatgagtctagatactgggaatacaacaaagaataaaacagataaaaattacagtgcttatatgttggtggaggatgcacataattaatatttaaaataatactatgtgggtaatatgttgggtggttgtcagttgctaaatagaaataaaaatgaggaagggcagtatgaagtgtcagtatggagacttaagtttttagtttgggtggccagggacttttgaatcactgaaagaagacttttgagtaaaggcagtaagatagagataaggggttatgcaggtatctgggagaagatcatttcaggtaaacagcagaagcagaggtcctgagttgggaacttgctctagcatgttctatggataaaaaggaagctgccttgttgaatttgactaaagtgggtaggggagaaatagggagctcagtttagagacaagaattcaggaattgagaccagaaacaaacttggaccagggtgatgaagctggaaacgtggagatgtggttcaattttcgatatcttctgaaggtagagctgacaggatatgttataaaacagcttaattgggagatatttaagagcaaaggctctgtgcttgtttgaattcagtacagggccagaagtaatgacccattcgtggtaggcagttctgagatattcagtattctgagatggaatattccttaatatcccctaagttaagtcacatggttactacttgatttttctttgtaaccatagaaaaattcactggttttcagggaaataaaattctatccttaaacagttcttatcatgagtgtaacctgtctctctgtagcactaaaaaaagtaactacctgtaggtctatttcaactttccaatcccaatgtctttttgtatttctattcacatattgaacatagactatatcaaactgattatcgttatctacacatagaataattctttaagacgtcattcaaagcacctatacacatgaagaggacagtgttgaggacaagggcctggagtaatgctcccgtggtggatttctactgcagcaaatgccaactgaatttttagtatcagtttagtcaggataaatcaacgtgctacaaaatcacttaaaaatagccaattgttttcctagtttttttcataggaacataatattgctttctactagtttctggaaatccagatatattatgtattttgtatttaattagtgattcttaaaaaccaaatgaatttgacttttcacaatttattaagtaaacgcacattagttcctagtgattggaactcacattttcttcatctgagtgaaagattcttgcaatcgattagtgccaaaacaagtttttcactatttttacaaattttactaagatataattgacacataatcaaattcacccttttttgtatatagttctctaagttttgacacatacacagttgtgtaaccaaaaccagagtaaggtacagagcaatcgcaccaacccctcatttctcctgagttcctctctctctaaacccacctactcctggcaattgctgatcccttttttgatccttagttataccctttaaaaatgtcatataaatggaaacacacaatattagctttttgagactagcttccttcactttttgtaatgtatttgaaattcatccatgttgctgcatattatgagtaatttgtttcttttctttgctgagtagttattcattttatggctgaatcacaatccgtttaaccattcccgagtaaaggaacattttattttattttttcagtttttagtagttgtgaaaaaaactcatataaagattctcatacagttgtctgtgtgtgtgtgaacataggttttactcacttcaataaataggagtaagattgctggcttatttagtaaatatatgtttaaatttttaagaaaccgaagcatagtttttcaaagtggttttactatgttgcatttctattgccaatttatgaccttccagttgcaaacagagttgcctttttttaaccattctaatatatgtgtaatagtatctgattatagccttaaatcgtatttactaatgatcaatgttacatttttatgtgtttgtttgccaaactgcatatcttctttcagaaattgactcttcaaatattttgcctgttttctatttgtttgtattcttattattgatttttatgaatttttctatatgactatatgtcctttaacaaatatgtgatttgtgaatattttctcccagtctgtcacttctcttttaattctgttaacagtgcctttcaaagagtaaaaattcttaatttttgtagagtctaatttctcaattttatcttttatgaattatgctttgactactgtacttctgttacctacctcaaggtcaaaaagattgttctacatatttttttctagaaattttatagtattgtgttttacatttttatttataatattttgagttacatttttgtaggctgtaaggcttggattaaagttatttttgttgttgttgttgcctcatatagtgtatagtgggtataaaattgtcctaccaaaattttttgaaaagactatgctttaaccattgatatgacattgtaccttggtaaaaatcagtttactatatattttggggtttatttttacacttcaattctgttcaattgatctatatgctggtaccttcatattgtcttcacagtaataatggatatcaggcagtgtgcatccttcaactttgtttccttttttaaaaaaaaaacataattgttttggcacttctagtttctttggatttctctgtgtattcttaaatcagcttactgatttcaaccttaatccctgtggggacactgattaaaattcattgaaatcataagtttaggataatcaatattttaataatactaaatctaaaaaaaaatgcggactttgggaggccaaggcgggtggattgcctgagctaaggagttcgagaccagcctgggcaacacggtgaaaccccttctctactaaaatacaaaaaattagccaggcgtgatggcgggcacctgtagtcccagctactcgggaggctgaggcaggagaattgcttgaaccgggaaggcagaggttgcagtcagccgagatcgtgccaccgcactccagcctgagcgatagagtgagactcggtctcaaaaaaaaaaaaaatcattattatctcatatatatttatctaatctacttggatatttcttgaaacatttttgtagttttctgcgcatggatcttgcagatattttgtaagcttttcacctcacttgttcatatattttgttacattgcaagtggtacttaaaaacattaattacagtttttcattggtagggtatagaaattaaattgatattttatattgactttatggtttgtgacatttttaaattcacttaagttgttctagcaacatttttctttagatgttgtagataaaaaatcaatcatgttgtttatgaaaagggatattcttctttccaatttttcagtagatatgcctttagtttttttattcccttattatatgggctagaaattcccgtatgattctgaataagtgtagtgaatatggacaaccttaccttgtttcttatcttagcatatagtattgcagcagtaagtattatgttagttgtatgggttagcaaatgttctttatcaaatagagaaagtttccttatacttggtttttgttgaaagtgtttatcataaataaatgttaatttttgtcaaatgctttttcaacatctactaaaatgatcttattttgttcattttgtatactgatatgatgaattacagtgattgattcttgaatgttgacatagccatgcatttggggacaacttttactttcttatgatgtattatcattttcatatattttggattaaagttgctagtattttattaaagatgtttacatctatgttcatgaaagataatgatctcaggtcctctttgtaagatctttgtcaggtattggaatctgagtaatgctggattcaggaaataagttggaaagtgctctctgcttttttattttataaaagttattttctgatatttttgcttttctagtttttaatttttgtgggcacatagcaggtatataaatttatggaacatacaaaatgttttgatacaggcatgcaatgtgtcacaatcacatcataagaaatgaagtatccatcccctcaagtatttattctttgcatcacaaaaatccagttatactcttgcttaaagtactcttttagttctttttaaatgtacaacagaattattattgcactttaataattaatttttaattaaataatgaaattaaatacttaatttaataaataaattaaagtttattttgctatccaatactaaatcttattcattttatctaactattttgttatgtaaccattaaacatccccacctccctgccagcaacacactacccttcccagcctctggtaattatccttctactctctatgtccatgagttcagttgtattaatttttagatcccacaagtaagggagaacatgcaatgtttgtctttctgtgcctggcttatttcatttaacataattacctcaggttgatccattttgatgcaaataggatctcattttgcatggcctaatagtacttcattgtgtatgtatacaccactttttaaatccattcatctgttgatggacacaggttgctttcaaatcttagctattgtaaacagtgctgcaacaaatatgggagtgcagatatctcctggttatactgatttcctttctttaggtatatattcagcaaataaaaggcaaaattgcaaaataaaatgtaaaagtattttaatttcttttcccccagtttagaatgaatacacaaataaatgcacaatttaaaaaataattttctgccactggtattataagaaaaataaaattatattatcggcatgcttcaagtaaaactattgaacttaatttatgaagatagaatcttaggaaagtcaaaaattgctttagctgatgcaaaatgttgccccagtgctgttagaaaaagattgtataaggctttctaccttgtacttgccttagtggaaagaggcaagctctcttctgtgtaggttctagagcaaatctgtagttcttaaccttggtttctcattgaaattacaggtttaaaaatatttatctcagagttgcaccctgcagtagtcaaaactttaagttgattcctgtattctttacctctttgtgtacacaaactgtaatcatctattctccttgaatttaggtgagacctatgaatatggtagaatgtgactcttgttattaagttacattacatggcaagagtaaagatattttgtagatgtaataaaagccctagttaatttatcttgtgttaataaataaggagctgtccttagtatatctgatttaatgaagtgagccttttaaaagaggttctgtagatcatatacagaagaagtaagagttaaaagtagtatatatgttgtccttttggccttgaagaaacagactgctgtgttgtggaaccagaaccgggcacaaagtggctagcctctaagacctgagggtctcagtccagcaaccacccagaactgaatttgaccaacaaccactgagcttggaagaggactctgaaactcagatgagatcagagctctctggttggcacattgacttcagcctgttgagaccttgaccagagaaaccaattaacccatgccccaatcatggaaactgtgatattacgtatttatgttgtttttgtgctctaagtttgtggtaatttggtatgtagcagtctataaccaatgcacagtcccagactgattgaattgacatgaaatgaggcgtgagaatcacatttttttttttttgactcggagtctctctctgatgcccaggctggagtgcagtggtgcaatcttcggctcactgcaacctccacctccagggttcaagcaagagaataacatttttaaaaagttctaaatagtctaggccagtggcctggaccttggctgcatattagaataaatacagaataaatgcagccaaggtcaagacagaccactagcctagactatttatatacacttcccatttaaatcatggaaaagagatatttttttcatatcatgctctatacagcttaaatttttagatttttaattataaattgatcatttataattgtatcagtttatgggatataaagtgatgctatgatttatgaataaaatgaagcttaaatttataaataaactctgccttatggtagaattgccatcactgtagttaatcatttcaaatagcaatttttaaatatctctttgatttttgacagatagaatgatactttaggcatcagaattatcttaagaaaatatataataaatatatacatgtgtcagcaattattttccagcattgaatgagagaaagtcaagagacctcagctggattttttatgcttacatagtagaaaaaaatataatgggcctctttcacgaacagaatagcaacatcactgctagctgcttataaaacaacttttaaaaatttatttccaactttcaaataaactaagtgagaattgagtttttgtattcaaatataaaattgtaaaacatgattcatcctaaattgcaaatctgttcttgtgacagtcttccatggaaattcagcaacagaatatcttacttctccatgaccattacagttcttaaattatatctttaactgggctgtaacatcactcctccaaataacatagaacagtgattctcagtttgtttctgagatcagcaatatcagtatcacttaggaacttgtcagaaatgcagattgtgcagctctagcctaactctattgaatcataaactctggggatagaataggccaaaatatgttattacaaggcctccaggtaattctgatgcatgtaaaagttgagaaatattaacatataacaaacaggttgacatatgtttacactcacaccctagaaaactttttgccttggcgagggtctaaatacaaatctggaaattagtctatctactgctgtttctaaaccagagtcaaacaaacttgtaaagaaaactcctaaacaagtcaggaccacaagaccattacatgatactttgaatagtctttgacttatattatattcttagcttctcattcattctacaagtaagtagccaagatcatataccatgcattttctttatctgaagttataatagtgttactcttgatataaatatctgcatagaattctaaagaaatctacaaaggtaagaagaaagacatattcctatcagcctgctgtcttctaggagtccatttctccactttctgtcaacaacactcttcatttcctattccaaatttcccatcttcatgctattcatgtctctatttccttctgcttctgcttctgcttcatgcacctcatgtcacctcacattactgtaatttttcttacaatttacaattttcttacaatctgcctcctcttccttttaatggcaagatgactcgctcatctttttaggattacttgtatagacaacccaaattctttagaaaattctttagaaaacagaccctgtagtccaaattctttagaaaacagaccctgtagcaaagattaacactaacattttactggtgatgaactgagtgtgtaaatttctaggggaggaaggattcataaaagaaaattgaggcaagaaagaaagcaaatataagatagaatgttatcaagttgaccacagattcaggagaaaacataattgttccatggactatgaccatgtggctatatggagccattgcaccttggattagtatgtaggaagaagaaaagcagtggaatttatctaacaaaacctgcttctttactgtatcacactggttcaagcttggcacaaaaagcattaactccgtaaacctacaggtggtcatattgagattattcaggcaaccatcagaaaagcgaaattcccccaaatctttaaaacggcaacagggatggggacatatacatataggtacaagagaatctggggaggtgcacaaactagatcaaccaattgtacccctcctatctaattgcacactgagagtggaaatgaaaatcaaattatttccagttttaaacacctaaaaagttataaaagcttttatgactgttgctgtacttgttcctgaggctgcaataaatatttttttctccttcatcagcattccatatttctatcactctcttcaaacatttactcttctttaggatgcttgcctagcagggtgaaccagaaattcatcctgaagggctaagctcttagcaatcttgcctttgatgggctagcattgttaaaattgcccattttataccaatctctatgcatgtaaacattacgagatgccccagtcaaacctctaggtgagacatatattccttcctgttctaattgtgcagtagcattcttgctcttcacagttaatgtcatagagcgtttcctctcaaaatcatggcttccagccagtcagagcctaaaattgtgagacagtaatgacaaattgcacaactggatctgttagcgtgatgatgagatgagcgtatcttatatcccacctttattcccaaaccgttgtattctacctattagagctacaccatcatataataacatgcatgttgaggatgtatatagcacttcatgggtactgctattcatatttctggtgattagaagtctgccagtttgagtggtttccagtgcaaaataaggctctgattaactgcagagtgagataaaagctgccctgccactttgggcagtatatgtgctaatgattcacattgggcagtatatgtgctaatgatttgggcagtgtatgtgctaatgacgtgacagtatatgtgctaatgattctagcacgtcaaggatacgttgtagagtctctagcaggccccagtaagagagtcacaaaacagaccaccagtggccacttaaatttaaaataatcataaaaccaagcaaaaataattcactcaacaaaattaattaaattaattaaaaatacaattcctcagtctcacaacctacatatcaaatgctcaatagccacatgtgactagtggccactatattgggcagtgtagctataaactatttttatcattacagaaagttctattggacagccttgctctacataatgaaaaaaaaaatcttctttaagtaagtgaccaattgtgtggctattgtatcttaacaaagactgagcacctgatcataggacaccaagctaccaagtgatgagagctgctcattatgaagtgggtgttttcacgtccactgagttttaaattgaggctgagtaaataaaaagattgtaaatttggtccagaaaaagaaaaaaaagaagtaagagcaaaagaagttaacagttagaaaagtatagaatattagcaacggaaaggatctttgagaatgtattggtcagcttcaccaataacttgcagagctcttcaaggtgtacaaagattgaaagggagagaaaatctaaaattcagctgatatcacgatgggattaattcaaagtcatttcctaagcatctttccacaaaagcatgtagccacatttaaaggcagagaaagtgaatcaaaatctggaaagcaccatgctaccatgagaagagcagtattcacaattcatataacacacctcccaatctttcaaatagtgctaggaaggaagtttctaatgaggtaataaagcatatgctatgggttgaatatgtgcccgaaacggaaacttaatcctccaagcaacactgttgaaacgtgggccctttaagaggtggttaggtcatgagggagggctctgccctcaggaatggattaatgccataaacataggagtgtgttggttatcacaagagtgagttcctgataaagaatgaatttcctgtgctcctatacattaaacaagaattttgaaagctttaacacttaacagaaagttgaactctatgtagaaaacactttatatatccaattatccttctgaagcaatgtttctctgaagcttccacttctgatcaaatttgattttgaaccttttccttgtgaccaattgtgtaagccaacaaatacctctctgtgtttagtattttgtcattaggtgttaaattttctcctttagggggtaatcttatctgtattttttcaaagtttcttgtgtccttcaaatttttttcatggaataccttaaattttcactccccttgtcttcacacccacagccttgcagtgattagcaatggaaggtctactggaatttgttttattattctacctgcaggtaatttgttgtgcatggtattctttgtcttctaataatgctgaagacgtgtattatgtgtagttttatttgttctccttgatgatgttattttattttatttatttatcttttgagacgaagtctcattctgttgcccaggctggagtgcagtggtgcgatctcggctcactgaaacctccacctcctaggttcaagcgattcttcttcctcagtctccccagtagctgggactacaagtgcacagcaccatgcccagctaattttcttttgtatttttagtagagacagggtttcaccatattggccaggctggtctccaggctggtctcaaactggacctcatgatccacccgcctcagcctcccaaagtgctgggattacaggcttgagccactgtgcccggcctatatttttattttgttttgttttatgtggaggatgtgtgggtaaaatcaatatcatgtgagtatcattaaactccaaatccatggtataccatatctgaaaatttttttattgacccagaacacctgaaatcaaaacccaaatctctctgtgtattccaaatctgcttctcatctcctgctttccatttctatgcatatctttctgatgtaggcatttgttataaacattcatgttagtaatatttttttctgcattccaaaagtttgggtatgttgtgtctctattttcattcatttcttaagaaatttctgccttgattttgttctttacccaaaagtcattcaggagaatgttgtttagcttccaaatatttctatagctttgtaaattcctctcggtattcatttctaattttattccactgtgatctgagaaaatacttaatataattttgattttttgaagttactgagatttgctttatggccaagcatatgctcaattttggagaatgttttatgtgcagataagaaaagtgaatattctgcagttgttgggtagaatgttctgtaaatatctattgggtcaatttgggttggagcccagcttatgtccagaatttcttcattggctttctgcctcaacgacctgttagtattgtcagtagggtgttgaattctcccactgttattatattggtatcaatctcttttctttgatttagtggtatttgttttatgaatctgggtgctccagtgttgggtgcatatatatttaggacaagacaggtaaatcatcttgttgtattgaaccaattatcattatataatgcctttccttttcttttactgttgttaaagtctattttatctgatacaagaatggctactgctgcttgctttcattttccatttgtgtgatatatcttttcctactcctttactttgagtctgtagatatctttagctattatgtaggtctcttataggcaagagatggtaagatcttgtttttttatccaacttgccagtcttatattttaagtggagcatttaggccatcaacgttcaatgttaatgttggtatctgaggttttgttcctgtcatagtgtcgttagctagttgccctgggctctcaattgtgtaattgctttataggatctgtgagttttctacttacatgtttacttttatgttggggagtggtgtctttcatttccatgcttagaactcctttgagcgtttcttacaggtttgatgtagtggtgatgaattcccatagtgtttgcttgtctgaaaagactttatttctacatttatgaaacttagtatgacaagatatgaaatacttggccagcattttttttctttaaagcctaaaaattggcctctaatgtcttctggcttgtaaaatttctactgaggtgtctcttgttaaagtgatgggatttcctttatacgtgatttgatgcttctctctagttgcttttaagatttgttctttcatgttgaccttggagagtttgatgattacatgtcttggtaatgttcatcttgtatagtatcttctaggtgctttctggatttattgtaactggatatccacatccctagcaagattggagaaattttcttaaattattgtctcaaatatgctttccaaacttcttgctttttcttcttcttcctcaggaatgtccacatgtctaagttttggtcactttacataatcccatatttcttgaaatctttgttaatttttttaattcttttatctgatttagttaattccaaagaccagtcttaaatctgtgaaatttttcttctgtttggtctagtgtcttgttaaagcttccaactgtgttttgaaatttcttctgtgaattattcatttctagtagttttggtttttaataaataatctcctttttcttctccaaatttttttgtttcttgtgttggttttcaactttctcttagatctcattgagtgtctttaaaatatatattttgaattctttttcaatcatttcaaagttttcattttgtttaggatccatcgttaaagagctaatgtggtccgtcggtggtatcacaacattctttcttcgtaatgctggagttcttgtgcttgttcttcctcatctgtagaagctgtcacttcttatttttgaatttcctttcatttagatgggattttcctgccttgaggatgtgattgtagaatatgttatgtagggtcttttggctttgcttttatatccctgggcattttttcttgtgaagatttctatagggctgtgcagtttgacctacaggccagtaggtggcacttatggctaaaagccagctgtagcaaaagcagatgggtaggtacttgatctttgtttagtgtatggtcatttgtgttgtttcaagtgatgagctggacagtggaaaatccgatcccctgaacttcttgttcagcaaatggagaggacacagctttgaagagctgtactgcatggcttgctcacaaatacccccaatgataaggatggacaccaacactgataggagtggctaggggagttcctgatgacatgccctgaggtttctgtggggaataaggtgcttgcaccagctccacttcctaaacaggcaggaatctgatctatttctccatcatactcctgccccagggcttgtaactctcagttcagatgcacactgttatctccaggccacagtgctgctgagagccagggaagacgcttgtctgatgattctccacaggagtgattttagggtggaacctcatcactcagaccagtacaaatagctctgtggcttgcttgttctctaatgtggtaatgctgctgctttgtgtacggatggggagggaatccaccttttggcacatttgtaaccgctcaatgggttcaccttgtctgctgcctagacagaactgatttatcaagacaggggaattgcaatagagaaagagtaattcacgcagagctggctgtgcgggagaccagagttttattattactcaaatcagtctcccggagcattcggagatcagagtttttaaagataatttggcgggtaggagcttgggaagtgtggagtgctggttggtcaggttgaagatggaatcatagggggttgaagtgaggttttcttgctgttttctattcctaggtggaatggcagaactggttgagtcagattacaatctgggtggtccactggacaggtgatccagtccagtgcagggtctgcaaaatatctcaagcactgatcttaggttttacaatagtgatgttatccccaggagcaatctggggaagttcagacttttggagccagaggctgcatgacccctaaactgtaatttctaatcttgtggctaatttgttagtcctgcaaaggtagactggtccccaggcaagaagggggtcttttagggaaagggctattatcaattttgtttcagagtcaaaccattaactgaattccttcttaaaattagttctatgcccaggaatgaacaaggacagcttaaacgttagaagcaagacggagtgggttaggtctcatttctttcactgtcataatttcctaagttatgtttgcaaaagtggtttcacattcaggtgagtgtcagatgttgagtgtgttggctggttgggttggcctgagttcaggccccacagggagtagtcagatgctggcggtggtggactaggctaggcaaaccttccatcctcaggcctctggatgggatgtacaagatgtacaagtcctaaggggactaaaccaggaatgggccagtacacttgttcttggatccccagaattcacatgctggctgaaaggagtgggctgatccatgggtcaccatcagaactttcaggcaggagcaggcagaacgctcaggcagtggcagaatagtgggagccccagggcagatcacaggcctgtgggggttgggctgtcagaaggactctgggcagcagctgaaatggtcaggtgggaacaggctggctttgctgttaacttttcactggaggaatcaggccccctcagctagagcaatggaggctgacagctgtgggatgcatggtccacttgaattttcctcccacaggagcagcagtaaattttgctgctggggacacacaaaattgcccagcctttctgctcctcccccaacccaggttcaggggtgacaggagtggctgcagtggtggtgggtggtggtgatggcaactgctataggagccaaagggtgggtcactggcttcagaggtcctggctttcagtagaatatcgggctgcagccaatatgtacatacaggggcagggcagctgcactgcagaaccgtgctgaagaagggaggcctatttttcaaggagcacctgaggcaggcagtcattgcagtgcatggcccacccactcctctctactgcagctgttgtatctgtctttggggcatgcaaaagtgtctggcctgtctgctccctccctgatccagctgcagcagccggcaccaggcttctcagcattccaaagcctgcggaattctaggtaggcttgagcagtacctatgcactgtctccaggcagcaccctgtattagactaaaggcctgggaggagtagagggggatctcccatggctaggattgtacaagtccatggcagaattgtggaaccccaggggtctctcactcaccacttctctgtatcaggaatcttctcttggctccatgccagtcccagctcagctggctgtacagctttgctcctctctgctttctatgattcctatcacttctttaatggattccagtgtgccctcttaggtgatctactcaagtgttaatatttactcactattttgaattctgtctgtgtgggaggctcccactatctggttctattcagccatcttgaaccggaacctcagaattgagtttttacatacactaatcgcatgatctattaataaacacattattagttggacttcattaaaattaaaaatatgttatgcaaaagaccccgtcaagaggatgaaataataagacacagactgaaagaaaatatgtgccatacataaatttgatacagaacttgtacttaaaacatataaataactcttaaaactcaacaataagaaaacaatcaaccctactaaaattgggttctaagaagacaccacactacagaagatatatatatgacaattaagcatatgaaagatgttcaacaacatacttcattagggaattgcaaattaaaatgacaatgctatcactatacgtttattaaaagaactaaaatcttaaacactgacaacatcaactagtggcaacaaagtgaaacaagaggaactgtaactcttttgctggttgtaatgcataatggtacagcaactttggaagacaatttggcaatttcttataaagctaaccatagtcttaccatatgatccagaattcatgatcctaagtgtgtacctaaatgagttttacttctttttggatatgaatgcctttttatttctttttcttgcctgattgccttggctagaacctataagcacaatgtttattagaaatggtgagggtggacattattgtcttgttcttaatcttagaagaaacatattcatttcatcatttcttaaaatatgaaatgctatactttatttttccagaaagtatatctaagaatatctgtgaagagtaatttagagagaaagattcttctaggtttccttaaaactcttcagtacatgctatccataagtagtgacatttttataatttttattttttcagtctttcaccattaagtatgatgttagctgtagcctttttagtaaatttttaaaatcaggttgaggaagttcccttccatttccagttttctggaagttttttttttttttttaaatcaggaatagatgttggatttttttcaaatactttttctttatttattgaaataatatttttaagtctattaatatggtcaatgacattgactgatacttgaattttgaatatgtcatgaagtcctaaatggttgtgatatattatgcttcttacatgttggtgcattcagttttctaaaattgtgagcaatattgatcttcggttctcttcatgtgtaatttctctgtctggttttggtatagtaatgctgacttcatagaatgatgtgaaatatttgcttaccttctcttttctagaataatttgtgtagaattggtatagtttcttcctaaaacatttgctgaaatttaccattgaagccatctgcccctgaaattcaatttgtgggaaggattctaactacaaaatctgtttattaaatacagtgatatttaggttgtctatgtcttctttaattacttttgatattgtctttcaaggaattttcccattgtcaactaagttgtcaaatttattggcatacagttgtatttaatatgcatttatgccattttacaattcatcaaatttacagtgatgtctactctctcattcctaactttcataatttatacccttactcttttcttcttgataactttggctagagatttatcaattttatatatcttctcaaaaaattggttttacttgcaatgactttttttctattcattttctgtcttatactttatttattttcattttgatttttgttattttctttcttataattactttgggcttattaactcttctagtttttaagttggaagatgggtcattgacttgagacctttatagtttcatcagctaggcatttaatgctacaaactttcctctaagaactgctttaacttcttggatgtgcgggtttataattttcatcaaatttacaaaaattaagtttcttaaagctgtttcactattcaattatatttttatgtctttcgttttccctctgtgtttcactttgaataatgtccatcattatgtctttagggtcattaatagtttcttctgcaatgtctaatttcctgttattcctattcaatgtattttttttatctcatacatattcatctttttatgtagaagttcaatttgggacttttataatcttccatgtctcttcttaaaatgatcaatctgtcttctggaatttcatatatgaaatggaaatataacaactgctataatggctttgcctgtcttctaattttattatctatgctgtttctgagtctgtttcaattaaggaattttcctcctaattacaggtaatatttgccttttgctttgcatacatgctagatatgtttgtatttgtgtaagtatttttgatttttatcatggatgctattaaaatacttgaaaaaaaatctatttaggccttgatttcaaggtttttagctggaccaaaagaactattggtttatagctcattttaaccccaactggggcaagacatttttgaatactctatccaacaccccatgaattatgaagatttctactctggctgataggaatgggagctcttcctggtcctgtttagctccagcagttatatctctttaactcaaaaaggtcaaggagctccacactgcttactgattatgtctttcccaggaactataacataatctatttacttacttggttatatcattgccccaagaatttgaaaaaacatcattcattctaattaatgttgacttagagaataaatgtcatggggaacaacttacacagtatgttcaaacaaaagtgatttaccactactgccaaatggcaagagcaagactagaaaacctgaggtcttgccattgccagtgtttgattttatttcctccactaatacccagccatagctggaaaggaccactgtatttttatatcaagcatttctagaatgtaaaggactggtatttcctggctagtatgggctctctggccaggaacacagaagatcaaaaagtgacattaaagccatatggttagacattaagaacctgttggaattttctaggcagtgagtgaggttttctcaatgttcttcatcaatacactagttactaaggttcacaagaatcctatggagaacattctgtcaaagctgacaccttggatagtgtgacttccaacagatgggaatagtactgggctcatatattggctattgcatttcctggttttaactatatcactgaatacattaggttacttgcataaagctatacagaaatgaagaaaaacagaaaactagcaaatttctggcaacatatttagttataaattgagatttcaatagagttttcaagccaatttctattttcagatgtacaaacttagtcaatgggtattatattcatcactgctgacaagaacaagaaactctcactgctcatggtctcacttcatgtgacacaatgttaataggcatgagaggagcactgcccagagagagggcagacccactagggtttatggtccagtcagagtccttacatggaaacttatggtaagaggaaaaaaaaactcagaattaaacaatatggatagttcattgtttatatttgtttcagcaaaattctgaatgatacaagtgaacaaattatgaaatattcattgttatttcaaaatgtatatacttaattagaatggagtattttgctaagtgaactgacccatcacgatacattttctcaacttataaaaaataattttttaattgaacttggcttccctgtttatttcatttaatattcctttgatatttttggagaaagttcctttaggagctagtgaaactacctttgcaaacattatgtcagtgagaaaatgacagtagtaggggagatatgatctatcccaaccccctcttgcctttagtttccaagctgccttaattatccctgggcttaggcagagctaacttcgggagacatttaggtatagtgtaaacaataatagccctactgcaaaactcaaccacttttataaagcttaggagagaccacgaggccagggggaggagaggagcctgaattctgctaaggtgtagacataaacaattaccagtcattattctggaaatcctgcagataacaccacgaatgtagattgaccttttgagatatcttttcaagttttttgcatgtttgacacccatgactccacctggacccaccaatctatggctcctatgacctcactgggaagcaactcagtgcaagaggacagcttcaactccccatgatttcatctctgacccaaccaatcaggtgcaagcacttattacctggccacacccacccattctccaaactgcctttgaaaaaccgctaacctatggagccttcatggagattgatttgagtgatcattccatctcccacgtagcatggtggacctcacgtcaattaaactctttctttattgcaatgctgtgctctttatttgtgcagtgggcaggaagaacccatgaagcagttacactaggatatttgggtattattccacagtcaaagaaatccctgttcaagcttttttttctatcatttactagcagtgtgagtttgggtctcagttcatttatctgtaatgtggtgatgaaaataatatctcactcataagcctaattacattgtggctctaaactggtattattttagtgctaattgatccattcatcaccctcccgcatggaactgtgttgcacacaaaattactttaaatattttacctttcttgactcaaggcactgagttactggtgaacactgtgttttcttcatacattgtatactttcactattgtaaatgtttgtacagtatcatgatttgtttcagtctttaaatcagagatattttacttttaataattaatcaatgaaaattctttaaaaacatgtctgttgagcactgataaccattataggcacaggagacaaggatagatgagggagatgttatgtttcagccaaagggtcttacaatttactgggagagttgggaatgcatgaggcaagcaggagtgcaaaggagggagactaagtccttgggggaggagtattcaggaaatttttcacagagaaggtgaggttgttgctgagtatagaagttccagaccatcaggaagacaaagataaagggtatttctggcagagagaattgcatttataaaattatattgttatacaaagccatggagttttgaatgaattgaaactacgatggtatttgtatagcaaaatatatgtgatggcaagttggaaagttgagacaagagaagttaggccaaatcactgtcttgagtacatagtaaatgcattctcctttatcaagtattaacagtaagaacaataattattcatggcatcagactcagtattcaagggcagaagcatgacagcatgaaagagaaaaataagatacaatgagaacctagtttgtacccattttaaggctaaagggtttttaaatataatcatattgaattcacatataataacatagcagaatatatggtgaattccattcccatctaccctgccacaggctaagtcccatgcagaggttcttggagaaacacttttgaaacagagaactgtaactgtaggctgctgtgctcctgcagctgtaactgctgagtgagctaagaataccaattcttctggtatagaagagctagtatcaagtgaatataccaaaatttatatacatgcagagattggcattgggtaaatgatataacctctctagatatagttccattttaaaatatgaaggaatggaccaggtgatgtccggtatcactttctggggaaaaatgtattaataacgcaaaagatggtcaattgtactaaaacaacagataaaatcaaaggatgagctgacttattactttagcacaatgaataacccttagtctctacctctatagagactggaatcatagggatacataaggaatgaataatctagctggaaacagataagcaaaaagataactatagtacctgcttgtcaagataaaagtagagggtaaggcaaacctctcaggagaggccccaaggcataaccaagtgtggaggaaatcaatgaagacttccaagaagacacttgcagtaagtttctacataagaaagtgagaagacattctcttgtctccccagctatattcctattattattattccctatatgtccctgtaagcctaatccctatataggtccagatccaaaaatgaaggatcattcattttgcttaagcaataagtggatccatcctatgagtttctctgtggtgctaggcacctgtgcagtgacagcagcaagtgcaaacattggatgatcagagaatcgggagtattcaggaaacaagaaggtgctgcagagggctagaacaaagggaacaaggggttctggggtgtaaaaagatgagtctaggactagcaagtgccagctcatgaaaggttatgtaggtcatactgggaaattgaatttattctatatgtcatggggtgccatggatgaatttgtaagcatagagatcacatgaccacatttgtattttggaaatctcctttttgaacatgagagaataaatgatgaaggaacaggtgataacatatgcagaatttcagatggcaattgatgagagccagtactaataactgaggaagtggaaaataaatgtaaagaaaacacatttgatttcaagtttacgattacatagtagaatagtctagatatggtgactgtttaggtataggaaagaagggaacagaaagacacaatatccactccctagtttctggtttgatcattggggaaatggtaagggaatttactggaataatgaatttagtttagtttttttctccagaatgtaaactttattttctgtccaagattagttcatccatctgtgatttggattcaccgctcttgtctcttcaggaatttcagctcaatattatttcttcactgtattctcaaccagttgcccatttaccctttactctcagtgtcacatattaaaaacaaaacaaaaaaacattttaaaaatgcctacttatctccatgttccacctatttccttggttttttttaagaaattcttccatcatttcacactttttcttgaacaatctactttattaccatcttctgtttaagaccttgatatagcccattcagtctgatgcttgatatcaactcttcagccctaattcctgttatctttcctcttctgtgactcagattcactcttagatcttatttgcactcgctttagctcatctcatcctccaaatacagaatctgcttcagcacagagcatttacgataccatttcaacccattatatgagtttcaagcatgcatatattttggcagtctacatttgcgtctcatctcctaccatcacctgaaagctgatgactccccaatatcgagtctaactagatctctcttctgaggatcagacctgtgtatctacttgtttggtgtcacctgcatctgaatgcctgtacaagaacttcatattactcatgtccaagcttaaactcataagtgtgcatgcacacacacacaccacaaaatattttgcaagatgctacacatatataaggacatatgtgaaacacattagagtggatatacaattaaaatagcacaaagttttcttttttgataggattattaaatctctagatgaatcaggaaatttgggcatataattaacaattctatttgaaactatatctaattaactcatcaataaagaacttcaacactgccaaaataaaatcagaggttttttttttgagccataatggtgaaaaaaacaaaatgatagcaatacttcatgtaaaaaaaaagtgtcaagacttaaattaggataaaattagttcaaccctttttcaacatgcgagtgttcagatttttcttctagagagatttcaatgcaaaatagcaggcatattaattatgaaagtataaaatgatgttatcaagaaggtgtcagtgtgggttgagtgtgagtcatatagttaagaggacagaatcatgtactttataagtaaaatgcctatatttgaatccccagtttatccgattgtagctgtgtgacctctgacaagtaatttattcactttaccttagtttcaccatctgtgtaatgggtatgatttgatactcaccttctcaggttgttatagtgattaaatgagtctacatgtgtgaagattttacaacagtttaagtgctatgggattgcttaatattattattcataaattatttttccaataccaacattatatcaattgaaatttgtctattttgaggcacatttcacattttctattttgaaactagtttctggctttcaatataagacagccagaagatccagccatttgaacttggatgaaataatctacctgtacaattgtaaaggagatttttgtttgcaaatttccttgtgtatgagtgggaaaaagtatgcaaacgtttattcacaactttttgtaactgatggggacacagctttatataagtgatgtaagcaataataaagatttcagaagacctgaatatgagaagaagactttccctgacacttcatttactataagtaagtcacaacttctaaaattttctactaattttctactctcacttctgagtgtccaacctgccagtaacagagacaaacacccaaaacgtaacatggcattattgtgacacagagggtaatgacctaccaggcaggtcaattataaaaaatttcttacatcactaacggagcagtgagttgtcctcttatggatagacacttactctgaatatggatttgccttttctgttcaaaatgcttttactgatatcaccatcaatggacttacagaatccctcatttatcataaatagtatccacacatacattatacaaatttatttcacagaaaatgaaataaatggatttcatcctgttcattcactgattttaccatgtaccacaacatagaataggccaaactgcaaaatagcttattgaaggtttagtatgatgcctttggttgacgatactttgtgagtttgggaatctgcacttaaaggctcagtatgtgctctgaaacaatgatcaatatatagtgccatttgttttgtagccagaatacacaaggcattgtaccaagaggtattattaccagtcataacacacgcatacaaatgttggttctagtctcaacaactttggtctttcctggtgtacagtgttaatccccccctaaaagaaatattaggttgacgcaaacctaatacttccacaagggccacaagaatccttccaataaagataaagctgaaattaacacctgttctatttatgattcagggtgccagttaataggaaaacaaaaatattctacttgctttgttaattgatcctgattattaacagacaatagagtggctgctagacagtgggatcaatgtggacttgtaataagtatgaaaatcaagtgattttctagaagacttctgtgtaattctgggtctaatggtgaaagttgatggaaggcatagcaattcaatgaaggcaggagctgcaaggattttgacactttaggaataaaggttttggttcacatctctagttaaacaacaatgatcaagttaagagcaagagaaatagtgactaagtagtggaagaattaagttattaatgccaactattgtattgtgacatacagaaatcaacactttagatttaagcatgttttattctgcttacttcgttacatataatatatatccactgtgcatatatataaaatattatgtttatattcaaatatatgctattccatatatgtaacaaagaaagaataataaacctatgttctctatattctttgtctactatgttctataattaattgtagataaacttatatcatcttaaaatttaaaatgatcaaagagtgtttgtgacaagtagagaaggaataaacatcacccattaatggataaatggataaagtttgttgggaggttaggattttatttcaggggtagaaagtgacagcttcttttttttttttttttttttttttctgagacagagtttcactcagtcgcccaggattgagtgcagcagccgcgatctcagctcactgcaacctccacctcccaggttcaagggattctcctgcctcagcctcctgagtagctgggattacaggcacacgacaccacacccggctaattttttgtatttttagtagagacggggtttcactatgttggccaggctggtctcgaactcccgacctcgggtgatccacccgcctcggcctcccaaagtgctgggattacaggcgtgagccactgtgtcctgccagcatcttctttacatcagaaatagtcacatcatgttatgtgaaacaggatctattgctatttttttcatttgaaagttaaacataggcaaaagagtgtacatgtatattgaattgactaaagagtagcccatgccagattgactggttcaaattgacataatccacatactgatttacacttgcttcttcaacacaggaggaagattcaaaactataattctgagactccactgaaaacagaatttagggcaaaattgtgtcaataagaagaatcagtatgatatttggaaagtggaagagaaggtcaagctagtattctctagcagcattataggcagtcttgagaaactgcaaatatgaatttgcagtaaacctaaaattaactgctattaattacttactttagttcaataggcagccatgaccatcatcagtggcttttctgtgattcctgcatttccagatcccatgaaaaccgaaagtgttctttcaatgccttttacttctacagcacttgtagtgattaatactcttaagtctctatattaaatttctttctacttgagatggttagggtggcatttgtcatggtaatttctaatgcatacaggcatggatctatatcttatgctgaggagaacgcatttggaaagttattttaaaaagtcatcatattaaatcaaaattacaattgaaaaattcttagaacagtgacacattagggaacaaaaaaaaaaatacctaaaaggttcaatatataatttttaaccatgtgagcatgttgttgctttattaaacaccagatgaagttaatgacttgcttttagaagtcatatatgaaaaatgcatatctttaaacaatagaattttactcaacacaaatagctactcactttaaggaaggtatgcctgaactaggacgagtcaacgtaacagcattgttataacaatgttgagccaactcatgtttctcaccttattttttcggtaggatgtacgcacactgattgagatagtatttgaaataacctcctctctctctctctctctctcatattagcacctctcactcttactttcattctctgtttcctaaaaccataaagttgaatttgccaaaatgaaatgtgtgtatgatttatgtctattgattatcgttttgttaatctcccctctatgcctttgaattatttattcctgttatttcaatatgaatatattataacctagaccttgactaatttaagttttatcaggaaatctgttgctcaaattataccttattcttaagtttaatacttgggatcaagtaataattcaacattgttataaataaatctttaatagaattttatatgatatagattttgagttcacgtttagtaataaattttttgggggagcagagaggagcacactaaagtgaaaactctacatcacaaatatgtttctatttaagccttgcagtggagtccccaatgtggctgtgtcaatactgatcaggtagggtgtcagaaattaccttgcttaaaagctaataagctagcctattactatttcaaagctagacattttggtcagagataagaactttattactcacagcacaattgacagcataatcatcagaatatttatgacagttcttctggctcaagttctacaaggacaacacagatgagcccaaagaaacgcctgcctatacagtgggttgcatttcagagaagcagcttcgaacatagggtatgtgaatctttttttataatgagcagtaagcatgcctgccctttgatccagatgaaagcactgtctttattgtagagtaatatattgtcttttgatccaatgtaaaacactacctctattttccaaggttattcactatgcaagcattcctgaagaaatagtaagaagaaagacaatgtttttgctcacgagatatacagacacatgagagtcccttgaaatattgtctcccaacaagctgcctttgtagtctgaggccgactgcttcatcatgacttgtttttcactgcctgggaaatgaattatcgatgtactgtctaatgaaatattttttacttgaagtctttatatttaatcaaaaatctaaaaaaaaagtgccccatgaatttaaataatgtgaactctcagaaattgtcaataaaaaaaaagaacagtagctttgacatttacttcctgaatgtaaaaatcaaaatggaggcaacaaaagagtttagtcaagattcaccttctcctgagagacaaaatcctattcaactattaccagatacacacaatgcccttctccttatatcagggaaaatttttccccaaagaaggcaagttctataatgtatagcagagtgatctctggacaagcctgtgtttcttggtcaataaaagttggattgaggagaaataataccttacccctactttgtttataaacaaagtagaagatatggatccttttttatctcagaatacacacacacacacacacacacacacacacacacacacacggagacctacaattactgtgtgtcaaatacgtacatatgtgcacatgtgcatgcatatacacaaacatacataaacaaaagataatacattctatttttttccatctgatgatcaatttgattcaaaaataataattttggctcttctctcctccttaccattttatgattttaggaatgagtaacagtgaggcaagaaagactgtcatatcaatggtagaaatacacaaacataaggcattgcctaccacaaatccatagcaaaagcaagaggtagaatgtttatttcaatcctgtgatcagttacaagatcagttactaggcacctttctcattgttgaggatgtaacagtaaaaatagtagggtaatacaagtagaggaaacactcattagacctgtaaagacattttataaacatggtaactgacagactgacaaaaaataaatcattccaatttcaaatttctttggtcaagatgaatgtggctcataacatgatgcagaatgaaccaataaaatggcaaaacagttaagtctctgtgttcagaaggtagttttgactggacttcacattgctctcacacaaagggcacagaaccacagggcatataggtatcatgtgggtatagatcctctttgctggtccagctgtgaaattgacactgcaagtaggggctgtgttctaccaaccacctggtattcaaaaacataccaatcatttatcaactcttaataggcaacatctatatggatattattgtcccagacattattaagtgtgcagcaagagactcaagctctggggtttaaatttctgaggtaataatcaacctctttgtattagtccattctcacgctgctatgaagaaatacctgagactgggtaatttataaaggaaagaagtttaattgcctcacaattccacaaggctggggaggcctcaggaaacttacaatcattgcagaaggggaagcaaacacatctttattcacatggtggcagcaaggagaagtgccgagcaaaaagagaaaagccccttataaaaccatcagatcacacgagaactcactcagtatcacaagaacagcatgcaggtaaccgtccccatgattcaattacctcccacagggtcccttccatgacacatgggaattatgggaactacaattcaagatgacatttgggtggggacacagccaaaccatgtcattctgctcctgacccctcccaaatcacatgttctcacatttcaaaacacaatcatgcctttgcaacagtcccccaaggtcttaactcattctggcattaacccaaaagtccaagtccagagtctcatctgagacaaggcaagtgcctttcgcttatgagcctgtaaaatcaaaagcaagttagttacttcctagatacaatggggttacagacattgggtaaatacacctattccaaatgggagaaattggccaaaatgaagaggttacaggccctatgcaattccaaaatccagtgggacaatcaaatcttaaagctccaaaatgatctcctttcactccatgtctcacatccaggtcacactgatgcaagaggtaggttcccatggtcttgggcagctccaaccctgtgactttgcagggtacagcccccgcctcctggctgcttacatgggccagcattgagtgcctgcagcttttccaggaacacagtgcaaactgtcagtggatctatcattctggggtctggagggtggtggcccttttctcacagctccactaggcagtgtcccagtgagaactctgtgtgggggctctgaccccacatttcccttctgcactgccctagcagaggttctccatgagaacccctgcagcaaacttctgcctccagacctttccatacatcctctgaaatctaggcagaggttcccaaacctcaattcttgacgtctgtgcacccacaggcccaacaccatgtggaagctgccaaggcttggggctttcaccctctgaagcaatggcctgaactgtacattggccccttttcgccacagctggagcagctgggacacagggcaccaagtcccaaagctgcacatggcaaggggagccctgggcccagcccacaaagccatttttccttcctaggcctctgggcctgtgatgggagaggctgccatgaaggtctctgacatgccctggagacattttccccattgtctttgagattaacatttggctccaagttacttatgcaaatttctgcagcagacttgaattcctccctagaagatgggtgtttcttttctatcacattgtcaggctgcaaatttttcaaatttttatgctgtgcctcctattgaatgctttgctgcttagaaatttattctgccagataccctaaatcatctctctcaacttcaaagttccacagatctctagggcagaggcaaaatgcttccagtctctttccatagcaagagtgacctttactccagttcccaacaagttcttcatttgcatctaagaccatctcaacctggacttcattgtccatatcactatcagcattttggtcaaagccattcaacaagtctctaggaagttccaaactttcccaaatcttcctgtcttctgagccctccaagcctctaggaagctccaaagtttcccacattttcctgtcttcttctgagtcctccaaactgttccaacttctgcctgttaccccgttccaaagttgctaccacatttttgggtatttttacagcagcaccccactatctggtaccaatttattgtattcgtctcttctcttgctgatatgaagaaacaccagagactgggtaatttataaaggaaagaggtttaattgtctcacagttctgcagggctggagaggcctcaggaaacttataatcatggcagaaggggaaacaaacacgttcttcttcacatagcagcagcaaggagaagttccaagcaaaaggggaaaagccccttataaaaccatcagatctcatgagaactcactcactctcatgagaacagcatggatgtagccacacccatgattcaattacctcccactgggttctcctcacatgtgaggattataagaactacaattcaagatgagatttgggtggggagacagccaaaccatatcactcttcatactattagttgtaatattggtatatattttaatctatgtaaaccttaacttcatatcctggaagaagaagtaaaaaccatgtgtctatgttgtctgaaattgcatcctggtatcttcccttaccagttgtgtgaatttatgctaattatgtaatctctctgggcctcagtttttgtctttatttgtttttgagacacagtcttgctctattgcccaacctgaagtgcagtggtgaaatcatacctcatggcagcctccaactcctgggatctagagatccttgaacctcagcctccaaagtagctaggattacaggtgtgcaccaccattcccagctaacttattttttatttttttattctcttgtggagagagggtcttcctatgtttctcaggcttgtctcaaactcctggcctgaagtgatcctcctgcctcagcctcccaaagtgttaggattacaggcatgagccaccacacctggctctggacctcagtcttattggtcataaaaatggtggaagaaatagtattgacctaatagggctgttgtgagaatgcaatgagttaatttaatacaagaaagcacttggaaaagtgtctggctcatgccaaccatgttagtaggaaaacataaaaagttcaataaaagaaatggtttgttattcaaagtaggagacacagtattttagctgaaaaagttttaaatacaggttgtagagatatgacacacacaactagataattcagtatctggagatgcatatggcaagacattgcaatatcaaataaatgataagaaaaccatcagtgatgtgggcacccagaggaaggagagatccacagaaggacaagagtatggaaaaccttccaagtggaagagtctcttgtggatgttgaaacatttttggcattcaaatgggtgatgaagccatgagataaaatttacaattgatacagaacttcatcatgacctgacttctcaccacctctctgacctctcccttgccttctttttaccttgcaatcagtatgcttcaatcactatttccccttttgatttaataaagataccaaatcttcctggcatcaaagcaacacatatgttctatgtgcctggaactttcttcccctactttttgtcaggtaaatccttctcatactacaggtctcatcaacaagaaggctattcttaccctctgccttcaccagataggatggcttcctgatacagtctgcactccctcatagcactatcaccaattgtaaatatttatttttgtaattatttgtttgatccctacatttccctatagaatataagtccactaagggcataagcagtctccactttattaataactgattctctgttttctagcacagtgtttgatatggcataggggctcatttaatcatcagtattagttgaatcaatattgttaaaatggccatactgcccaaaccaatctacagattgaaaactattcctattaaactaccaatgtcattttttcacagaattagaaaaaacatactattttaaaattcatatgaaaccaaaaaaaaaaagaggggctaggagttgaaaagcaacctgttaggtactatgctcactacctgcgtgatgggttcaatcgtatcccaaacctcagcatcacactatatactgctgtaacaaacttgcacatatagcccctgaacctaaaataaaagttggaataaaaaaccagtatttggggggttaatgaataagggtaaagaggtagaataatgcaacagactcagaaaatattaacacttctcttggttttgctattaactaataatagtcacaaagtcaaacacagtattaagttttattatacattacttctcctcaaaacaacttccccaggttacatgttaacttccccaggttacatactattatcccaactttatagatgagaaaactgatgttaggaagctgattatcttgattaaaatcacacagctaagcctaagttacaaaatagaccaaatagtgtggggccttggaaaaaacatgtgagggttttacacaaagatatgcctgggttttagtcatagttctgtcccttactagtcatatgtctcttgtaaactaagcttctctaagcctcatttttctcaagagttagatccagtgctgtcaataaattagaaataatttatctgaagtacctagaccataattggtattcaatcaccaattatttgcagggagctggtaatatatcactagggggaaaaaccgagatacatccccaagtggtgatagataacttacagaagtggatgagatctccaaagaggacagtataaaagagtcagcacagcagtcctcagagacttaacatgaacattaaggtaatctgtaaagttgaatttccccagtgaattcacacccttggtagtctcctctgcttgaatcatggctgtttctgtattttacttaactagtagaaagtggcaaaagtgatgctcttcaagttctgagcctaagactaaagagcaattggaaagttgggggacttctgctcttcttattgtggacaccctgagcaggagtcctgctggagagaccatacggagagacttggtggagaagtcatgtggaggggtaggagcactagtactatagaggaaagaaaggagagagagaaagaggaaaagagagaatgtgagagagagagagagagattcaggtatgttgatgtctcagctgaacctagccttccaacttccacataaacccaagaagccagacctgggagtgaaacatcttggacgttctaagtcacaatgtgactacaacagcacaagacgtgtcaagtgagaatagcaaaagaaactgcccatctgagttccagtcaacccataaaactgtgaggaatattaaaacaactgttttgtcatccattgttttagagtagttggttatgcagcaatagataaacaaaacagacattaaaatgctgtatcaatttttacctataggccatctggccccagtgtttttctgaggaaaaggacttgtcttaggaggatgatagtcctgttcataatattattctcacaaataaaagatttattagcttgccctattttcccattatgggctggtgatttgaaatttatttaagccatgcttgaatgtattcatatcttccgtctgcataacttttgggcataagtattacatatgtctacaatccatcatgccaactgtcctttctacaattctcaaagaaattattttaaatgctaaatattgattctattttgccttttaagccaacattctccaaagaaaagacaaaagagattgaaagaaaatgagataatgtatctgtaacattcaataaaacatcccatgatttgcacttttgaatttgacttaattacttattaatatcctagaattcacataataatatctatgatgaagacagtttatctagtttgtgacaaacttctcaatctgttcaccttccttatgtaccagcctccctccatttcaccatgaaatgctagggtattgcatgatcagagacacgtgtgttaactctacattactgccttatgtttatgtcagaggagaagctcagatctccatattattattggaaattttcatctacaattactttaagatataagtattttatcaaaaagaattttatctgttcttgtttgtctatctcctaacttcagagaaggaaaggctctccccttttacagatagccattgtcatattccagggatgtaggactttcatgacttgttttacttttcttaaaaaacttctacaaatttgtggctgcagatttggaggaccagggcaaaatgagggaggaataggttagaaaagatgagaataggaagaaaagttgagtttgctctgaaccttattaagtatggcctgagtggagaagttagaagctgactctgtgtagggcaattaaaaataaaagctggaacttctgtggttcaggcccacatgtgaactaaagagagggggaaggaagaggccaggtatctgatgaacaataaagcagtgggtgcatatgtggggtcaaaaaaggaaagcaatgagtcaaacctcaaacttatgcattcaggtgtcagtgggtaaatgcatagaataagaaatagctgatggtcactgatggaggtcatcaggggattagtggaaaccaaagaatacattttaaaaaatgaagtacaattaactaggaatgatcaaacaataagagagacaatccttctctaaaacatcctgactctcaccctgctctcctttgttatttctgggcctagaacaatttccactttcaattaacttgctttataaaaggaatgaagagtgactctatctctcacataccttgctctgcctttgttgtaatcagcactgtgaattgaaatgccttatcaaataagtgtttttgaaggcaatagacaacactgttggttgacaaagcagtatcataaagtcacttgctgtttctgcttggcccctgcacaagaaaccacactttgctccttccaaaataaggagaaatgaaatgatcctttgtggtggagggaatttttaaagtcatactttatattctgcctgaagacaaaattaaatcacaattcatgagtggtttagatcatacacagggctagagaacagatgaacatacaggtaataagacaataaatgtttaaaactgcatataacatcatcagctaaatggcctttgaggaccaatgttaagtaacatttagtgcagaaagggatctacaatggaactattaccaatccatgcattatctatggagatctcaaataaaaaagctaactttacagtttaagaaactgaaggaagaaaaacaaactaaacccaaagttagcagaaggcaggaaacaataaaacatccctttgtataccttaaatagatacgatgtttatttttcagttatacttcaataaagtttgaaaaaaggaaagaattctccccagtttatgaactacatatacagattcttatataggacactacaaaaatactcaaccctgtggagagaaaataaatttatcttgcttgtccaaatcaacttattggtagttagtgtcagagcattgagtaacagtggattgtgaggctctacttggctcagtggagaggaaggcagtgaaaagagagctagggtgactgagaagatggtttggagggtgtaggacaacaaataccatatgtatgtatgtatgtgtgtaaatatatattattatatatattttgtatatgtataaagtatttatttatttatttattttgaggcagagtctcgctcagtcgcccaggctggagtgcagcagccgtgatctcggctcactgcaacctctgcctccctggttcaagcaattctcctgcctcagcctcctgagtagctgggactacaggcacatgccaccacacctagctaatttttgtatttttagtagagatggggtttcaccatgttgaccaggctggtctctaactcctgacctcaagtgatccacccgcctccacctccaaaagtcctgggagccaccgtgcttggtctttatttatttatgagacggagactcactctgtcgcccaggctggagtgcagtggcgcagtcttggctcactgcaacctctgcctcctaggttcaagcgattctcctgcctcagcctgccgagtagctgggattacaggcacacaccaccacgccctgctaattttttgtatttttagtagagacggggtttcacgatgttggccaggctggtctccaactcctgacctcaagtgatccacctgccttgacttcccaaattgctgggattacaggcgtgaaccaccatacctggcctattttatatatatatacatacatatatatatgaatacatatatcaatatatgtgtgtgtgtgtgtgtgtgtgtgtgtgtgtgtgtgtgtgtatattttttttttttttttgagacagggtctcactctttcacccaggctggagtgcagtggcttgatcctggctcactatacccctgacctctctgggctcagatgatcttcccacctcagcctcccgagtagttgggactgcaggggtgcaccaccatgactggctaatttttttatttttcgtagagacaggatctcactatgttgcccaggctggtctcaaactcctggacccaagcaatccacccaccttggcctcccaaaatgcagggattacaggcatgagccacgatgcctaaccacagataccatatattgaaaatttttctcaaattcagtcttcaatatttagagtgggaccatttaaatagatataaaattgggggaaaagcatgttttcatgactgatagaaacattcttttgaatgtgtcttaactagtaaaatcagcatgtctaataaaacaaaagaaatccactaagtaaaaataatgtcaggaagagtaatatttgtcagtgaacattcagcattgccaagggacagagatgttgatatctctactttcatgtttgctccctagttgtcctcaatacaaatggcagcattattttctaagagtcagatatcacccttttattagcaacactctaatgactctctctcccactcagagtcaaagtcaaagttgtttcaatgatctccataactctctaagatctgaatagtcatcgcctctctaataacctcttctattacttctcactcatcatgttgcagccacatctacctcctggatattcctctgactcaccagacatgctactgccttggggcccatttttaagctatttgctctgtctggattctctattcccagaattcctttccaaatctttgcttaaatatcaccttctcaatgaggttatccctgattacttaattccccttaacgctaccctatcttctttaccctgctccaatttttactgtttttcatatcacatattaccttcaaatttattatatttagtgtttctaatatgtctgcccacacctaccacctctagaaaaatgtgatcttcaaatgggcatatatctggcctatgatagtacttgatgtttcacagatgctcaatcaacttgtgttgaatgattgtgactatattctaggataaggcaatttcctggacctttccagatgttaggcataaatccccttaaattgtgttgcttatctcattctcagtttgtgtcacaaagcaaactgatgtattattcggtttccaaaatgcctggagagtggaaaatgaagctatggataggggattaacacatgcctcttttactttattagacatgatggtatctggggaaaactattctttattaacatgaataagtaagtttctctttaacatactagtttcatgttatttagtgtaaatctactgcaaattgaatagtcacctctgggcatattaatttcattcttttctatgcctgaaaaactgaggaggggaaaccaggttctagcataacatgacttataccaagtgctaatcctgaaaggatgactggtttgcagccttccatgacatccaccaccgcttttcaagcttttcctgaccctgcaggcatgggagataccgtaagtaaagagaccaaagattaattattctgcaatctgaccaaatgttgaaagtttaagcattccattatctaattaatgacacagacccacacagtgtgctaacatagtgtataggtttgaaaagtaccatgtgactgttatagggttcaggctatggtgcaagataaaggtagtgattcttgactagaccataaatataaagaggaaagaagacacatatgtatggatagaatctacacacagagatccctgaaaatcataacttgtgtctatttcattattttctagctgatgtgtctgcctataacccagatgattctactgctcattggatattgtctcaggatgtccccatgtataatgtcaactattatttttattattattatttatcagagcaatgccatcaccatctttagatgctgttgagaggaagccagcactatttgggaaaagatcaacaatattaataggggaagagggaactgaagatttgtaaatatcaagaagaaatagacttaccctgatgaaagtcagaaaactgggtataatatgaggtataaatactaattagccttatatctttgaccaatttatatcctgtctctggacttcagctgaaatgtctgtgaaatgaagatactgagttagataatttctaaggtctctggagcctatggctgtgttcatataatgctgatgttacataaaagagcaaggttagggtcagtcttgtatggggacacacaagatgaaaaattaagcttgcattaataataactatgacttatatagaacatccttcataccaagaatccacagtaattgtcagcttacaaaaaaaaaaaaaaaaacgatccagagaagctgcccatagactcatggctaatatgaagtagagtcagggtcataacttaggcaatctggtccagattccatgatcttagttgtcctcctcactgctttgtgcttaaaactaatacctatcttttatctgtcagtaatagtgggagggaggccattgagtagctcaagagttttcagtaatttatgttatacaggttgagcatccataattgctaaatgctccaaacttcaaaactttatgaacacctacttggccccacaggtggaaagttccacacctgatctcatgtggtgggtcatggtcaaaatgcaggtgcacaatgatgaagatgacatggttaacactgcagaaaaaagtgcctgtacatgacatggtgaatatgtgtgattagcttattgaaggacgagatccatgtgcattcataacaaagtgcaaaatcatatcactttataaaaatccgagagagacttctaagacaaaaaccttgttaaataaggccaatgactctggaggaaacatttttaaaagccatatagcagaatgtctcctcatccctagaggatacaattcctggtccctcaactgcttctgatgtttcttctcatctaaaaaacgaaaatacagtgtacaataacattttgctcaaaacagcattgtaggtggagtctgaaggcctgccattgtttgttgttgcagtttttaaacaactgatacaactatactgaggatgctattacgctgcttagctaccctgaacacattatattttcactatactaagggtatgtcatattttttatgtatgtatcggtaagtacttatgtatcagtaagtgtaagaaaatgattgcttatgggtagcatgtaaattcagagtcaggaatgatgatggtgatgctaaacaatcacagactgtacacatgagtgactgagatagtgacacttttgctttctgatatttcaatgaaagaaattttcttttatgcacaaaattattaaaagttttgtataaaattacattcagaagatttgtataagatgcatataaaaataaattttgtgtcttgatgtgggtcctatcctcaagatatctcattatgtatgtgcaaatatcccaaaatccccccaaaaagttatccaaaatccctccaaaaagttatccaaaatccgaaacacttcaggtcccaagcattttggataagagatactcaacctgcaatagttcgaatgcgctaagaaaactacaaaatacattattgagagagagaagaaaaaacaactaaattgaccctaatcattcctatccctaagggaggtaagttaagagtaaattagaaactgtgtttgcttttggctgatactctgaagctttgatatgtgcatcaggcttcccttggccctcaggttctcaggtgacagtttcacacctttttagctccttacatttccaagcaccttgttctaatttttggaggttgaccttgctttctacttactgactgagaaattctagaaccttgtactactaaatcttctccctgccagcatctgtgttcttgcactctgccttaacttatatggctatagataaactttctgtgctgctgttcatagccaatatctccaccttcatcagtagatcccattccctttctcctacttgaggctattattccagcaactttatcttctctcccatatcatcatttttttttatctttcaacgggataattcccattatatttacaaatgtatattattaatttcatctttttttttttttttgagaaagagtttcgctcttcttacccaggctggagtgcaatggcatgatttcggctcactgcaacctccacctcccgggttcaagcgattctcctgcctcagcctcctgagtagctaggattacaggtatgtgccaccacacccgtctaattttgtacttttagtagagacggggtttctctatgttggtcaggctggtctcaaactcccaaactcaggtgatccgcccaccttggcctcccaaagtgctgggattacagatgtgagccactgcgccaggcctaatctcatcttaaaattatatcttgcctcacagccactacctaatttctttgttcctatttgtagcacaattcttcaaaattattgtccattctgccgctactttgtctcggccagttctctcttcagtctcgtctacacctctctccctcactactcctctgaaatggttctcatcaacgtcaccactgacctccacttgctgcatccagcaaacaattctcaactttcttcatttttaaaaacttttcatctttatcaaggtgtaactgacaaataagaactatatatttaagttgtacaacttggtgttttgatatatgtatacattttgaaagatcattacagtgaagctaatgaacatatctatcacctaacatagttaacattttttgtggtgaggacacttaagatcttcactctttaaaaatttccactaaacaatattgtgaactgtaacccccttgctgtacattagatttctagaactcacttatcatgaataactaaagctttgtaccatttgagcaacatctcctgatttttctctccccactacccctggtaaccaccattctattcacagcttttatgagtttgactattttatattccacttatacgtgagatcatgcagtatctgtctttctgtgtccagtttatttcacttaatataatgttatccaggtacctccatgttgtcaaaaatagcaggacttcctttttctgaaggtttgataatatttctttattttctttatccattcatccttcaaatgacatttaggttgtttccgtatttgggtattgtgaataatgctgcagtgaacttaagagtgcagatatcggccaggcgcagtggctcacacctgtaatcccagcactttgggaggccaaggcaggcggatcatgaggtcaggagatcgagaccatcctggctaacatggtgaaaccccatctctactaaaaatacaaaaaaattagctgggcgtggcggtgtgcacctgtagtcccagctgctggggaggctgaggcaggagaacgcgtgaacctgagaggctgagcttgcagccactgcactccagcctgggtgacagagcaagactccttctcaaaaaaaagaaaaaaagaaaaaaaaaagagtgcaggtatctctgtccaatggaacaaacagaatagagagaacagaaataaatacacatatttacactaaattgagctttgacaaaggtgccaaaaacacatgaagaaataatattctcttagaaatgatgttaggaaaactagatatccacatgcaaaagaatgaaattgcacctttatctcacaatgtacacaaaaaccaactcaaaatggattaaagacttaaatggaactgttaaactactagaagaaaatgtagtgaaaaagtttcttgactttgatctgggcaatgacttataaaatatgatatgaaaaccaccggcaacaaaagcagaaatagacaaatgggatggcattaaactaaaaagtgcctgcacagccaaagaagaaatcaacagagtaatctatggaatgggagaaaatatttgcaaaccaaaattgacaaatgggacctaattaaagagcttctgcacagcaaaagaaactatcatcagagtgaacagacaacctacagaatgggagaaaatttttgcaatctatctgacaaaggtctaatatgcagcatctacaaggaatgtaaacaaatatacaagagaaaaacaaacagccccattaaaaagtgtgcaaaggacatgaacacacacttcccaaaagaggacatttatgcagccaacaaacacatgaaaaaaagctcaacatcactgatgattagagaaatgcaaagcaaaaccacaatgatataccatctcatgccagtcagaatggtgattattaaaaagtcaagaaacaacagatgctggcgaggctgtggagaaataggaatgctcttacactgttggtgggaatgtaaattagttcaaccattgtggaagacaatgtggccattcctcaaagacctaaaagccgaaataccatttgacccagcaatcccattactggctatatacccaaaggaatataaatcattctattataatgatacatgcatggattatgtttattgcagcatgattcacaatagaaaagacatggaatcaaccaaaattcccatcaataatagaatggataaagaaaatgtggtacatatataccatggaatattatgcagccatgaaaagaaatgagatcatgtcatttgcagggacctggatggagctggaagccattatcctcagcaaacaaatgcaggaacagaaatccaaacactgcatgttctcactcataagtgggagctaaagaatgagaacacaaggacacagggagaggaacaacatactggggcctgtctttgggggtggggtgggggtagggagagcatcaggaaaaatagctcatggatgctgggcttaaatacctggtgacgggttgaatacctaggtgatgggttgataggtacaggaaaccactatggcacacgtttacctatgtaacaaacctgcacatgtattctgaaacttaaaataaaatagaaaatatttgcaaaccatgcatatggaaaaggagttcatattaaaaacaagtaaggcatttataaaactcagtagcagaaaacaaacaaataacccagctaaaaatggacagaatacatgaacagacatttcttaaaagaagacataaatgggcaacaggtgcatgaaaaggttatcagaatcactaataatcagggaaatgcaaatcaaaaccacaatgagatactacctcacacctgttagaatggctattgtcaaaaatacaaaagataacaagcgttggtgaggatatgaagaaagcggaacactagtacactgtaaattggaatctaaattggtacagccaatatagaaaacagcatggaggtttctcagagtattaaaaatagaactaccctaggatctagcaattcagtcttctaaatttgcctctcagcagtttttaatggaagtgatccctcccttttccttgaaatattgcccatttgtcttccagagcatgttattcttttgttgtaatccttttcaacttccttttctctttcttcctcttcttgctgcccttaaaccttggagtttcccaatgttcagtcctaggtcccttccttacaagcttggtaaaaactcccatgacttcaaatattatctaattgcttactacactgaaatgcatatcctagctttgaactctgtgctggacttcatacttcaaaagtatatccaaattttacattcagtaattctacttttatgcttaacatgaaatttaagttgagtacgtctaaatttgaactctataaaaaatatttatcccaaatctgctccattcacaatgtctgttgagggcaattattatttcagtttttcaggacaaaaaccttactcttgacttctctctttctttcacacatctcatctaaaccaccataaaacagcaagatgtatccatttagaactaactgggatcacgtcactctgcttaaatcctccaatgcctgtctagtccactctggataaaagcctacgtccttacttggtgtggcactctgttacagctctgacttcgtctttttctccttcctctttttcactccactctctctgtcctggcttctgtgttgttattggaacacaccatgtactctcctaccttgggaactttgctcagagatttcttcagcttggaagactttttttttttatatactttaagttctagggtacatgtgcacaatgtgcaggtttgatacatatgtatacatgtgtcatgttggtttgctgcacccatgaagccgtcatttacattaggtatttatttcttctaatgctatccctccccaagccccccaccccctggtgtgtgatgttcccctccctgtgtccaagtgttctcattgttcaattcccacctatgagtgaaaacatgcagtgtttggttttctgtccttgtgatagtttgctgagaatgatggtttccagctccatccatgtccctgcaaaggacatgaactcatccatttttatggctgcatagtattccatggtgtatatgtgccacattttcttaatccagtctatcattgatggacatttgcattggttccaagtctttgctattgtgaatactgttgcaataaacatatgtgtgcatgtgtctttatagcagcatgatttataatcctttgggtatacacccagtaatgggatggctgggtcaaatggtatttccagttctagatccttaaggaatcgccgcactgacttccacaatggttgaactaatttacactcccaccaacagtgtaaaagccttcctatttctccacgtactctccaacatctgttgtttggtgactttttaatgattgtcattctaactggtgggagatagtatctcactgtggtttagatttgcatttctctgatgaccagtgatgatgagcattttttcatgtgtctgttggctgcataaatgtcttcttttgagaagtgtctgttcttatcctttgcccactttttgatgggattgttttttttgaagactttttatctcaggcatctaggtaacttcttttctcacctcgttcctatctttctgcaaaatttacctttactaccaggcctaccttgatcaccccttttaattgcaactgactgtctacacctgacacatccatttgttcccactgtgctcttgttattgttgtttaattatacttagcaccctctagcatgctacatagattagttattatctttattatttattgtctggatctcaataaaagcctgaataaaagcctcatgagatgagggttttgtctgcttcgtttactaatagatccacatctcctagaatagcctggatatttagcatgtggtcagtaaatttgttaaatgtacaatatttactaaatgccaaatttacacagattgagaatttgacttttgacccctaaacaattgactattttgccctctaaaacagcgcacaggaaaatcttgctctaaatttcttattatagtctctgggcagggagtatatgtagcttttcttacatataaggatcacatgcattttgtctgaacttttcatttattatgatgtttatacttttatcccagcctaccctgttatatttaaggtaaacagtaatgttttcctaactgtgaaccatgatcaatatacattcctgccttcatgaatataattttgacatttcatccagtaatctttagtcatggtcaacaaagtcaggaaggattgaattgaacactattcaaacagttttcttcgattgctgagattgtcagagacaattaaacctcaaatgactctaaacccaagggcctttgaaaatcccttctgagtcgatatgtaacatctcatatttttttattctgcttctgcaattgattttatgcagtcaagtttcctgtgagttgaaagctcacacctaactgaaaatgatccacacataagaatcttgggctttgttcaaaatgtgccaagagaacttagaatttgagttgcgatactagaaacaatttaactcattatcctctttttctgttttttttttgttttgtttttttgtttttttgagacggagtctctctctgtcgcccaggctgggagtgcagtggcgcaacctcggctcactgaaagctccgcctcctgggttcatgccattctcctgcctcagcctccccagtagctgggactacaggtgcctgccaccactcccgtctaatttttgtattttttttagtagagacacggtttccccatattagccaggatggtctcgatctcctgacctcgttgtccacccgcctcagcctcccaaagtgctgggattacaggcgtgagccaccgcacccggcccaatagatgttactgagaatcggctagtgcttggctccactggaactgagggggaggggtacagcttttccactgttccatttgtttggctggagtagggcagccattgctaaaatagatttctattattaagcacccattttccagatcttcggctacagaaaacaagtttattttttctgtgacttttggtgatttggggttggagattctgtagtacgctgtttgtgacatatcgaagtgataagaaaacacaggaaactcattgttatgtcgttcttcaagtccaaaggtgcctaggcaacccaacttctttctgccggccagagtcttcttatgcttgtttatctgttgtgttatatttagggctgtagttataagagggaggacctggaagaaggagaggcttctccatcttagatgaaactagaaatctcctgctctgctatgttctttaagtgtaaacaattaagggtcaccaggcagagtaggggttgattgttttatattaaacctttccaatttctataaatcaaataaaataggcttacatgtgtcaggattagattaagtttttgatggccctctttccattcctacacagtcagcaaaaatgggaacaaaataaagatcagattattttcacactccattgctttttccttttaatttcttccttaaataataatgcccacccagagatcctaactgtgctaaacacctagacttgttattttgctactttgtgcatccaaggggattcaacttgctttgaggcacaaataaatacctgtctgtgcttttgttttaaatccccatctatgcaacatttcaagtctcacatttgctctttatgcagtttcattccagcttactgctgccaaattatttaggaatttaaaaaataataatgttttcagttatttaaagttaagtacccccgttatccacaagacccttgaaacctgcaaataatagaccactatgagatggaaggtgcttcctgtgaagagttactatgtattaaccctttttcttagtcctggatattgcagtctctgaaccctgagggcccaaaagcatggcactttccttgtctcccactatcttgatcttaatagtgactgaaatgagtaaggaacaactctgagagccaatcttgtggcccccaggttccaaaagtgctgtcggcatctgtggggttatgtgaaatgacagtaaaggtagctcagtcacatctgagtagaaaacaaactcctcgctttttcttccatttctgtatattgcctttgcttacacccctccaaatccaacatgacttattttcctcacaaatttggtaatattttcaagtgctcagccccaaaaggtgccagcaattaatgatagggtttcatagaaatgattctttagctcctgctccccagttcatgtgctctgctccctaagaataacttagagtggccaaaattttataatactgtgaatgtgtaacatgattttgtgaaaaagaggtatgtggcaggcttgcacaaatatccaacaagcttttatgtttaaaagtcatttaaaaacactatttaggccgggcgcggtggctcacgcctgtaatcccagcactttgggaggccaaggcgggcggatcacgaggtcaggagatcgagaccatcccggctaaaatggtgaaaccccgtctctactaaaaatacaaaaaattagccgggcgtggttgcgggcgcctgtagtcccagctacttgggaggctgaggcaggagaatggcgtgaacccgggaggaggagcttgcagtgagccgagatcccgccactgcactccagcctgggcgacagagcgagactccgtctcaaaaaaaaaaaaaaaacactatttaaattcatactaagattttaccaataaatagctataactaagagcttaagtatacatttcttcaatgtgcttcatataaaattataagtcaccaatctgtatctaatagaatgcataattataaaaaacaagtgcataaacccaattcatcaaagcttaatagtaaaatccagacaccaatgccttttgtaatgaaaaacctgtaatactttcctatgtatgaaccaatatttacattttagaactatatttggagttgaaaatgaaccctcatccatatatacaaagactccattaataaagacacaactgtttgtgtctttacacaaacagttataaagacaaactgctaacatagcagtttgtagagtcaaacgctgaagagtagtttctcagagaccacattcccttacctaagttgtgtgtatcagagtcaccctggaaggctgaatagacagggcccaagaggtcatataatccagacctcatttgcagatgaggaaactgtgcttagagaaggtaactggcttggccaaggtcacgaaaccagttaatcttgaactaaaatcaatatctcttctgttttagaccaatgctattttcattatatgagtggtactcacattttagtggtacatcagaatcaccaggaagacacgttaaaatgcagaccaccggctgctgccaccctcaaagtttctaattcagttgatctggagtggaacccaggaatttacctttcaaaccgatcccatagtcttgggcacaattcattgagaaccactacattgcagcatttttattttatatttctatactattttacctttcatttcttttttaattgttataataaatataaaattgaccatcctaatcattttaagtgtacaattcagtgatattacagacattcataatattgtgcaaccattaccaccatccatctccataactattgtcatcttccaaaaccaaaactttgtactcattaaacaataattccccacctctgtctttcctcagcccttagcatccaccattatactctctgtctctatgattttgactactctaactacctcatttaagtagaatcctacagtatttgtctttttgcgtctggcttattttatttaccacgatatcccccaggttcattcatgttgtagcatatgtcataattcccttcctttttaaggtgaaaaatatcccattgcatgtatataccacattttgcttatccattcatcaactgatggacacttgggttgctttcacgttttactactgtgaacactgctgccatgaacacacctgtacaaatatctctttgaaactctgcattcaattcttgtgggtaaatacgcagaagtagaattgtcggatcatatggtaatgctatttttatttttttctaaggaattgccatgctgtctttccacagtggctgtatctttttacatttccaccaactgtgcacaagagttttaatttttctacatcctcaccaacacttgttgttttctgttttacattttttatggcagccaccttagtgggtgtgaggtggtaacttactgtacttttgatttgcatcttcctaatgattagtgatgttgaacatcctttcatgtgcttattgccattgtgtcttctttagggaaatgtatatttaagtcgtttgcccattgtttaagtgagttgatggttgttgatgttgttattaacttttatgtactgttttacttttttcttgttgtttttttttgagatgaagtctcactctgttgcccaggctggagtgcagtggtgtgatctaggctcaccacaacctctgcctcccaggttcaagcgattctcctgcctcagcctcccgagtagctgggactacaggcacgtgccaccatgccgggctaatttttgtatttttagtagagacagggtttcactatgttgcccaggctggtctcaaactcctgacctcatgatcctcccgccttggcctccgaaagtgctgggattacagatgtgagccaccacacccggcctgctttacttttaaagaagtttttttttttttcttttttttaaattttatattttggagaatttcaagaatatagaaaagtacacacaagagtaaaaggaatcctcataaatgtgtcaagcaccaacaactgtctaacaatggccaatttaaaggacttaacatatttatttttttcaccacttttctctgagagacgagtatcctaatatattccaaatatctgataagaaaatgtctggtattattattctagtaatttttattctgtaatgttatttaatgtaaacttctttacaacttcaagaaaagtgggggaacagtggttactggcttccatattacaacgaagcaaatggagtctgagatggttattaaaagacgcatcaaaaacccaaactgaagtctgactccagaactcaccttgcaaagtgtcatcattcaattgctccaattaaagtcaaatttatctgattttaaggaaaaagcatattactgaaatatttgtatatgtgtagccagtaatggtgacataccaatagcacttgtggacaaatgttaagtgcctggttgcccaggatgattctaacctcttgatggagtgcaggattactgcatttttagtccaacatccaacatggttcattgctatcaagatttcgacaccactatccaccttactttttatgccagagtatggagttttcccctcatttagggccttattcttgcagagactctaccttgctttcagaaatgtggatagtctttgtcatttatgtgcctccaacaaattatgaggtttaacgaactattaagagctttttatatgcatgcttatttatagtagtacatgtctctaaatggtttgctgtactataacatattcatatacattatgagtaattcacatgaagttatgatctgataccccaaaacataaaatattaaacatttatgtgtaccaaataaaatgccactcaacatatcttatgaaatctcattctaaacctctaacccttacactgttctaacagttgtcatagtttaagacataattgctttagttagtatgataatgtgtttctatgattatttgtgacagacatcatactctagacttgattagcatagaataaaaaacaaaacattggagaagctctacttgagatgaagctcagcagttatagtactttctcactgctgacctgtggcttttaaaaatgggattctggtttctttctttcacgtttattaatttgggataataatgaatggttttagtgaagtttgtgagttgacagctattttatctaagatccatgaagaaaagtaagaatatttactttattattctttttatattaaaagttgtgcatgcaatccagattgttaattaatatataaaatggtgtttaacattattagtcatcaggattgcaagttcaaaccttagtaggagattactgtaccaccaacaggatagttaaaattaaaagaactgccaatgtcaagtgttggcaaggatttagagtgactggaactcttgcacgttgttggctaggggtaaattggtaaaaaacactttggaaaactgtttgctggcaactagtatagctaaaaaacactctaggattcagtaattccacacttggctatatatacaagagaaatgcatacacatatgcaccaaaatacatggaaaaaaacctcataatgtgaatggataaatatatgttatgtattcatacaatgggatataactcagcaataatagttttatgatttctgaaaatacatggatgaatttcacataaataaaattgagcaaaagaaggccaagcacaaaagaggacaaactataattccattcatatcgagttcaaaaacaaacaaaacttttggagtatataaactaggagtgggcacaggagagctttcctgggtgctggatatgtatcttgattttggtgctgatttcatagatgtaaacatttatcaagctttcttaagattcatttacttactaaaatatatacacttaaaataattgaaataagaatctgtataaccaacattgtcaaaatgccccgttaaagcaacttccgcactggctgattcaaagtgtttgactttagtcccagagaatgaaagcttttctgagtcaccagatcatgttcctgtaggttctacttggataatacattttaaatgctgtgttcaggagtaactgatgcttaaatatagatttagtgtcatcactttttattataaaatgctaaatggaagtagaaacatctcatgacccacattttcagtttaatagtcctaaaccatcattttctatcctaaacatataagtcaataacttaaaaacaattaacagtctatatatatatatatcttgtatatattatatatcatcataacttacacaactcctcaaaagcaataatttaaataagtactagatttatgcattattgaaagaactttggttaagaaaatattccaaatttttcatgagatttgagaaagtaaatgtcatatacatgtcagttcattttttcatatacatgtttttttacacatattctatcagtgtttcaaaatataatatgcagacccagaagaaaggtacagaccccatttttaaaccatactctggacaggactattttctactaggaatggactaccctatgaaggcaaacaagacaggaaggcactctggatcctgaagcgattctgtccaccaaaacatcttctgaggtgttgtattttgcttttgctaaagttttgcacagacctctgtgagtggttgtcccagatacaaaatcacacaggaaattaattcctaaggatgaagctgaagtcacaggctttagttatctttggaaacctcagaatgctttttcagcactggctttctgatctttgaaatggagcaaatccttgttccctgaaaatgacttttgtattagaagacattcttgaatatactttttctttggaggagtgtctgttccttacatgaaaaccttgacatatttttgagtgtgtcagtgctccaattaaaacatagtgtcacaagccaggtgccactgtcaatattgcgatggctgaagtaaggtaaaatataaaagaaatttcatgacagtagaagtggtagagccagaaagtgaattgaattcatttagaattaatcttttatggatcagggaattttttcagagtttcttaaaaaggagttagcattcaattagcaacaaactctaatctgtgtcagcaataagacactctttagcaatttatttcagtgcaaaaggtcactgcagagaaaatgcaattattgaatatctaagagagaaataaatattgaggcagaattaggattttttaatagaattatggatattagacttgattctaaactttatttaatcaaagcactagattatttactttggtgagtaagcttataatcaggaacaatgaaattattttttgagaacattaaagctaacatatttttgcaaagttgtagcaatgatttaagtatagttgcttggagctattgtacaaagataatgatagacgctggatgtggtttcctaaacccatgtgtgggacaggatcactaccaaacatgaagcgaggcctggcctcaaatgctgggaaatctttgagaggccattattcagaagttcatcacttcagagggtccttcaccttgactgcattgggtttattctcagacccctacacatcagaatttctcttgggtagtcaaggagagcagcatatagtagaaaactcccaaagatgtctgtgaatcaggacttcaatggagacaaagctaccatttcaaattgaatctcagcctaagtcatacaccacatacaaaaattaactcaaaatggatcacaaatttaaataaagcttaaaactatagaactgctagaaaaaagtaaaaatagttatgatctaaagctaagtagtgttcctaaacttgactaaaagcacaattcagaaaaacaaataacctaaatttctttaaaattagaaaattttcttctgtgacacgttatgttaagagaatgaaaacacaagctacaaatggaaagaaaacaattagaaaccaaaccatatatttatcaaagaactactactgtctacagaatattaaaactctcaaaactcagtagtaaaaaaataacaatcaaacaaaatctaatctaagtgattagaaatgctaaaatacatgaagagacgttttactaaagaggatatatagagagggtaaataagtataaataagtatataaaaagatgttgaaccgcattaaaaattatgaaaattcattttaaaaccacagtgagtgccaggcgtggtggctcatgcctgtaatgccagcactttgggaggccgaggtcggcagatcacctgaggtcaggagttcaagaccagcctgacaaatatggagaaaccccatctctactaaaaatacaaagttagccaggcatggtggcgcatgcctataatcccagctacttgggaggctatgggaggagaattgcttgaacccaggaggcggaggttgcagtgagccgagatcgtgccattgcactccagcctggacaacaagagagaaactccatctaaacaaacaaacaaacaaacaaacaacaacaaaaaaacaaaacagagattctaatattccccatcagaatggctacaataaaaaatagtgaaaataacaaatgttgttaaggatgtgaagaaaccagatcacagaaatgttgctggtgagaatgtaaaatgtcacaaccactctggaaagattttggtggtttcttattaaaaaaaaagcaaataccctacaatctagcatttacactcttgaacattcatcaccaagaaatgaaaagttctgttcaaatacctgtacatgaaagttcatagtagccttatttgtaatagtcaaaagtggaaacaactcagatgttattcagcaggtgaatgattacagaatatttggtatatgtaccatggaatactacttagcaataaaaggaaataaaccactgatacacacagcagcctggatgaatcttcagagacttattctgagataaaaacaagccaatccccaaatgccacttactctataattccatttatataacattttttaaatgacataatattagaaatggagaatagattagtggttttcagggtttaaggagggggtagaaattggaatgtggtaagcttgactataaaaaagcaacatgaaagataaatgtggtgctagaactactttttctcttgactgtatagatataaatattctggttatgatattctactatagttttgcaagatgttatcattggggaaattggacaaagagtacatggaatctcactttttaaattgtaccactgcatatgaatctaaaattacattaatttgttttaaaataccttaaaataatattaatacatgtgtttttaagtgtaacagatattatgggcagaaatattacaaatgagtaataccaagattctcttagctgaaaatactataaatctctactaaaaagtatgtctctcggccgggcacggaggctcatgcctgtaatcccagcactttgggaggccgaggtgggcggatcacgaggtcaggagatcaagaccatcctggctaatacggtgaaacaccgtctctactaaaaaaatacaaaaaattagccgggtgtggtggcgggcgcctgtagtcccagctacatgggaggctgaggcaggaggatggcgtgaacctgggaggcagagcttgcagtgagccaagattgagccactgcactccagcctgggtgacagagcgagactccgtctcaaaaaaaaaaaaagaaaaagtatgtctctcagatatataaataggtcaccatatacgtatttgttctctctccatctgggtatatacttcaccatctcacccccaacatggtctgacaatggcaaaatgtggagaccatcaaccttctatatttcttacccatattccaatattgtcatgttgcttcttgatatggtttggatttgtgttcccacacaaatctcatgtaaaattgtaatccccaaatttggaggaggaacctggtaggaagtgattggatcatgggggtggatttcccccttgctgttctcgtcatagtgagttctcacaggatctgcttatataaaagtgtgtagaacctcccactttgctctcttcctcctgctctggccatgtgagacatgcctgcttcccttccaccaagattgaaagtttcctgaggcctccccagacatccttcctgtatagcctgcagcactgtgagccaattaaacctcttttctttataaattaccctctttcccatattgctttatagcagtacaagaacagactaatacacctcttgaaccacatccagaagaaacttcatctggtaaactgacacagagtaaagaattagtgcctaaactttaagtataaaggagaaatgtagcataagaatccaggtatagaggagggtggagcaagatattagactagaaaactctgtcaattgtacatcccacaaggacacaaatttaaataaatgtatacacacacacacacacacaaacaccttcatgagaataaaaaatcaggtgatccctcatagtacctggtgttaactttgtatcaattgaagtggtactaaagaggtacgaaaaagtcttgaatcaccatcaccatccctctcccatccccaagcagctgcaaaacagagagcttctctaggtttgggggaaggagaatgcagcaattatgaggcattgaactcagtgcaaggagggagcctttaaaccagccttagccagaggggaatcactaatcctagcagtcagcacttgagttcccttaaaccctgtcatcaagggctacagtgctctgtgtctctaagtaaacttgaaaggcagtctagatcataaggaatacaactgcttccccttcatcttccaccatgattgcaaatttcctgaggactttcagaagcagaagccattatgtttcctgtacagcctgcagaagcatcagacaattaaacctctcttctttataaatcacccaatctcaggtactttgttacagccctgtgaaaatggactaatacatcacacaatgggataaaatatttgctaactacccatctaacaagggattaatagccagaatatataaggggctcaaacaactcaataggaaaaaatataataatccaatgaataaatatttgaatagacatttctccaaagaagacatacgaatggcaaacaggcatatgaaaagatgctcaacatcactgatcttcagagaaatgcaaatcaaaacgacaatgcgatatcatctcaccccagttaaaatgccttagacccaatagacaagcaataacaaatgctgtcgaggatgtggagaaacagaaccattaaatgatgttggtgggaatgtgaattagcacaactattatggaaaacagtttggaggttcctcaaaaacctcaaaatagagctactatatgattcagcaaccccactgctaggcatatacccaaaagaaaggaaatcagaatatcaaagagctatctaaacttccatgtttattgcagcattactcacaatacccaagatttagaaataacctaactgtccatccacagattaattaacaaataaaatgtggcacatatacacaatggtgttcttttcagccataaaaaagtaatgagattctgtcatctgcaacagcatggatgaactggagattattatgttaactgaaataatctaggcactgaaagacaaatattgtgtgttttcacttatttgtggaatctaaacatgaaaacaattgaacgcatggcaatagagtagaaagatgttaacagaggctgagaagggtagtggcagcatgggggtgggagggtagggaggatggttaatgggtacaaaaaaaaatttacagtgaatgaataagacctactatttgatagcacaacagggtgactatagtcataataattgaattttgtgtaataaaaaagataaatgcttgagtgaatggatacctcattctccatgatgtgattatttcatattgtattcttgtattaaaacatctcatgtatcccataaatatatacacgtactatgtacccacaaaagttaaaaaaaattagatataacacaggaaacccaaggataagtaatacagatatgaatatgtcccttgagtgtcatcaatagtcaaggcagatcatagcctctctagtttatctctctctgtaagtttgccttatttgtccctctgaagtcaggcactattgatgttttgtcttctgcatacattgccatcacacaggttcaaaatttacttaactgaatagttgagacaagaactcaggaagatagactcttccatcccaatgccaaattcccagaggagaaaagttgacatttttccaggatcagttgccttccctttatctgattgcctgtgagtcatttgggaggatgaacataaatattaaggactagagtccagtgatatttgtcttctgaaatagatagtgaacaacatgaacaaatttataaggagtggattctaggcatgaatgtggcagataactttacatgagccctttctttatatctcacaaacaccactgcttgaatagcctatacacagagtggggatagtctagtctatctgttatacagatgtcaaatgtctcgacattagtattagaagataagagtcatttatcagctcttgttagtacctctttcatattccctcaacattcaatgttccagtacttaacaacccaactctactacaatttctacctaaaggctttttttttcacccagtatgagttaacaccctaagaaagttaatgctcttagggagcagcccttagcaataacaaatggtaaggggagagtaaatactccagattactgctgggaaagaagggggataaatttgaggcatatttgatcctggattacaaagttccccagaagaagtgggcctcagttaccaacagcactaacctaacaacaacttctttttttttttttttcttttctctccttcttggctcgttctcccaatggcacttcctgcaataactaccaaaaactatctgccttcaaatttccatctaagtgttttcttctttgggaatgcaatgtaagacttgccaaacagcctgttttcagggccggcatagtggaagggaacaggaaaggccactacttgacaaagaaaagagagataagcaagagccataagaaagctttatgcacttaaggcaatgacttcatcataatggaatacattaatgtagcaaaattacactgtactccatgaatatatacaaataaaaataaataaagtgcaccctgctaagtcggggcacagaaagtaaatatggcttaaacactcgacaaagatctgatctgtgcagaacaggataaaataattgttggagaaggcgggggcaaagtcctcagacagacaatggagcaagcttagtaaaagactagctgagaaagaccttcccttagaattttagcagactggaacacaatgagagcagggtcccctgctggctacctggagacacaggattccccacctgtggttaagtgacttgtgccctattagagaaccttctcagctgagatccaggagagtgaattaatctatcatataatcttagttcatctgtataatttctaacccacctaagtatgaggattcagccttactcacaagttagatcaccggctaatattttgctttaggttaatgaggctcttattagagaatgaaggaaacagctccttgtagatataattttgaaataaggccctcagcttaaaagctctataaaccatattttaacacttcaaaatggagatttactcagaaaccttttacatgataagcaaaagtataaagattcaacaatttcatttcagggataatctgttaacacaggaagaaaagggtataaatatcacctaactaattctatgatgtagagaccaaggctcctcaagcgatagctgatgagaaaattccagttccaacatccttaacaagttgattgaaaagttttacgtaacattttatatgctaagcatcttttgaaactggtgacagaaagagtcaaactctgtaaaatatttgaagagatttattctgagccaaatatgagtgaccatggcctgtaatacagccctcaggaggtcctgagaacatgttcccatggttttgtatattttagggaggcatgagacatcaatgaaatacatttaagaaatacactgggctgggcatggtggctcacgcctgtaatcccagcactttgggaggccaaggtgggcagatcacgccactgcactccagcctggcaacagagcaagactccgactaaaaaataaaataaataaataaataaataaataaaatacattcatttggttcagaaagacgagacaactgaaagcaggggcttccaggttacaggtaaatttaaacattttctggttgacaattggttgagtttatctgaagacctgggattaatggaaagaagtgttcaggttaagataaaggattgtggggagcaagttttattgtgcagaggaatctctcaaatagcaaacttcagagagagagcaggttgtaaaatgtttcttattggacctaaaacggtgcttggctcttagttgattatctcctggattagaaaggaaggaaaacaaatggggaaggggattctttatagaatgtggatttttcccacaagagactttgcagggcaattgcaaagtatggcaaggaaatatattttggggttaaatattttttctgtctcataattttatgccacagtcagattgaaaagtaagtcacaatacatagggtcaaataaaacctatctgatgagaatttgtggtttatagggcatggctccctagacctcttaggtaggaatttgggcaagataaaaaaaggagcttattcctcaaaacagagcaaaaagaatattagtcactgatgataacagatatgcttaaatctgatgatgaaaggagtcaagctctgtaaaatatttgaagagatttattctgagccaaatatgagtaccatggcctgtgacacagccctcaggaggtcctgagaacatgtgcccaaggtggtcagggtgcagcttggttttatatattttaagaatgcatgagacatcaatcaaatacatttaagaaatacattggtttggatcagaaaggcaggacaactcaaagcaggggcttccaggctataggtaaatttaaacattttctggttgacaattggttgagtttgtctaaagacctgggatcattagaaaggaaatgttcaggttaagataaaagactgtggacaccgaggttcttttgaagtcttatagtggctgcccttggagacaatagatgacaaatgtttcctatcgaagtctttaaaaggtgccagacatttagttaatttctccaggattgggaaggcctggaagaaaaagatctagctatgttaatacagattctttacagatgcaggttttcccccacaaaggatggctttgcagggccatttcaagatatggcagagaaacatgtttttgagtaaaacatttttattttcttccttgtctcgtaatgttattccagagtcagattggaaagtaggtaacaatatatagggttaagtaaaacccatctgatgagaatttatggtttatagggcatgactccccagactcgttagacaggaatttgggcaagataagaagaaaaaaaaaatcagtgcatagtccttaaatctatggaaattctacagccatttctacttggaagttgcaggatttcctttattactaaacttagaaaaatgctgatggaatgtgtagttaaaattaacctggaaacacaggtaaaaatagcaaactatattctttctttggtatagcctttactgttctatgaacttggcgatgatggattaactacaaaaataaaacatcaaaggaacatagacaaaataaacacatctttatataccagagacaaaatagaaagctggagtggttaatggaattgaagtaatatactccaaagcaggcagtgggagatgcagcttcacttcttatagggtaagaaaagctggaggttttctgtgtgaaatgcagaaataaacttggcttcactgcttaaatccaggagctataattcattaaagtagggtgaaaaattgtagacaacttctgcctgaggctacaacttatatggagatgccatgcaatgtaagcctgaggatactgacatagcctcaggacaggactgcctgaggctcactaaccagttctgtatatccttcgcatccctgccagagaggagtcctatgacttccttttgagagctacttctcaactgaggaccctacaatattcatggaaattagcctcataattgttttttaggaaggaatgacataagaatgtaaaagaaaaaacaatgcaagtcaaatatatatatatgtatatatacacatatatatacacacatacacacaatctatacatttattttatatatattttatatatatagaaagggatgcctaggttataatgataggagtatagagagcaaagttttatcatgccaatgaagtctctaggtagcaggcttcagagagaatagattgtaaatatatatataaaatatatatattatatattatatatatattatatattatataatatttatattatatatgttatattatatataatatatatataatatataatatattatatataatatatattttatatataatatataatatatattttatatatattatatataatatatattttatatatattatatataatatagtacatataaaatatactatataaaatatgtagtatatataaaatatactatataaaatatatatactatatatcatatactatataaaatatatatactatatattatatactatatatatatatatattttagcagacttaaggtctatgttgatgttaatgctggtcagctttttctgaattccaaaagggaggagggtataatgaagcatgtctgcccctcccttcccatcatggcctgaactagtttttcaggttaactttggaatgcccttggccaagagaaggggtttattaagatggttgaggggtgttataattttatttttactttacattctcccccttctggctaagatttgccagagataacatcaagaggcatcaaatttttattttgtcccatagcattgccggggtaatatggctgcctgccctagatcccatcctggaatgggattctttgtggctgaggaacatacagtcaaaggacttacagcaaattaaatgttctaggccagataggaatggatgtgaacaggcattcattaccccttaattttttttttaagtaaaaagccaagaaataaaaaaccaaaggtgaggttacaaaagttacttttttaacttctgtgcattgagctactgtaatgttgattttagttgtggacttatagcaattagctatacaaaacataagcactgttctgaaaaaaaaatttctttaaatatatatctgtacaactcataactggaaatattatatccaggaggctttctcatgaggtatctttatcctttcagtaattatttactttttattctacaggaagcaggaaattctttatggttggagcagatgaaaaggtgccacataatagctcagaaggcaaaatcctttgttttaccagctgtttaggcatctgtgtactcatccttgatgtgaagggtctgaactaattctgtccctcaaaactggcccttacaatctcatgcacccacctctttcatgatagtctatcggcttagagggaaggtgctggtatagtcttaatagcagggcatttatagtgaaaaacagatcaggcccagtggcatgccaaatgagagagatttgcatctctagttttcagaatatcatgatactggtttccttggaattaaaacaaggagagataagtaacattaatattttgaaaatcgaaagagtatttgtgtgtcagaacagaaaaaggaaactattcaatcaggccaccaactaaaaatacaaagaaaaattataatctggtactcttgagagggttactatagccaagaaataatacatgattcagtctgcactcaaaaacaaaaatcaggactgaaatttagtaataagtgttacacttttctatttaaacaatttctctctctctctagcccttcttttctattaaagagaaataacagtaagaccaatttgtgtgcaaagtaagttttaggcttattatacttggcctgaatatttgcataaagtgcagcaggaattgattggccatataggttccttttaagttgggtttgctggaactttacctaaaaatatgttattctactgaaagccttagaaaagtaaccagtgtctccaattttcatatttaaaaaaaaaactcttatgaaacttatgcaaataactatattgtcataaatatcagaatactcacgaacagattcagaattttggagataaatttgctcacagaaatatattttattcaattgctctaaactataaataattcagacgaaaaaaatttacttgactctagtgtggcagcttccaaacaggatgtcatttgtcaatcttggaactgctgtccacaagccaaacaacttttgttagatgagaggtatctatcaggcactgtagaatctagcagctcctcatatagtaagaatcagtcctagaggaaaaagaggctccttgcttatgagtattctcctccttgcattccccaggtagtaagatcctatataaaaaggatttgggtccccagcaggggattgggccaagggattcaggaccttttctatatctttatcttagttgtctcaacattgcaccaggcaatgtgagctttctcataacctttgccttttgacttttcttaaattttccaatctggggcaaacagtgtcttaagacctttgctttaaccacctcagcttttattttatcatttcttaataaccattcaaatactttcatcactcccttttgcctttcccattttttaaaattatcctcaatgttttatttaagcatctgcaagacatatgaaggacagcaaatttgataaggctactcaaacagttgtatgattctgtggaagtaatgttacccagagtgcccatgtaaaaggcacccctttaacccccaaatttccaatgacctgagtaatagacatattcagcgggagaatatcccagacatgataaagccagttccacatgacttgcatatgaagcatatcaactgcttcatctggagtacaccacttggtattttatagggagagatggatagtccccttatcagggtaaacagatgttacagtggtgtttatctgatccattaggctggttgttccctcaggaataatctcctgtgcatttggatcacatatactcatcagcaattgtttaatagtgagcacaactgaaacacactctttcattctgtaccatttaaaattaaggattttaataattatataactaggattacttaatttaaacataacttttagattttaaattgctagagagaattgagattaaattcatcttaaagtaattttttttcaatccattatagtaaatttttctcaggaagccgatgataccaatctacaaactagaaaaactcttttacattatacccttttgttttaagagttacttggttttgacctttccccacattgactatcttcatggtaaccacaggtctcagaggtaccttttgtggatagcttggaggcttgtagcctgagctgggacagagccacatcaggtcttggtctggtcttaaggaccaagcaagtacttttttactcttattttaactattacagataataaaccaagagattgaatattttgctttttacttattagtttgcacatctgtaggcatccattgaatgtgggagtatgatccatctcgaaattccactggcaacttacctttagtaactgaatgcagcccaactgcagctccatatcgtgggtgaccatgtggccaccccagagtcaaggattctcatccctccatctttatatatttctctctatccatttagttttatttatataattttttctttattttaaggcatttttaaatagtctattaaattttaaaaattacattttctttagcaaaatctacatccttgtgtttttataaactttagcaaaaatacattttattctcctactactttatgtcttagtaatccaaattcccaatggaaaaaaaacaaactaggatttcttaacttaaacataacatgacttccagattttaaattactggagagagaattgagattaaatttaccaaattaatcttcccaaatattactagtcatgtgaactacaaggcatctgacctagattctgtcaaatatggttaagtattaaattctttaaggcaattgtttagagctctttcatacagtttggtgtgaaacagaacttggacatgtcatatgtaaacatatagacatagcagacatacagaaaaaagcaaatccaaaacatttttaatttgcttgttttcaaaaattctctcccttactttagagtattaatttaaaaacattacaggagccaacaaaagttgaaagagaaagtttccattcaaggccttctcaaaagacagaagcaactgaagcagcagggtacaacttctgagatatcaatctgaataatttgaagaagaaacatatttaaaaatttaaaaattaggacaggcacggtggctcatgtctgtaatctcaggactttgggaggctgaggtgggcagatcacgaggtcaggagattgagaccatcatagccaacatggtgaaaccccatctctactaaaatacaaaaaattagctgggcgtggtggcgcatgcctttaatcccagctacttgggaggctgaggcaggggaatcgcttgaacccgggagacagaggttgcagtgagctgagatcgcgccacctggtgacagggcaagacatcatctcaaaaaaaaattaaaaattaaaacttcttgcattaagagtaacaatatttttaataaaatcttgttctcacccatccttcagttttatatgtgtatttttaatatgaaagtccaatttttagaaaaattataatttatttcaattatagcctccataatcacataacatttttataaatttcttttatactgatcttattacaacttatagaaaccattcctaacatgcttggactttctggtcactaaatatccatctttcttgaacaacccagtcccttttactttaggagaaaaaattcaccatataaaattctttctcatataaaactacttttcctttaagctttattatcaaaaatacctttttatgtctataattttctttacatctttcttatttcctggttctttttacctggttttatatataacctttaaataagctctgaattagacaaaaattatttactttttaataagaacacatttttagaaagaatgttttcttatactgtaagtttattttttaaattggaaaataacctgtcatttaatgaaatgtctattatttaatttaactttagattctaaattatgacaagttcatttacaattaatttcatttacctaattatgttattttaataatttagctagattatttataaaaactgtgatagtcatcatctaaaattatgttcctgtctaccatttttatagcctgtgaatttcaggtgtttatctgagtaagataagctcaggattaaatatgtgcttattttacaaataattcaagacgtagctgtttctatgaaaccaacaatattaaatgtcttatttatcaaacatcacacaagcaaagatcattctgttttgggctgggtttacagctttataactcttatgccaaattttgacactatagtatttgacagggataagtatgaaattgattaataaatgcaaacacaaaagtatgttgacaattcttaagacatttctaatattactttaccaacaattttaaagccagtttattaaatattttacttaagtcatgtgagcttgaaaatcatttgagcttattaattaattaattaatgctttttaactttaagccaattcactaccttgtggccaaaaacacacagtaaaataattgtaaatacacttaaacacacacatacaaatgaagcaaaatacagtcactggagcagtcttgatgtctgaggtattacccagagttgtttgcctcacaacccagaaaattaaggagcgtagacaccaagggtgaggttggcgcaaatgtttaataagtgagagaggaaagctctccacagcagaggggtgtctgggagggttgctgtttcacacttcaatacaaaaacttataaacaagctaagggagcacatttgcatagggcacaaaaaaacatttagggctgggtgtcttatttgcataaggtgcaaattcttgttagctccaccccattcctctagtgcatatgtgggtccttagcctgagttactacgtattgttttattttccttactgcacatggatcaggagatggaattttccactgtggacatgtctgactctatgtaaccttttttatctacacaattgcaggccagtcttaggcaagcccccttgtgcaaattcccttatctgtgtatgcccaaaaaggaaaggaatgtgctcactgaagcccaccatgtataggcagagctcgctggttgcacaaaaaaacaaaagtgttgacccctgcttacttatctgtgcttgcagcttgatttattccaggctgctcttttattggagggacttctactggtagccccgtcctaactatctgcctaatcagttccttcctgtctcctctctcacaaatttatgcaaacaaggattctatagcttttctttcaaactctgatgagattagtaaaaactcacccttttgccagaacaataacaacaataaatgcttagatgcacacagtgtattttatctcaacagaaaagtaatagcagatataatgcagacagaaaacagagagatagagaacttaggaactttatagttgcaggtcaacctttggcctctggattttccttgatgtaatttgaccatcagtttaacatgtgcacaagaacagacctaatgtgtaaccagctggagtattagaaaacctggcacttccttccatttacacaatcacaaattgagtcgctgtaaaaacaaatggggtacctgaaaatgcgtcattctccttgtctttcctcattatcatgtaaaccaaaaataaaattctaagcccctcccaaccatctgaatgaacttcctcctcagccagggctcttaaaatttaacctgaaagactggtttaggccatgaaggcaagtggggatcagacaagcctcattatacctctctggcattaacatcgatacagactttaagtctgataagaaatatttcacatcctattctctctgaagcctgctagctaaaagcttgatctgcatagtgaaactttcgtccctaccacctcttatcacaacccagacattcctttatattgatcccaggtctttagacaaactcaaccaattgtcaaccagaaaatgtttaaatttacctatagcctggaaggccccctgcttcgagttgtcctgcctttctggaccaaaccaatgtatttcttaaatgtatctgatggatgtctcatgcctccctaaaatgtataaaaccaagctgcaccccgaccactttgaacacatgttcttaggatctcctgaaggctgtgtcatggccatggtcacttatatttggctcagtataaatctcttcaaatattttacagagtttgactcttttcattgatacgtagattatttgtttcccacttttcttaatggaaaaactgagctgtggcttaaggtttactgttgttgatcaagatgtgctgattgtggttgggactccatagtttgtcaccattgactcatttctgccttcttatgtgcctcagtttctttctccagaggtctagcccctccaagagacctcgaaatgcagtgtgaccagctcctgtgtgtttcctggatgaggcttttaaaaataattttgttgggtgttccctgtgagaccactgcatgttgcagtgggtcaatctcccagacattcccactgggcccccagtcaccaaggagtgcctttcagttgtgaggagcaaaatgtcctttctttttgggacacgcatgacaattgaaactccacaatgaaaacagaacactccaaaaagggttagtggcccctctgttctgagttctttaaggggttcaagtcattagaaaccttctctctatatgtttttggtactgaaaatggtaaaaggggaaggagaaatagggtggaagaaaagtaaacaaaagaactattttttttttaaagaaaggaaacaaacacagaaatcaagtgcatttttgttagttttttacagctgcaaggaattttagccaattcagggaccttgttccccataatttggaattctcattcagatttgaccaagtcacgcagggttggtcaaatccaatgggagaaaggccagaccaacaacaacaaaaatcccgacaatatgattactgagcactctaatggttaggagaaattaagaccaactggttgtccattttaacttttagtcatgaaggagaatttccaagaccaaaaaaaaaccaatttagctacttacctaggcatgggccccaactaaagaccgttctctactatctttgaagcaggaaagaaaaaaaactcaaactcccctccctgttggaaattagctgaaactccagagaggagttctctattctctatcatcatggaagcaggaaaacttgccttcctgttggaagcaaataaaaactccagaaaatgaattgtacagcaaaataaactgtagatcttgaccaaatttggggagatgatggattctctggaagtggtggggggagctcccagacctctgcaaattgtcctattggtttgagacttaaagatagctcaagctggtaccaaacaacaataggagatttgtcaaaagtcagtggaagctccactcagacttccttaatggttatccatttgtaaaccaaaagtgtctgagacatgtctcaatcaatttagaaagtttattttgcccaggttaaagatgtgcccctgatagcctcagaatgtctgatgacatgtgcccaaggtggtcaaggtacagcttacttttataccttttagggagacataatacatcaatcaatacctaaaagatgtacattggttcaatctggaaaggtgggccaatttgaagtggggacttccaggttataggtcgatttctctgattgacaattggttgagttattatctaaagacctggaatcagtagaaaggaatgtctgggttatgatgataaaggggttgtgaagaccaaagttttatcacacaaaagaagcctccaggtagcagccttcagagataatagattgtaaatgctttaaaatcagacttaaaggctgtgttgttgttaatactgactggcttttcctgaattccaaaaggcaggaaggtctgatgtccccttcacataatgacctgaactagtgaactagttattttgtttttgtttttgagacagggtctcactgtgtcactcaggctggttagtgcagtggtgcaatcttgtctaactgcaacctttaggctcaagtgattctcccacttcagcctcctgagttgggactacaggcattcaccaccccttcctgctaacttttgtattttttgtagagacagggtttcaccatgttgcccaggctggtctcaaactcctgagctcaagcagactgcatgacatggcctcccaaagcactgggattacaggtgtgagccattgtacccagcccatgaactagtttttcaggttaactttggaatgctcttggctgagaggaggggtccattcaggtggttggagtgcttagaattttgtttttggcttatatttttaaaataagcatggttgggatactcaatgacataaggactatgcttattctaaaaattataaaaatattacacaaaaatagcaataaaatattaaagaagttacaggttgaatatataatataaaatagtttgaatatgataaagaatcaaatcaaattgaaatatgggaagcaaaaatatcattaaaataaaaaatcaatgggtagggtaaactataaatgcagcaggacgagccacagacaaaacctctcagacaccgagttgtagaaggaagggctttattcagctgggagcattggcaagctactgccttaaaatccaagctccccgaatgcacaatttctgtcccctttaagggctcacaacactaaagatttcacagaaagggtcatgattgatttgagcaagcagggggtacgtgacaggggctgcatgcaccagtggtcagagtgaaacagaacagggcagggagtttcacaatgttcttctatacaatgtctggaatctatgaataacatcggtttctaagttatgagttgatttttaactactggggttaggccaggcaggcccaggcctggttttgggcctggcgccaggctgcctgtctttggttttacttccttgtttttttcttaaaacaggtactgagtataaaacaatatgagagggtctctctcttccctcagaaacagaacaccactgaacacatatattactgactttgaagatagcattcaacacttcatctgctaagcagaaaagaaaaaaataggcaaaatacaagcagttaagatacccataaggtctattcagaccttttaacttaaacttcaataactattatctagaaatatttgttttagaatataaagaatgcaggcaatggcagggaaggaagatttgataagatattagctgagaattttctaacattgaagaaagacatattaaaattaacactgcactttgagtaccaaccagggtaataataataataataataaaatgatagcataatagatccatagctagatatataatacaaaaatttcaggaaaacgacaatttaaaaaagtcttaaaggttacaagaaagaaaattctgtttatctaaacatgaatgacaatttcacaaatagtatatatctcattatcaacaagaaaggccagggaaaatgggataatagcttcaaagtggcaagaagagaattccacaccagtgaaatttaatttaaaaagtaagggaatataggatgcttttagaaataaaaagactaaatgaacttgttgcaaacctttacaacattgacttcatttgtaagaaagattctaaatgaatgccattttttccttcctgtgagtgaatttcaataaggagtttacaagaaggtttgctagtactcaaaactttccttgggctcctcaaaatttttttccttcccaggggtaattaccccaagttgtccagtctgttctcaggacctatgccttggtgtggttggttcagtggggaaaggatccctgactgagttacccccacctcaggtgcagaatttagacatttctctcactaaccagattcttttctgtttacattcatgcctctttttctgtctgtttgttgtctttaaattttcatttttcagaattgtttctatgcctcccttctcttactcaatattttgtcttaacatgtgaaccttggaatcacctggagcacttgttaaaatgtatcttactacatctagccaaacatatattaaattagcatgaggaagaatgaaacttataaatctgcttttttagcaatcaatgaagataattctaatttatactagagtttgagaggtgctacttttataaacttttagcattctcatgtatagctctgcttttgactaataacaattcattgagtcataaaatttatatcaaaatcaaacctttgttttcagttccatatgaatatattcacatgctaattggtcatttcaatataaatgtccgattgacctaaagttagtgcatccaaatttgaatccatttccttagccctttatttattgttgttgctgagcaaaatctgagtcactttaaagttttctctttccacatacatttgtttccacattttctgtcattcccaaggccatctatcctgagctagagccattgcttactagcctctacacatgtcctgttctgtcacatttttgtacttttgcacactgtgttattataagaaaaaaaaaaaacatactttgtttctgcccctggttcctgacatgcaactcctaaaaccattggaatctcttaagtgataagagtgcttttggtatgctaatgagatgacaggtggctggggccccctaagtagctttaggatgtgggcttgtcaccagaaagaccagggcatgattaaagggttgagactttcaaccccatcccccaaactccagggagggaagaggggctgaaggttgatcaccaatggccaatgatgtaatcagccaggcatacataatgaagcttctataaaaacacaaaaagacagcattcaaaaaacttccaggttactgacggcatggagattcttggagggtagtgtacctggagacagcatggaagtgccatgccccttcccactaaactctatacattgccctctgtatcttttccttctgtctgttcatttatttcctttgtaatatcctttataacaaactggtaaatacatgtttccctgagttctgtgagtctagcaaatcaataggatctgaggaggctgttatgagaacgccaacatacagccaatcagtcagaagcacaagtcacaacctggggctatcgattagcatctaaagttggggggtgccatcttgtgggagtgagccaataacctgtgggactgactctaagcccaagtagatagtgtcttaattgagttaaattagaggacaaccagttttgtctgctgagaattgctaggtatgtggggaaaaatcaccaccagagaaatctggtgtcagaagcgttgtgtagtgtgatgtgtgagagtaggaaaagcactttgttgttgttttttcctgtttcttagtacgcatgatcctcctcccagtctcagatgtcttaggcttcttctatacttgaatattccaattccgttaatttcctggtaaaatataacctcctccttgaggccttttctttctcctcagccaggtccccacccctatatttccataccaaaaccagttacaacactttccatggtcttaaaactacttgtttacatctttcttccctatcagtcagggagcccttgtaggaaagatctagcaatcagggttcatttgtctttgtatctcaaagttgagtatagaacatagttcagagctcagcacctgtttaaataagggcataaacgcatgagtgaattgacagacacttgaccaaggttcagaaaatctgcaaccaaattccaaatcagcgtatgtaatttttacgatgcaataattttctgtacttgaattattttccaacacctttggattcttaggataaaacaaaatataaaaaagagtagtcttgcattcagattttcagaagatttaattgattttacattgctctacagataatcataggaactaggactacagctatgtaaaacttgacattctaagcaatgttttcacaagaaaatgaaaacaataaaaactgcctgagaaacatgttaaacttcttatcaaatttaaaacctcttccaataaacaatggaatactcttcagctacaaaaaagaatgaaatactattatttgcagcaacatggatgagcctggcggaattattatgttgagtgaaatatatcaagcacagaaacataaataccataaatacagcatgttctcactcatatattggagtttaaaaaatgagctcattgaagtagagagtagaactgcagttattaaaagctaagaagggaaagggaggaagatgggcagaggttggttagggaatacaaaattaaagctagataagataaatcagttctagagtcctgtagcactgtagggtgaatattataaactataatttattgtatattttcagaaagctagaagacacgatattgaatattcataacacaaagaaataataaatgaggtgacatatgtgctaattatccggatttgatcattatacattgtatacacatattgaaatatcatcctgtatctcataaatatgtataattattatctgtcaactaaaaataaaaaggaaatatgtagatgggaaaataccataaaaaacagctaagggagtggaaaaataattgtctctagaaatggaccaggaggagaagagcagtaactaatattttgttatacatattttataatctgacttttaaaatatgtacttatgttactttgaaatgataaaactaatgttttaaatgaaaaaaaaaatagtacacagttggtaatggggagtagagagtttgacactgtggccttgtcccttatgttttcttgacacctttgggtgtcttgtgaattcagtctgtaagtcctgaggattcagatatttcttgatatctggttccactggaggccatttcagacagataaatataaaatttttaaaccagaaaaaatatacagtcaaaatactctaaaaacattgagagttatttgcaacatggtcctgataatggataggacttgggagagtgtttcaaaataaatattaagtagaatagcatgtacttcaaatttctactagcagaaagaggaatcaagaataatcccccaaacctagtagttgtcacctttttagaattatgatattggttaacatgcatacctcacagatatttcaggctaggttccataccactgcaatacaacaaacatcataagaaagtgagtgacataaatttttagtttcacagtgcatataaaagtaacttttatgctatattgtagtctacttagtatgcagtagattatggctaaagaaacaatgtgcacatcttaattaaaacatactttattgctaaagagtactaacaatcatctgagccttcagcagccagtggtaatctttttgctagtggagggtcttgcctttatgtagatggttgctgactgatcaggatggtggttgttgaatgttgaggtggctgtgacaatttcttaaaatacaacaacaatgaagttcactgcattgattgaatcttcctttcaagaaagatttctcttttgcaagcgatgctgtttgacggcattttacccacattaaaatttcttctttttcccgaacatttattttagactcaggaggtacatgtgcagatttgttacctgtgtgtattgtatgatgctgagattcggggtaataatgttcccgtcacccaggtactactgagaatagtaccccaaattggaatcaatcctctcaaagcctgctactgctttattaactaaatctgtgtaatattctaaatcctttgttgtcattccaacaacattcacaatattttaaccaggagtagatatcattttaagaaaccattttctttgttcaatcataagcagctactcatcccttgaagttttatcatgagattgcagcaagtcactaatatcttcatactccacttcttttctagttctcttgctatttccagcacatctgtagtacctttctccattggagtcttgagttcctcaaagtcattcatgagggttaaaatcaatttcttctaaattattttgacttcttcccctcacgaataatggatgttcttaatggcatctagaatggtgaattctttccagaaagtgttcaatttactttttccatatctatcagaggaatcactatctaaggcagctatagcctttaaacatgtatttcttgaataagacttggaagtcaaaattactccttgatgcatgggctgaagaatggatgtcgtgttagcagtcatgtaaacaacattaatctttgtgtatatctccattagagatcttgggtgtccagttggagtatcgatgagtggtcatattttaaaagtaatctttcttttactgaaagtacgtttcaacagtgggcttaaagtattcagtaaaccatgctgtaaacagatgtgctgtcatccaggctttgttatttcatttatagagcacaaacagagtaggtttagcataattcttaagggccctaggattttggaaatggtaaatgagcattggattaaagtcatcagcttcattagccctaacacatttacaacatatgcatcaaaacaaattaacttacgtaaatgtcctgtggtctgataaatgcaacataactgaaaatggattgatcatctctcgtctatgtaataattactccctgttgtattcataaatgggtttattaatgtcagatcaatcactaagaccaccagtgcttataaaaacaagaagaattcattgctctccaggcaagtgagaactaggaatgtcactcaagggacagttctcagggtctcaccaggttaaatgcagaagagccatgctcaatacagaaagaggaaaatttgtccacattaaaatttggaaggctatgatttgaatgtataaagagagaattttaaaatctctttggggattggacattgcactggttcatattacaagagtgtgggcacagagaccatacttttaaattagctgtaataataattttgtccttgcagggcaggctgaaagcttatgggccaggactttgtttcaattggctgtgtacaccaataccatacatcttgtgccatgctgggtacatagtgcttgccaaaaatatttttttgagtaaacaaatgagcacaagttatacatagtaacaaaacagccagaactttgcatcatccgcagaaatatttgccttaataatataaataattatttccattttcagcatagtgctgtgccttttcatgtctttgcttcaactccaagagattttctttagtatgggtttttgcatggttcttaactgatttttatcttcagttaatatccagttctcatatatatatatatatatatatatatatatatacacacacacacacacacacacacacacgtgatacttattagcttaataagtggttttgatacatcaatactctcaatcatataatttctgtgtatgataaaaagcgaggatgccaccgtctttttaatgacatattaattaaattaatgacgtatctctcctcctggaggaacatgggggtgctcagagtagcccacagtgtggtataaaagaataatcaaaactgagggatgatagtaggagaagtaaaaatcaaaagccatgtgatttttcatagcttgacagattatttcttttcactgatgaataatattccattgtctggatgtaccagagtttatttaactatttacctgctaaaggacatcttgatcactcccaagttttggtaattatgaataaaggtgcaataagcatccatgtgcagttttttgggtggacataagttttcagctcctttgtgtaaataccaaggagtgtgatggctagattgtatggtaagagtatgtttagttttgtaagaaactgccaaactgtcttctaaggtggctgtaccatttttcatttcagtcaacaatgaatgagagttcctgtttctccatatcctcaccaacatttggtgttttcagtgttttggatttctgtcattctaatgcatatgtagatttatctcagtgttgtttcaatttgtaattccctaatgacatgtgaatttgaacatcttttcatatacttacttaccatctgtatatattcttcagtgagatgtcggttcaggtcttttggtagtttttattttttaatttatttttaattgtcccataataattatacatatttatggggtacacaatgacattataatacatataatgcatagtatcagataagagtgataggcatatccatcatctcaaatatttataatttcctttccttgtgttgggaacagttaatatagtctttctagccacataatatactgaaaccacataatatattattgttaactatagtcatcctacaatgttgtagaaaactagaactcatttttcctatctagctgtcattttgtatcttttaacaagtgtctctctatctccctttctccctactcttcccagcttctagtatcctctgctccactttttatttttatgagaccaacttttttaaacttccacatatgagtgagaacacgtggtgttttactttctgttcatggcttatttcacttaacataatgtccttcagtcccctccacgttgcaaggaatgacaggattttattctttttatggccaaatagtattccattgtgtatatatacaccatattctttaaatccatccatctgttgttgggcatctatgttcatttcatatatttgttgttgtgaatactgctgcaataaacatgaaattgcatatgtttcttcaatatattgatttcttttcctttggataaatgcccagtagtggtattgctagattatatggttgttctatctgtagtttttttgagaagcctctataccattctccacagtggttgtactaatttacattcccattaacaatgtgtaagagttttcctttctccacatccttgcaaatatttgttattttttatctttttcataacagccatcctaactggggtaagatgatacatcattgtggttttgatttgcatcttcctgatgattagtgatgtttaacatttttttcatatattttttggctatttgtaagtctttctttgagaaatgtctgttcagacattttgcccgttttaaaaatcagactgttattttgctgttgagatgaagttccttgtatattctgagtaataatcccttgtcactttaatagtttgcaaatattttcttcccttcttcaggttgtcttctctctgttgattgtttttgttgctgtgtgatatggtttggctgtgttcccacccaaatctcaacttgaattgtatctccgagaattctcacgtgttgtgggagggatccaggggaagggaattgaatcatggggtccagtctttcccatgctattgtcatcacagtgaataaatctcacgagatctgatgggtttatcacgagtttctgcttttgctgcttcttcattttcctcctgctgtcaccatataagaagtgcctttcgcctctcgccatgattctgaggcctccccagccatgtggaactgtaagtccaattaaacctctttttcttcccagtcttgggtatgtgtttatcagcagcatgaaaatggaccaatacactgtgtgtttttaaatctggttatttgtttgcttattctgaaagttaataatttcttgtatatttttgatgaggcctttatctgatatgtcctttgcaaatatttttttttcaatctgtgcttgtctttccattgtcttgacaatgtcttttgcacaaaaaagtttctaatattaatggattctagattatcaattattttatttattaatcatggctttggtgttgtatctaaaaaattattgccaaacctaaggtcatttagatttttcttctatgctatcttcttggtgttcaattgttttacattttatttttaggtctgtgatccactttgagttaatttttgtgaagtatctatggcctgtctttagattcatttttttgcaaacaaatttccatttgttccaacacacttgttgaaaagagaaacatttccccattgtattgactttgatcctttttcaaagatgagttgactataactatatgtgtctatttctgggtcctctattctgttccactaatcttttgcctattcttttgctcattaattacagcatattgactactgtagctttgaacatgcatatttaagttaaattatttattaaatatcacatattccaaatataagaaatacagatataagaaatcattttcttatatgctgttatcattgtttcaaaaaactcatacacaatatagacatgaaaaattgagttttaatagcaacactagtatttgaaatagtactgccactgaaatcatttttctattttactataaattactactgcactttaaaagcgatatttgcaactcaagttaattttaaaacatgcacataactcagaaatgatgtatgacatattcagaaaatagatttatagtcagcattcggaaagacaggaaaacatagaagccctattataattaaacattaattcatcagaaatatttcaaaaactaaaatagcaattatgaaaatatttttaagtatatttaagaccaagacatattttaaaaaaaaatcttcaacaccaaagaagcacttttgatagcagaagacatccctgttcctatgagtgcagcattcccataggttaaattgcaccaacaaattggcttgcaattggttattttttaaaatttaaacttttatttcagatttgcgggggcacatatgcagggcttttacctgtgtatattgtgtgatgatgaggtttggggtacaattgatcctgtcccccaggtactgagtatagtatccaaaagttttttgtcccttgcccctttctctcccttccccctctagtagtccacagtttctattgttgccatctttatgtctatgagtgggtaatttttgttattagcattgattttacttgtacattctttggtggcatggtaaattgaggtaatctgttgttattaaacaaccggtacatatccactgtttagaaacaaagagaaggagaaactgcatatgaagtatccaggaaatgagagaatactaagaaacaatttagcataagtgacaacttttcttctccacgtagggtgcagaaaaggtacaaaattgagagtgcacttaaaatgacaaaaaaacatgaataagaaattcaggaaagcatttgtctttatgaattaagaacaattcaccaaaaaatctctcagttagaggtctgccgtgtaggtgaactaagcatgcatcaattttgaagggaagctatttagttcgtacgaaattgttgtctacagtgaacagtaactaatagaaatggtaccttgcaagataaacttacacatgagaatttaaatgtgaacataaagcctactgataaaatatgatgagtttctgctttttagattaagcaagtctataattaatataaccattcaaatatactggtagtggtataacttcattaatgacacacgtaattgatattcaattcagaacaatttttacagtttttaagcaattcttaatttcttctgccatatatggataggaaggcaatattgaattaggcagtctagcattttctgcatgtttgtgatcacatttaagttccattgctctcacaaaatttcctgaagctgcctatgtttatctaggccttcttttttatattaagatttataccatgtacattcagaaaacccattcaggagaagtccaagccaggtaaatattgtagtgtgtcaagatttgatgtgtaatgtgatctttttcaatgaatattgattaagtgcagaaattccttgcatatctggcctttccaccttatgtttcagtaattctaattgcaaaagaaaagtgataactcaaatgaggatagaataaataatttgtaaagggctcatcgatgtgaatagcttgttgggttttttttttgcttacaccttcacgttgctgccttgagttgaaaaacaagtcaaaactgaatgacaaattgtctagtatatctttctaagaagattgttgtgagaattaattgagataatatatataaagtgtcaagtacataataattaagacactagttatcattatgacatatacattaacaagaatgattgatgtttatttttagccttctaaatttctgataaccaaggtataaatatatatatgtaatgttttaaatgatttccagtacacaattaaattatttgagactgatatctgtctcaaaaaaattaagcagttcaaataaagcatgttcgtaacgtataaatatttttacttttaattccacagcaacaagtaaaattttacttatacacatcttaggatatatttaatgcttgccttcaaaatatccattccttctttcttcagcaataattcacaatgtttatttgaagactcacctctgcagagttctcattttaaattttttattctatctttctttcaagaatcaaacgtgtcctgcattcctttgagcaaagtctttttactgacatataatagttgtacatactttgggggtatatgtgatattttgatacttgtatactatgtgtaatgataaaattggggtaattgagagatccatcacctcaaatatttatcttttctttctgttagaacattataattcttctcttttaactactttgagatatacaataaattcttattaactatatatttttactatactatcaaatactcgaacttatttcttcaatatggctgtattttgtaccccttaacaaacttctctttatcccccctttccttcccagcctctagtaaccatcattcttctctctatcttcaaaagattcactgtttcagctcccacatatgagtgagaagatgcaatatttgtggttttgtgcctggcttatttcacttaacataatgaccttcagttccggccatgtcactgcaaatgacaggatttccatctttttatagctaaataatattccaatgtgtatgtataccacattttctttatccattcatcctttaatggacactaaggttgattccacatcttggctgttgcaaacagtactgcaataagcaagggaacacagatatctctttgatatactgatttcctttcttctggatatagacccagcaatcaaaatcaccatgagtaatcatctcactctggttagaatggctactattaaaaagacaaaaaataacaaattctggcaaagatgcagagaaaggggtatattcatacaatgttggtgggagtgtaaattagtgcagccattatggaaaacagtatggaagctccacaaaaactaaaaatagaactaccatatgatccaaagttattttttaagcagtgggcatatgactaaagaaaaaccaaatggggatttttgtaagagacccaagaaaaataaaatatgttctttttatgtatcaatctttaaaaacaaatttatactctgtgattttttgacatcttaaaaagcttgctggccagggagagactgcccttctcagagctagcactttcttagtgttagcaaaaggcttgggcctataggaggtctgtcatatacaaaccaatcaatcccagtctataggtccaaccacctcattttttctcacataccaagcccatatttctcctgccttaaatcacaaaagggtcaggtaccagaaaaacagccacatctctagctcaaagcccaataaaattattcaaactagccgatcttagcttgattattcctccttgccttgcttttctcatggaaattccaataaagactctggctttgaccttcctctcttgacttctaccaccagaccaaaacctggtgcttcccctggggtcctgtgtggtgcagtgactcctctctgcaaccagtgttaataaactgccttccaagccttgttctaatatcatcctgtggccatgttggctttaccataccgtatccaacatttaaattcttaaaacactttactgatctacttgaatttacgaaaaagacggaaccagtagagtcaaatgccccatgaaggaaggtactagagctgtgggaccaccacaagcaaccttgaaatgaagtctacacagatcaagagatgaaaagaaactcagtccggacaacttttttgaattctaaatccaaccatggttgaagctgtttcttaaaacttacagtaatgtgagctaaatatacactttgttgtttaatccagtctgatttgggtctgttgacaattgcaacagaaacaatcctgattccaaaattagtaccaaaacaaggagagctgaatgtgataaatcctaaattatgcaatttgctgagaagaattgaggtggaagccataaggaacagttattttgggacttggtaatttttattaaatagtaaccagtcagtaagttaaaatgttacctattttatttgagactaaagccatgccattgcaactgcatcatctgaggcttggaagtaaaaattcaggaaggaccttagaaaatgttgtgttgcctaatattttatctgtctcgccagggatatataataaagattcaagctatgacatctgggcacataaccatcaatgttaaactttagttgccacttgtttgagactaagcctgtcagatgaattatcctggatgtcttgacagatattatgtgactagattgtagatgaacaaaacaaactcattatctgtttattatttccagtctttattaacggtatcgacactttccaactcacctaggtcaaaatatagagacaggtttgactgcactcttttcattagtctgcatgtctacttggtatctcttttatcaatactgtgtcttcactcccaagacttcccgctggttgatgtctcattacctattgcttctaatgatctatgagattaattctctatctttatttaatatctctttcttacattgattatattcttacatcagagggaaaattggaggaaaatgatcaggtgaaagagaaggatcatgagcaaaagtacagaaatgaaaataaatgactattgtaattttgttaaggaattggaggaaccttgtccagggacagcacagacttatcataacagaggagaagtggtaagtaatgctgaatgaaaagcataaagtcatgttttagaaggctctgaaaagtggcagaggaattctgactagatatggtaataattggttatgcttgtaaaatgacatagtttacaaagcacaatagatgttttaatttaaattttgatttgtgacaggcaatctgtactacagatgagaaaatgaaaccagaatggtttggagtcttcaaaaaaatacatatctaatggaagggcacctgacttcgtgctcagtgttctttcttcatttattctacattaccttctgcatttttatgcaaaagatcaaaatgactgatattttatttaacaagtgtgctctgcctgcattagaaataaccctttggaaataagtggtttacgatgtagaggacaaagctgttttctatgtctgaagtgaaatagaggttatcaggttaggggagtgagcacaaggatgttagaatttgcatgaataaggctttgggggtatcatttagaaacaagaaacagtttcctgtaataatgttaacaaataaaccaatgatgataacaaagaaacattcctctgcatatcacagttagaatgtatgagtaaacttcctctctagcacagtgataaacatcaaaaggatacacacctacactgttaagaaaccagatatcagcagctagaagaaagcattacagggaagtcatacagtcaaatttcatatggattcagtatagcattgatataaaaataaataaaaatatttctggaaaagtttatgagacttttgctggggtaaaatgtgttttgctattttggaaaagaaaaatgaatatttcaccaaaacactaaatcatatttgtataacgagcagatagaatatgaagggagaggatagaaaaggagtggggtgcactggggatcactgatgagcaactttttcacaccaacaacattgctaccactggcaataaactcaatgcatcagggaaccgaaatgccagcccaatattggtaatctttgtcagagagtaataaaatggattaaataaataaaactaaacaaggtaaagagatgctatcttaatgcctctagaatcaatgagtgggcttgtttacttgcttggtaatgtttttgttttttacatttttgcttcatagttgtttaaatttgtttttcaaatgaaaatagatatgtaaaaaataaaatcataagtattaaaatgattacaggaaatagggaattcaaagtcactattacaagccgatttttaaaaaagaatatagtaggtgttcacagtgcttttatattcaattcaataattttattttctacttgcttatttttaaaaatgggaattataaaaactatcagtagttaaaaggttatgaggatattatcaaaagtaacagcaacaataaagtcacctctgatacactgcaacaaacagaagaaacacagtggaaaaactacctggcaatttttgagattctgctttttaaagtttacataaagttaaattgacataaaattatatggattaattgcatttcaattgctaggcacaaagctattatgcatttaaagcatactgcataatcaattttactgaaaatgaatccaatttatcaatagcttttctttgttgattattttgactgataaagagtaaaagcagccatcatatatagtagtgtgaagaaagaccatttctaacatttgatacacacacatcaaaaggtatcaataactgtaatctctgaatggatcaatttatatagtttctctttggctcctaaagtgtgagctaagataaccagttgcattattcttttatcctatataccagacattagcaattttaaaaggcagactctaaaaatagtgattcattgatctctaatgtctcatttcaatagtctgaagataagcactactgagctactaacatttttgtgattttgaagaataattcctgatcttcgcttcagaaatcaatatctgcatataatgataaactgatataattgctaacctaatataaatattttttgatgaactacattttttgggaagacattcacaaatagttactgacatgaaactattaggaccttatatctgaatagtatagttttggggaacaatgtgatgtatacccatcttcaatgaaggacttactgcctgagctgctgagagtgctgtggacataatctttttgaccgtcattcccttcagggattgcctcaactgcagagtcatctccaccaaggtcccattcctttccagattggtctacatgaggtatcaagtcaatatagatatataaattcctggccagatcagccttcctgtatctgcagaggcaagcttagaaactaagtccactggtgctgtcctgatgactaggactttgggagtagacttgaatctggagtagtccttaagcctggggccaagggggtcagcctggtactagggggcagtccggagcctggggccaccctagccctaaggtgagcctggtgactgagtcttatgggtgtacctacagcctgagtcagtaagagttggtctggtgcctggacaaaactgacacatgaggtttctgcacctagtccatcactgacaccatttcagaacctgtagcttttggaattgggttggcagtgggcagcctgtggatggacttcaatggtgagactggagcctgctgctacaatatcaagcctggcatcagggcaggcctggagcttgaatcattgattactggcctagtgtctaaggcatagtgatatgcttgatgttgggatctacggcaaaatttagtgctctctttccttccgccaagggaaggatagctctctttaagctgtgttgcctgatgttgaggtagaggtaatgtgaaaatatggatctttcctaacctcttcaatgcatctttttttatttctgtgttatgcttagatgttacagtctctcacccagtttccttagcccttgtgaatgtgttttgtgagtggacagttgttcaaactgatgtttctgtgaagtcctactctgctgtattgtcatcttctagatcttctagtaaatttttcattttaaatactatacttttcaaccctagaatttccatttggttatttcttttaatttatgtctctttattgattttctctatttgatttgccatctttattaaacaagtaagctttatttttgtaatcatcatttcctttagttctttaatcatattatggataatctgaagttcttatctaaaatttaacatctggttgttctcacaggtagtttctttggctatttttttccagtgtaggggtaatactttccaatttctttgcatggctaataatgttttgttggaaactggacatttcagataatagttctagcaattctgaatactgatacctggcctacacccccggggcattttaggaagagtataagtcaacttcctcctctgcctcattgtgaagtctgctgttgctactcagggtgcataaccttgggtaaacttataggcatcagtgggataagagtggcttggttgtctttaattggctctttctctttttcctcaccaaaaccagctgttaagcaccactaattgctgcctgattgctttattgttttcaacaatgccctgagggtcttaattgcttcacagaacactccagtcaaatattaactcctttcaaaagatggttctggaactcagattttgagatatattctgaccacaagaggacttgtcccaggtgtctctctccaggtttctctccagaatactaaacagactatagtttagcctgtatagccaatgaatctatcaattttctctcccaattttctttcattacaacttctacattttttgaggcatgaactccttcaaaatctgttcaattaaagcgaattccttagagacggaatttggaggtttcttttctaagtcttgcttccctcctcctcccatcccacagaaatatttatgtgtgaaagttctagttctgggggaagaaatattgacgcatttcactttaagtgaacctcctctttagttgctgaaggctaggcagatgttgtagcagaacccccaaatttctttggcttgcctcccttggcatggaacccccagtctttaagtttgggcatggggaatcaagtcccctgtattctcagaggtgcatcctgacctcagctacctgttgctagactatgatctgtgtatatgaggccgagaggtgaagggctttcttctgttctatgagtgggttctgagagaaagaagagagaccctcacttattggatgagaaatgttgacatactgcccctcttgagaagacagccttataactaggagctgtggagagagggagtttttatttctgctattagtttgcagtggaatgtccacctcacttagcttatgcaggtgatagagaacatggatgttggtacaaaaattaaactttcatgattcttactgcaaatagtgaagtagaggctcctcttcaaagagattttcctccccatctaattaagaataaatagtaacttctcttagaagcaaaatttattcaaagacctgtgataatattcttagatatctgctagctgtaataaagaaatcaacatactttgtgttcttagttcccacaatttactctaaatatttgctctggcatgcttatactggtccaagcaagcattaggtcatagcctgttcctcttccttatttggaggtgtttttacctttctcaggattccacaaattacttcctctttcctttgttctcttctgcctttgcctcttttgaaaagttctaagttgctagccaatcaggacaaatacagaatgtgaggtcccattccagccaatggaaaccagacacagcaatagggtggacgcatcaggttataaatgaccctgtctccttttttcagtgtactctcatggcaaaactgctggcgagtgtaccctttctgcagaaagttaaaaaaaaatggccttgatgagaaagttaatgttcaagaactatttctttgtgatactggagaacaagcatttctaacattaccatgttttagtagattttcttcaataagtgtttttatacttgcagtataccattgggaacattttcagagaatttaaatggctcctttcaaagtaattttcactacttgagatggcaatggggtctttggagggccttacactgtcatgcccaattttgttatgacctaatttaagaatataatttgtcttgacccagtacacacacacacaaccacatacacacacaaacacacacacttaaaacctaaaaccaaatccaaattttgtggaacaatatttttccttactaagtgtgattctctctgctattttctaatctattttgcttaattagaaaaagttggaatatctaaattgattttacccccgctaacagattgtgattcatacattatgtaacactgctcaagttgatttgcagttttgttcattcttttattttattaattcaacatataattatttagcacagtagttcaattttcattctgggcagtacaaatctgaatgaaacaatgatttgttcagaggaacatagaatctacttgagcagtctgttaaaagtgaaaatactattgacaagagacatgacattgaagattttcaagtggaggtattgtgattatacctatactaggaaatcaattctggtgttgacataaatgttgcataggtagtggggagaaatcagaatctagtataccagtttagggctgttgcagttaagtcaagaaacattatgtgaacccaaatttaaatgttataatagcattagataagtgagagttgagagatgacaatataaaatacatgtaggatatagactcagtaagatgcagtaatagggtgatatcagcataagaatgctctcgtgcagtggaggatgcatgtaacatcatttacttaacaaggggaaaaagtgagagaaagaatatgtttgaggaaagtagagaagaaagtgtttctctattctgcaaatctgatcatttgtctttcataattgagaaatatgaactgtcagaaaaaccttaactaaaaactctggtggaaattttagggattaaacagagagttacacgccactgagttaaaatggagaatattcagtagctctgatttttgtgcaattaaataattttgatgtaaatgttttatgtaagtatttggcactttttggtgtttcttttagtgtaatgactattgtcacttgcattttagtgatacgtagtttatttaaaaagaaagcaatgtatttaacaagtacataccacacgatcactttaaattaagtgtcaatataagcaaaggctccaggagctttacacttctatttttattgtttcattcagatttgtactgcccaaaatgaaaattgaactggtgtgctaaataattgtatgttgcattaataaaataaaagaatgaacaaataaacttaaactgcaaatcaacttgagcagtgttatataatgtatgaataacaatctgttagcaggggataaaatagattaaaaatagaaataattttttcaagcaatactcaacatttttccttttctctgttcatttaaacaataacaatacattttttttctgcccatcgtactgcctaattaatgcctgagttagaagttcagaaatcactttgacgccaataattgtacgttataacaagactacattccctttgtacctgtgctactgaaaacaggcagtggtaacaggcatttgttcagaaataattataaagttgcctttagcttaaatgctctagtaaaaactttgtgtgacagtttctagtgaaattttacctacttgagaaatttgaaaaattgtaaatacctttgcagttaataaaatgattattttaagagacatttccattatcgatggttcattttatatttcattgtttcaaatcaaaatattttaacttatattattctcttcaacacttcagaattttttgtttacactgctttttttttttttttttttttgagacagagtctccctctgttgcccaggctggagtgcagtggcgcgatctcggctcactacaagctctgcctcccgggttcacgccattctcctgcctcagcctcccgagtagctgggactacaggcacccaccaccacgcctggctaattatttgtatttttagtagagatggggtttcaccagggtctcgatctcccgacctcgtgatccgcccacctggcctcccaaagtgctgggattacaggagtgagccaccatgcctggccacaatgccttatgttttaatcaaagcttccaaaatttctatctcaaatcacctaaactttataaagtccttgaaagattatagaaaataatatattaatatcaaattcgctttatgattatcatacttttcactgtgttaaaagactttcttttattattattattattattattgagatggagtctcattctgtcacccaagctggaatgcaatggtgcgatctcggctcactacaacttctgcctcccaggttcaagtgattctccttcctcagcctcccgagtagctgggaatacatgttcctgccaccacgcccggctaatttttgtatttttagtagagatgggatttcaccatgttgaccagactggtcttgaagtcctgatctcaagtgatccacccaccactatgtccggcccagacttttatgttttatagttaaaacttatttcctggacaaaataaaaataaaacaagacagaacagtggaaataagctaacttttgcaaagtaatattgtttttctttaccagtgatctttgggtgaaaccttttcttcctatttcatttattgcctttcatgacatcagacatccttgactattacttctatagaactcacttgtattactaatgttgctttgtattttctagtgtatatttaaggtttaaattttatgttgatcaaagttctataaatgtcaaaaagaagaaattctctaatctgaagttttgaaaaatctctggattgctgtcaggtaggaagtatgtggtacatgactcaggatttgtgaaagaaaatgtaaatatcaatccattaaatctgattatttccccattgtcttggtttatatcctgctgcaaaaatcctaaggttaaacattaatgctgttatgcagctttgagtctgatacttgataatttgtgaaatgtttacagaataataatcaggagatatttttaaatttttgaaaagtgtcattattaccagagtgataaaatattcaagttttttttttcaaacacaccttacatttacagcatacaaggaaacaatgacatccatacagaactttagtagaactcaatgacccaactgaaaattagtcatttgtaaatacactgaaatgtgaaatgactggtcacaacaactaccataaagccttctgtttacactactcttccattgatatatttattctctcttttttagttttatacttgctaactgagatgacagaactttacaggctcattaagaattatttggcctgaagatgaattgctatgatctgaaatgaattgtgttacatttaagattccagtgaccatcttcatgccaaggttgattacatttaaaatgaaaactttgaaagaagttgaggaattttctctcagaataaagcaggggaggaacacactgcacaggagattgtaagtgaggaatttaaaatccaaactgactgcgtcctactaaaaacaaaaaaaaaattagccgggcgtggtggcaggcacctgtagtcccagctgctcgggaggctgaggcaggagaatggcatgaaccccggagacagagcttgcagtgagccgagatcgtgctgctactccagcctgggccacagagtgagactctgtcacaaaaaaagaaaaaaaaaaaatccaaactgaccagggagatgcaggtaggagctaaaatgcagcctctgaaagaagccaaacagtaaaacatggaagaagacaaaaaggagattcaggggggattcattgatcttctcagaaaatgtgtattgagtattgtggaaaagggtttgatagcatggactggttatggagggtctagactggaatcgtagcctaggtgcatgacttcaggacatttatgtaacttttctgtacctcagtttcctcatctgttaaatgaagttggtaacccctgtaaagccatcaaatcaatgttcgacatgtggcaagtgctttataaagattagccaatattactatggtcatcactatcattgtggttattgtttcaacattttattaccagtaagtgatccaacaaatgagagataagacagagtgcccattctcaaaaagctttatctattgcagtttttcagttatgagtttaaaagcaactgatctttttaaaacaccttacatacatttttaaaatataaaagataaatataagttacataaaatataaatgaataaatgaattgctgccactgaagttgtaatggggaatcaatcaggatatattatgctgttgtattgtttattctttggtttctaattacctagttattaataattgagcctgtgacctggggataacccaatactgtccaatatttgctagaatgttttcataaatcagagtataaggtgttccctgtctctgaatcaatttcattatctttgattttcaaactttttaaaatccaacagaaaatatgcaaaatatccaagaagccaaaatgaaaaaataaaatcttaactacaaaaatttaggagcttaaaagttgtagatatggaacatacatattagtgaaataagattaatcagaactttatttaaatacccatggggttgatagttggtaaattagtgttgctacaagaacatctctataatcagttaatgaaataatatgacttctttattaagagttaaaaattaacatgtaaacaaagaagctttatgttagttatagcggaagttgaatacctgatataattttaaagagaaactgttttcagaaaactatgatccactcttcagcatttctaaagttgaggcaaaggaaccaagtttgatatcttcagagaaaatctttttggccacagtgtcctatgcagtttgttctttaatacattcttctattttttaaagaaaattcaagaacattaaggctacccatggaattgagaaaattattattgatgactgtctctatgcatggataataaaaataatagcctcatttattaaacttttgtcacttcaaatttcaatcaagtatcttaaatgaacttgggagaagactttaattagaaatggggagagcttagactaatttccacgagggaacagagcagacaggagcctggggcctggaaccgcaacccttagtgaatgaggcagagggatcctctgtggaggaagaaggtgcaaggattgttcccttgatatgagagagaggctcattgatgggaagatttagtcccaggcctgacgtgatgtttgtctactctcaacactcaagagtacctgctgcttgtcaatggagtcttcactacttgggtggaagtcactacctaactgtgtagcacagtgtcccaccccatctcctctgtgatgatatgtaattaccagcttctccaggccccactggaaccctgggcccctgttccaggagtagaaagcctgagcagtggcggtattagccttgagaaagatgaaaatgtgagcagccaaaggaatcatccagaaacccatgaagcctgcagtcgagccatgtgagtcagggaaggcagtgtggggaggggaggaggatggcaaatatgagacatctcagaaataccctcccttttagagggagagagaggaaatgaggaaaccagaccagaaaaacagatgtgttacaaatatacatctggactataatcttaagttcaggttctgtgcaaatatctgtcatccagtcaactaccagtgcattagttattatagttttgcctctatgatgttcatatccaattacataataatataatgatcaatatttcctttgttagataaatatttttaaatggcagcttttaaaatgacttctcaagtatatacccttgctccgtggtactggcacaagtatttgtgagaaggaccaacgttgcactaatctgtaatttgtaatttcacagaggcacacatttgaattgcacaaactaggggagaaataacaagtcactgtgcctggcctcccttctagcatatccagaagaatattgttcagtctcatttatcccatatgcaattataaaagcagtttttaattttgtaaactagataaaaaattaaagatattaatcactgctgatgatgctagagtttaaaaattgaagtaatctgcaaaactcacgattttaagaaggaaaacaaaaatgttggttacattagagaatgcactggtgaagcaatagcttcaccatgtgatttatgatgggaatgggcctcctataggttttatgaggaaacaagaaaaaactttgctaatatgactttagtggatactgtggtttatagaaaatatgctcatccatttttttaaaaaaatcattagtgaaaattgaagagtcattttacttgaggtctggcaaatgtgtaactctcaagagaaataaaatttaaaagacatttagcaggtatcccttcatcatcatctctcctatttcattaatatcagctaatttgtttttagccctactggagttataatatgttattaggctgggtacagtaatagcaaaacttactgcaataaccttatagaggaagtatcctatatttatataattattgaggatttttaagagattgattttatttttttttatatgctaccatccttgatgggggaaattatatgctagagctaggttggaaatccaaacacttaatatatctcaatctagaacatcaagatcatactatatctccggttattttatttattagcaagtatttttaagccctatgtttgttacatatccccatatattagtttcttctcacactgctatgaagaaatacctgcgactgggtaatttataaagaaaagaggtttgatttactcacagttctgcatggctggggaggcctcaggaaacttacaatcatggtggaaagcagctcttcaaagggtgacaagagaggatgagtgtctagcaaggggggatgccccttataaaaaccatcaggtctcgtgataactatcacaagaacagcacggggagaaaccacccccatggttcaattacctcacaccagctccttcccacatatgtgggaattataagactacaattcaagatgagagttgcctggggacacaaagccaaaccatatcaacccatatttaatgagagacaacaaatggtttctgtattcaagtatttcataatctgctcaaaaaataaggcatataaacaagtactcatatatcaacaataaaatgaatgctacagagaatatgggttatagaaactcataggagaaaggaatatacgaggcagactggtcaaataaatggtggaaatttatgatttaacataatcactctggattgctaagaagagatttcagggagaaaaagtagagagagagaccagtaaaaagctttgttccaaaccagactaaaaatttggtggattagaacaaggtagcagtagtaataatggtcaaaagtagttggattttgtttatatattttgaaggttacattgacaaatttgctaacggatcagatagggagtgcaatagaaacagataaatcaaagtttggcccaagtttcttggcctgaataaatttaaaaaaatagaattgccatttactgatatgagaagactttaaaaagaatcagtttgagggaaaattcaagaagcttattgggtggcatgttatgataaaaaaattaatatccaaatagtgatgttgagtagataattgataatatgagtctgaagtgcagtgaagaagttcagactgaaaatacaatgtttggtttcttcagagtatggttgataaagtcctaagactggtgaaattatctagggagggagcatacacaaaaggaatttcaagattaagcctggggggcaatacaatgttttaaggttagggaaatcaggaaggacaactaaaggaatctgagagtgagtggccagtaacaagggggaaattttaagatacagcgatgctctaaggatgatgtgaggacagtggtttaagatgggtgcaggttaagggatatgtacctttggattgagaaagtgtggtgagagtacaacaaccaaagtggcaatggtactggatgcttcatctaagtaaatattgaagtcatcaagaaccatgtaagggtggttcaggaaagggtggcactggactaggtgctgagggagagttactgtgatatattcagtgactgtatcaaggaagaggaggtgtgggggattctgatggcatgagctccaatgctggtatttaggggagatgggcaatgaacagtgcagcgtgacaacggtgaggaggtactggtccaaccattgggcttagtcatctgtggagccctgagtatggcaggaggtttagtatgtcttctctgaggctttaaatgtctatagcagcaaacgaacactcccctatgcattttcaaataccacctaaaggggtgttattgcccctggttatttccaaacctcattttcttgccctttattggcactgtctcaactatgtgatcctttcaaatttgtaaagttctatacatatccacaccaagattattgttacatagccccaacagtcccattttaatggaggtcaagacggctttcaagagaacctcttttttcacccagtggtttacaagacttctatgtttttatttacatttttaggtatggaatcctttgcttaaactagttacatagaagtacaaatgaataaaacacatgtatttagtattagtattttccatttaaattctaagagtgtgtgtgtgtgtgttggtagttggtgggacaattggcagagaaaataaagtagcatgttttaaaaatgacaaccttaattcaaaaggatgagactctgataggatactttcagaccccacatgtgtgatgacacttatttgtagaaattatcccttcctgtatgtgatattttttaaattatactgcccagtaggatacccattctgcctaaacctgcctaagataatgctaaaggtaaatctaaaggaacagggatgtttaacagttttttcagggatgttggtattaaaaatatagccgggcagatctgctgtgttctttaacctgccacagtttagaatgacctgaatctgaagtttgcagaacaccaagccgaagtagggttgtaaacggggatgtggacaggctactctgagtttttcctcagcaagtgctcgactttgggtttctatgtccatccttgccaaatatagtcctagcaagaatcttgctaagtcaatttagagagaatcagccatccttcacgtctgatcacctggcctgcctttatcaagaatcctgttaagtccatttaggaagaagcttctcacccttgatgtctcttcctagtaattttccacccactgatctccttatgctgctctttgactataaatttctttttatttttaacttttattttaagttcaagggtacatgtgcaggtttgctatataggtaaattgtctgtcgtggggttttctgtacagattatttggtcacccaggtaataagcatagtacccaataggtaatttatagatcctcaccttcttcctaccctccaccctcaagcaggccccagcgtctgttgctcccttctttatgtctgtatgtactccaggtttagctcccacccataagtgtggacatgcagtatttggccctctgttcctgtgttagtttgcttaggttaatggcctccagctccatccacgttactgcaaaggacaccatctcgttcttttcatggttgcacagcattctatggtgtgtatgcactccatttgctttattcagtccaccattgatgggcatttaggttgattccatgacttggctattgtgaacagtactgagatgaacacatgcatggatgtgtctttatagtagaatgatttatattcctttgggtatatacctaatagtgtgatttccgggttgaatgataattctaagttcttacggaaattgccaaactgcttttgacaatggctgaaggaattacgtttcccacagtagtgtacaagcactccctcctcttcataacctcaccagcatctgctgtcttttgactttttaataacacttggctataaatttcttattgtccttgttgcatttggaattgagctcagttctaaactgaagtctcttttcccctattgcaatagtttctgaataaaatctgtctttactgctttaactcatgtctggccctggttctctttaaaagaatggaggtaagaggtgaggtatcttacctaaaataacaccctgccaactatgcactcccaaatctggtaacttatttcgttctttactgcaactgtgtaaatatgtgtgcttacgtgtgtgtatggtggatgggtgttcagataaattggagacaattttatctactttgtagtatcattacacaaattaataaataattttatatacgttaaacacttaatagacatgcaatatgcaataaagatttcctattattataatgttgtgtatgggtagggcagacaagtaaataaggaaaactgtggtgatcattaataataatttaagcaggctcatatcttaaattttatagagctctgacttttaccagaaattattttcagttcttttttattgataacaatgttattaagaataataaatgaggccgggcacagtggctcacacctgtaattccagcactttggaaggccgaggcgggtggaacacttgaggtcaagagtttgagaccatcctggccaacatagtgaaaccccatctctactaaaaatacaaaaaattagctgggcatggtggcaggcgcctgtaatcccagctacttggaaggctgaggcaggagaattgcttgaacctggaaggcggaggttgcagtgagccgagatggcgccactgcactccagcccaggcgacagtgtgagactccgtctcaaataaataaataaataaataaataaataaataaataaatagctgatttaataattctcttatgtgtttaatgctaagtcttcagaacacttgtagcccacatcatgcctaaaattatcccttgacaaactttggtctttttcatactgaaaatatataaaagtgaaatgtattccataaaataggcttcctcagcctccgatctgtcctcctcttgaggaccctgatgctttagagatcatttaattttcctcctcttgaggaccctgatgctttagagatcatttaatttaggaaacaaaatagacaccatcacatgacttttcatgcattttctcctcttttccccttcttgtatccctaggaaatgagaaaaatgtgtagctatcagggcatgagagtcattcctcatcaaaactcattttgcttttgatccctgaggaaaagggagatactgaattggttcatggggaagttggtcaaattccaaagatggtaagcctgtgtgttttcccatgccatcttgtttctttttcgtatagtctctactagttttctaaatcttcagaatgacataagatttctaatatcaacttaggtacagcctcccagggactggtaagtaagttggatatattcagtagcttattaacatcattggattatccaaaataaatttaaaaacagaatttacatagggcagcaattagtttacaattgctctagtaaattaaaatgaagagaaagcaaattcatccccttctgtagcttggttttgttacacaccaggatcttccatgccactcaaagactttcagcttgtggcaataccccagaggactctcaagagagtttattgacttagaagaggctgaaaatacttaattaagtaagcctactgcaccatggcatgcctgtgcattctttaacatttttcccatcaaaaggtggggtctatattccctttcttaaatccaggtcaacacagtgactctcttgttaccaatagaatgtcactgaagtgatgttgttgaacttctgtgtttaggtcagaaaatgccatgcatcctctgcgtggttttcttgtaatacactctctgtgggaaaatagtcaccacgtacaaaatcaaactactttggatatccatttaagaaagactatatgcaggcacaactgtcgaaagccctagcagagcatctagcattgtgaaaatggctaatgtgtgattgtactctcatgagagaatatcaattattaaaatgcaacaaaaatgtaccctaaatctgcacatcaaatgtagttgatgagaaaaattccatttgctattgagtactttcaaaaaatataccagtatcgctaatacctatgaatgcattattatattttctgagccaaagtggaacaaaattagtctacataagctgtactgttgatgtttccagattacttgaaatttctaagtaattcactaaatataagaggatcatcagagttcaaggcagaagtcaaattttatttcatattttgaattcatttgatatatatgattctatatcatagaattcccgtcaaatgcattcattctcaaggaaaatctttgttgaaagctaaaaaggtctattttttcaagattgttttaaaaattaacacttgatgtattagttcgttctcacaatgctagcaaaaactacctgagatgataatttataaagaaaagagctttaattgactctcagttccacaggctgtacagaaagccgggaggcctcaggaaacttacaatcatggcaaaagggcaaagagaagcaagcatgtcttcacatggcggtgagagagagagagaaggagagagtgccgcatacttttaaacaactagatatggtgagacctcactcactatcatgagaacatcaagggtgaaatccacccccatgatccaatcacctcccaccaggtccctcccccaacaatgggaattacaattcaacatgagatttgggtggggacacagagctaaaccatatcacttgcaaacacttgaataaaagataaaaactgcttctaatttcaatcaagtgcctaacaatatgttaaaaatattaattaaaatgaactcagtcattaatgaactcagtcattaagtataaagcagaattgttgcttctattttgtttattccataccaatatattgccatacttccttcctttactatctttttaaaaaaatcctagggcataagaaagcagcccttattacattagaaactgaattatacatcatatactttttggtagtatccataaccaaattaccataaatacattaagaacatcaagatgcacagtgacaatacaaaattaagccaaatggaagtctgaaaatattaatttgtaattgccttattgttctctaaaggcctagggaatgtagaaagataatctggaaatcaacttggaattggattgagaaaaaaatgaataaatgtgagggaataaagaaagtgagaattgtgattctgatttattactgggagaaggctgagatttaatttaatattgtcacttttatcacaggaagtggcatgttaaccatattaactgtaaactattaacaatagtattactactaatacagtagagttaataaaaattaggataatattatccccaaaattggaagaaagagttatactggcatcggaatccaattgtatgttcggtagaatatgacatgcccctgttcttccttatcttttttctgatcctaaatatgggcctgtggtctatgtctctgcagagagaatttccactccgatttaaagagaaagtagactaattatatatattttttccaatttagacagaaataatcatgataacattcttgcagaaaactcatacattccactttagacctttattgaaagttttcttttgtgggtgtcattcagaattttgagacttcatgattatattgttataactgatgattgaattacttaattgtatctgtcaaaagcaatgaggcaatggagaaaggaacttgtgttatttttaatggaaataatttgtttgctttatttcatcaaattacatgcaggataatattacaggatgattaattaacaaggacacaaactaatagcttaataactctgaattccatgggtttttctacagccaagaaaaaatgaagatgattttatttattttttttttgagatggagtcttgctctgtcacccaggctggggtgcagtggcacgatctcagctcactgcaagctccgcctcctgggttcatgccattctcctgcctcagcctcccgagtagctgggactacaggcgtccgccaccacggccggctaattttttgtatttttagtagagacggggtttcaccgtgttagccgggatggtctcaatctcctgacctcgtgatccaactgcttcggcctcccaaagtggatgattttatttttaaaggctcatacaagttatgaaatcagttaaatatattatattttaggtagagtttatctgatatgtttagttaattttcacctacatgggaaatttgcaatgcagaacgtctaaaatagactcccagtagcaaatgctctggttaaactccaatgttatgttggtcaggtcaacatacagaactagatgaaggaaaattgatttcctagccaagaggcaaattgatcagagtagacaagttaggataatacaacctattgcctcccaaataagtagaaactcatttttgcactcctaattgcacaggggagattttaaacctggccaaactaggaaaagtcatgcagaacatttaatcaattagtaaaggagctgagttttcattcatggccataactgtgtttctttggagaagattaacccatttaaaggtcctcttgattacaataaacaacttatctttaaaagattccatacatacagatataatagttttaaccaatgaataaggataagaattgtcacaacataacttcacatgactgctcttttaaaagtgtttttaaaagttttataaaatcttcgattagaagtagtaattaattatatatgccagaattccccagaaacccaggaaatatatcaaggctgtcttttcttgtctaagtatgctccaaggcaaatttatattcaataattactgaacgtatcaccaatttatttgctacttattgtagaaaacaaaatgcttgaggaatctcattctttctaagtatacttattgagcatctcttatgttttgatgctctgctggttgttggggatacaatggttgaacaagatggttataattgctgcccttattgaactcaggctaatggggatagcagatattgcaaaattaaagataacaccacaaagcagtattaaagagaacaacagtgtgatgttgttcgaggaacatacgtattcctcactttctagtatgtttccagaaagaaatgacatttagattaagacctgaggaataagtagaagtgtttaaatcaatgcatgtggtggcattgtgatgttctccccagatcccttttcatgaatgaaggacttggatctttagctggcaaaaatgaagctggctgacagcatcaagctgtcaggccccttcataaattagataaatctttggacaaagagagttgctttaccgaaatttttcaatttggatgcccttacttttttcttttgcctgattgctctggctaggactttcagtactatgttgaacaggagtggtgagagtgggcatccttgtcttttgctagttcttacagggaatgctctcaacttttccctattaagtatgatgttggctgtgggtttgccatatatgacttctattcttttgagatatgttacttcaatgcctagtttgttgaaggtttttatcattaatgaatgttggattttatcaaaagctttttctgcatctcctcagatggtcatatggattttgtttctaactctgcttatgtggtgaatcacattcattgatttgtgaatgttgaaccactattgcatccctggaataaaacctactttatgtgataaattatctttttgatgtgctattgaattagatttgctgatattttgttgaggatttttgtatctacgttcatcagagatgttggcctgtagttttctttttctgttggtgtccttgcctgttaccagagttacactgattttatagaattaattagggaggaattcctcctccttgatttttggaataatttcagtaaaattggtaccagttcttctttgtatatatagtaaaattcagctgtgaatggaagatattttattactgattcaatttcattacttattattggtatgtttaggatttttttcttcctggttcaatgtcaggagattgtatgtttccagaaatttatcccctttttctaggtatacagtgttaataaagtctacagtagtatatagtaatatcctagaccttcacattcactcacaactcactcactgattcacctagagcaacttctagtcttacaggctccattcattataagcactttatacaggtgtaccatttttatctttcatgtcatatttttactgtaccttgtctatgtttaaatgtgtttagatacacaactacttacccttgtgtgacaactgtttacactattcaattcagtaacatgctatacagttttatagcctgggagcaataggccatatcatatagcctagctgtgtaacaggccataacatctagttttgtgcaagtacactctatgatgtttatacaatgatgaggttgcctaataatgcatctatccccattgttaagttatgcatgactgtacgaatttcaaacaaaatgcagtattagatgctctcggactataaaagataataattaaagtacaaagagaaatactgtttattgctaaggagtacatctctaactggctggggctataagacagatatattaaaagtagagaaataaatctttgttttagatataatgaaatatgtgtattcaaccctgttcttcaactaaatgcaataaaaagtaccaaattgatgaaatagctaatgaaatactctgaaaagtaattgtagcaagcaggttcatttaggaaactggaactcaaagtaatgctgattcaatgatgagtttcctatatttgctttttttctctattatgcccaggcctggaatcaaatataactcaaaccccagaactgagcaccatttgcgaacagaaaagattcaagagatttcttatttatcttacttgagaactgtacaacagtctcactaaaggtcagagctagtgaggaaaaatgccagttttattttatttttttccccaatcttttctacccaggaaggcaatctcaaggcagcaaaagatgtgtcaatgataaaattaggggcactgaataggccctaaattccacaggaagggaatttccaggggaaatgtaatacaaaaatcgtgaagagactcttcgtagcttttccctgtctctgtcatctcattccttggcaacagagatagataaaaccattagaagtacataaccaaactccagtttttagtgagacatccacagcagagggacattgggatctggcatgtattaaggagaagagcacaaggaaaaacctcaacaaagctatagcatgaaattgagtgtgaactcaagaactcactaacaaacttctcatgtgtcaatctgataataaatatcatatcaaaagcttttcaaattgaactaggggatagaccaccagccaggctgtagactgtccaccagttgtcacataaaatgaaagaacactgcaaacacattaaaaatgaactgaaattagaatgatcagtacgcagaagacaggttagaaatttcagtctttttttttttttttttttttgagacggtgtctagctctgtcacccaggctggagtgcggtggcgtgatctcggctcactgcaagctccgcctcccgggttcacaccattctcctgcctcagcctcccaagtagctgggactacaggcgcctgccaccacgcacagctaattttctgtatttttagtcgagacggggtttcaccgtgttagccaggatggtctcgatctcctgacctcgtgatccgcccgcctcggcctcccaaagtgctgggattacaggcgtgagccaccgcacccggcccccagtctgttcttaaatgagatgattgtctgctgaaacagaaaagacaacaacaacaaacattttctttaggaataaaacaaaatataacatagtattcaaaatactgaggataaaattcaaaatcatttgacatacaaagaattagaaaaattttaaaaattttcaagggaaaagataactaaaagaagccaatactgaaatgaaactgatctcacaaaaggctttaaagtaactactctaactgtattgtaagaagttagataagtcactcttgaaatgaatgtaaaggcagcacatatcaacatgcaaatagaaataaaacaaaataactgaaatataaattcacttgagggctgggagtggtggctcaggcctgtaatcccagcactttgcaaggccaaggcaggcggatcacgaggtcaggagatcgagaccatcctggctaacacagcgaaaccctatctctactaaaaatacaaaaaattagcctgatgtggtggtgggcacctgtagtcccagctacttgggaggctgaggcaggagaatggaatgaacccgggaggtggagcttgcagtgagccaagattgtgccactgccactccagcctgggtgacagtgcgagactccgtctcaaaaaaataaaataaaataaaataaaataaaataaaataaaataaaataaaataaattcactggaatttctcaagaacagagcataagtgacagaatgaagagccagtgaacttgaagataaatcaatagcaagcatccaattcgaacaacagagaaaaaaagatacaaaaaataaagagtttttacaacatgtgggacaacataaaaaggtataagagttgtgtcattagcattctaggagaaggggataacgagtggttctgaaaacatatttgtagaagtaatgcctgaaattttttcaaatttggggaaatattttaaagaatgcatattccagaatgtaacatctcaagaaactcatgcccaggaaaccacaaaaaatatacagtaagaaacatatatatatatatatatatatgtatgtggacatatatgaaatgcaatagataaaataaaatggcatgctacaatattcaaataataccaaaaaaagggagaaaattggaaatacagaaagaagaagaaaaggaagaaaagttaaattaggaagagaagaagaggaagaaaaacaagaccaagaagaagaagaacaacaacaacaataacaacaacagcaaacccacgtgagggaacaaaaaataaatattaaaatggtagccctactgggcacagtggctcacacctgtaatcccaacactttgggaagctgaggcgatggagcatttgaggccaggagttcgagaccagcctggccgacacggtgaaaccccatctctactaaaaatacaaaaattagctgggcatggtgtctggcgcctgcaatcccagctacttgggaggctgaggcaggagaatcgcttgaacccaggaagcagaagttgcagttagccaagactgcaccattgcactacagcctgggtgaaaagaacaaaactccgtctcaaaaaaaagtagccctgaataatcaataaaatttcaataagggtatatataaactgaaaagattggcaaagacttgtacaccgaaaacaagaaaatatcactgaaataaattaaagaaggcacaaataaatgaaaacacattctgttatcatagattggaagatttaattttgttatgatgaaaatgccacacaaaggaatctacagattcaatgtaacccttatcaaaaatcccaataatgttcttgcaaaaatagaaaacccatcctaaaattcatatagaatcataagggaccccaaataaccaaagcattcttgaaaaagaagaatgaagtttaaggattcacatttcccgattttaaaatattattccaattttatcattacacaaacatatatcaaaacatcacactataccaccataaataggtaacactatttcatgtcagttaaaaacaaaataagactttaaaaaattaattacaaaattacattaatcaaaacagagtggtattggcataaagaaagtcacacagatcaatggaatagaataaagagccagcctggaaataaaccctaacatgtcaaatgattttcgagaaacatgccagcaccataagataaagaaaatgcagtcttcttatagatgattttggaaaaactagatatccacatgcaaaagagtaaagttaaattcatactttatatcatatacaaaaattaactaaaaatagatcaaagacataaacaagacataaaaccataaaacccttagaaggaaactttcgtgacaatgaatttggcaatgatttcttgaatatgacaccaaaagcacacacaacataaaaagaaaaagagtaatttggatgtctcaaaatttaaaaatttgtaactcaaagcacactaacaagagagtaaaaatctacaaataccttagaaaataaataacacactgtatataatctgcccatcaaacaaaaattgtcaagatacatttctgtcgcctaggctggagtgcagtggcgcaatctcggctcactgcaacctctgctgcctgggttcaagcaattctcctgcctcagcctcctgagtagctgggattacaggcacctgccaccacacccagctaatttttgtatttttagtagagacgggggtttcaccatcttggccaggctggtcttgaattcctgacctcgtgatccacccgcctcggcctcccaaaatgctgggattacaggattacaggcgtgagccactggcgcccagccccatgaatcctaacttattatttaaataaatgcaaatacattaaaaactctaaaagtcggagattggcagaattgatttttttctttttttttaaacttttattttaagttcaagggtacatgtgcaggtttgttacataggtaaatgtgtgtcacagggatttgttgtgcagattaattcatcacccaggtataaaggtcagtaccctctccctcctcccagactccaccctccagtaggccccattgtgtgtagttccccctatgtgtccatatgttctcatcattgggctcccagttataagtgagaacatgtagtatttcattttctgttccagtgttagtttgctagcgataatggtctgtagctccatccatgtccctgcaaaggacatgatctcattctttttctatggctgcataatattccatgatgaatatgtaccatattttctttatccagtctatcattagtaggcatttagattgattccatgtctttgctgttgtaaatagtgctgtagtgaacatatgcatacatgtgtccttataatagaatgatttatattcctttgggtatatacccagtaatgggtatgatgaattgaatggtatttctgtctttaggtccttggggaattgccacactggcttccacaatgactgaactaatatacagtcccaacaacagtgtataagcactcctttttctccacaaccttgtcagcatctgttattttttgactttttaataatagccattctgactaatgggagacagtatctcattgtggttctaccataaagacacatgcatgtatgtgttcatagcagcactattcacaatagcaacaatgtcaaatcaacctaaatgcccatcaatggtagcctggacaaagaaaatgtggtaatatacaccacggaatactatgcagccataaaaagaatgtgatcgtgtctttgaaggatcatgaatggaactggatgctgttattcttagcaaactaatgcaggaacacaaaaccatataccacatgttctcataagtgggagctgaaagttgagaagacatgaacacatagaggggaacaacacacactggggcctattggcaagtggaaggtgaatgggaggagagagaggatgagacaaaataactaatgggtactaggcttaatgcctcgggggcaaaataatctgtatagcaaacccccatgacacaagtttacctatagcaaacatgcacctgtatccctgaagttaaaagttaaattatttttaaaaagtaaatttatgacaatcaagtaggctctattcctgggatgcaaggctggttcaacatacacaaataaatacatatgattcaccacataaacagaattaaaaacaaaaaccatgtgatcatctcaatatacggagaaaaagcttttgataaaatccagcatagcttcatgataaaaactctcaacaaactaggaattgaaggaacatatctcaaaataataagagcatctatgacaaacctacagccaacatcatatggagtgggcaaaagctggaagcatgccccttgagaacaggaaggaaaggatacccactttgaccactcctattcaatatagtgctggatgtactagacagagcagccaggcaaaagaaaaaaaaataaaaggcatccaaacaagaagagaaaagggaaaactatctctcttcacagatgatatgatactatacctagaaaaccccatagtctctgcccaaaggctcctagaactgataaaaaaaaaaaaaaagaaaaaaaaaaaactttagtaaagtttcagaatacaaaataagtgtacaaaaaccagtagcatatctatataccaatattttccaagctaggagccaaataaagaatgcaatctcattcataataaccacaaaaaaatgaaatacctaggagtacaactaaccaagaagatgacaaatatctacaaggagagctacaaaacactgctgaaagaagtcacagacaacacaaagaaatgggcaaacattccatgttcatatttaagaagaatcaatatcattaaaatagtcattctgccctaagcaatctataaatttaagactattcttttcaaactaccaatgtcatttttcacagaattagaaaactattttataatatttcaagttcctgatctttcgatggggagttttgttttcacattatttgatgcccttgtgggtttaattgtagcataagttaggtttagtagattggctttgtttctggattctttcaggggaccaagactcagctcagtactcctgggctgcatgctctaaccttagggtcttgaaccagccccatgactttgttcttccgcccctcaaagtcaagcacctaccgtgctggaggggctgaggtgtttccagtctctggtaatgacagtctgatggggactgcctgaaaatgcgctctggcagggcagcagagtgtccacgggagagtgcactgcggcagggtggccatggacaagtgcacacaagcaaggtggcaggggataggggggtggccacaggtggcaggggttgtgggcggggaagctgcaggtaagtgcacatctacagggcagcagagaagtcacgggcaggtatgcagaggtggggcaccataagcacatgcataccagtggggcagcattgggtcccaatgcccatatgcacctacaaaatggtggggagaggctacaggtggatgcatattgtggtggtagttacaggaatttgtaactgttttaaaactcagaaatctactacaaatagtaagtaaacacatacatgcatgcatgcatacatacatatatttaaaaagtccattttcttttattaaattaaaaataaacaactttttggtttacataagtgatatacaagtttaaggcatgagaggaatctctggctttgaactggtcagataacattttgctggtattataaaataggatgggacccttgaaaaagagaatttaaataggtaaagaggtggcaagaagggcattttaggagcctaaagaaaataaagacagctgcaaaggatggatgtgcagcacaggctctggaaatagtgactctttgcataagactgacgcagaggatttgttttagacaggaggcagtaacctggaaagtctgaggggactaggactgtgttcagcatgtatcattgacttgctactctttgtgtgcagctgggaaacactgaatacttttaataaaataagtgatgtggttataacaacatattagggatattagctttaatgcactctataaggtggattgaaagtaagagagactaatggggagttgattatgttaactcaacaagaaaagcgtccaagctaaaacgacagcagtgtgattgaaatatataaaaaactagactcgcaaattatttcaatattggatataatttcaaaaacataatttctcacgacttattttcaactgttctttcctaatatttcaaggtgaacaaaatgtttccagcatgttttctgaggattgattattgatgaaaccagttgaaaatattttcctaaacctgaaaaacgcctttgaatgcattaaaggaatttagatttaaaataagaatccaatgatttgcaatatttctgatgtgattaatttgccagaaatggtttcatgacattattaaaacattcgagatggcctgtactatcaaaggtgaaagtttcaagtataataggaaatcatgtatttcattgcttgttaattttaatgtaagctcatagaatgcatttatacgtacccagtgcctttataaagttcatttctatgtaaatataggaatatcataagctatcatgaagcacagacaggcaagtcatgccaaaaccattcttatggcagctataaaatgaagaaaaccaataaagctaagtgtttccctctcaaatctttacttctctcatcttgtccagcattagtgtgtgggatgtattaaatctaacctggagatatccacccaccttatttttccacccatcaaagtttagcagtttgtgttgaatggacacaaataaccctctttatggagcaatctgacctattcaaacaaaaatatatcattcctcctagcccatggtgaagaaaattaaagtaatcaatactaatctctagtcagtatttcaaataaaataacaggtagcatttatattcaaccaaagtgtatttaaaatataatacacctgtgcatacaagagaggcttgaggtggtattgtcatgtatcatatggtattgcaagcataataaagatagttgtggcagaggagcaggaaagtaacatagaaaatggaataaaggtattacccattcatctctgcttcgttaaagcatttcacactctagaacctttaaatcttactgacaattttcaatgtacgttaaaaagtaaaatgcactggggatgtccattgaaaactaagagaaagattcttctacacaatcaatatatagttatttcctttgtctcccacttttttttggttttcactttgcagacactatattttctttattttgatgaatatactaaatatctaaagtttgagcagagaagcaatgctgctctggcttaagcagcaaaagatgacctaataggatattccatcttaaattttgtttcacagttgagcatgaattgcattctgaaaactgggctacataatttgattattacattccttaatgtgtcagtctaaaatcaataatagaggacttgaagaagcccagtctttcttttttttttcttttttttttttgagacggagtctcgctctgtctgtcgcccaggctggagtgcagtggcgcaatcttggctcactgcaagctccgccttccgggttcacgccattctcctgcctcagcctcccaagtagctgggaatacaggcgtccgccaccacacccggctaattttttatatttttagtagatacagggttgcactgtgttagccaggatggtctctatctcctgacctcgtgatccacccgcctcagcctcccaaagtgctgggattacaggtgtgaggcaccgcaagaagcccagtttatgtcaatgacaccacctgctttaaactcaatggagaccaacatcacaggaaagtttcagatcctatctatgatgtactctattgtgacttgagacactgagcaaaataagaaatgtgtaaaaacatgctcttcagaaaaacaaagagaacaatagcatgttaagtcaatatccaacataaaaatgtaaaccttgaggttttgacacagccactgaagctttcaattctcaaaaaaaaaaaatggagaggctgtgaattagattacagaaataatttgtatggtacattttatattgttatttttcttttggggtaatcattttgcaggacatcttgtctagtctctatttgtttactaagaactggaagcttgtatctaatggaccatgcaactttactataataggtagacagtattttataaagaatttgaagaatgatttggaaaataagcccagtgttaatataataggcatgattcttgggggttttatgttcaatatggcaaactgtaaaatagtcattttaactgtttcattttttcacatacaaaatgtatgtttttgtgaacacctgcaaagcctcaaaacattgcttgaggaacttctattttttaattagattataatcatcagtgaccacagacacactattaacatcactcaaatttgctaaaagtgacaaaagtatagcccggtatacaagatggaaaaacattttttaggtaaatttggtggttatggaagagggaaaaaaggaatatactttggtgttaccggctgctgagctgacagcttcccgcaacagctttttagagacattttttctaagttcacatttctttgtgggcattcacacacgcaccagtgacacactgagccccagaaatggacagtaatctgtaatagcaaagctgtatggattcaaggggaagctgcaacaacctgtttgggctcatatgcaaacaacagtgtcttctccttctgatctgttatggacaattaccacaaaaagaactctcacctgggtatcggtttgggttttgtgactttgtatgtgggatctgaaagtccaacgtctggagacagagagtagaaaagtggttgccaggggctgggagtagaggaaatgggaataggttggttaaagggcacaaactttcaattataagataaacaagttctgggaatctaacttatagcatgggtagtgatggatgtgttgatttgagtgcgataataattacacactgtatacatatatgagatcatcataccatacaaatcttcatttgtccattaaatatttaaaaattaaaaaaatgtttcaggtgctggctcagcttatccaggtatttaagttctaccaagatgtctcatcacattttttttttttttctggagatggagtcttgctctgtcgcccagggagtgcagtggcgcgatctcagctcactgcaagctccacctcccgggttcacatcattctcctgcctcaacctcccgagtagctgggactacaggtgcccaccaccatgcccagctaattttttgtatttttagtagagacggggttttactgtgttagccagaatggtctcgatctcctgaccttgtgatccacctgtctcggcctcccaaagtgctgggattacaggcatgagccactgtgcccggccctcatcacatcttttaaaccacacttaaagggttaccccatcacaataacattttgtggtctttgtggtttctgagtttctgtgggtaaactgcgaattacatagtccgtgaggaactagaatttgaggttagacacatctggattgaatagatttgccacttcctatatctacgcacccttggacaagttgcataattcctcaaagtttctgttgactcacgttatttatatcacagatttactataagattaagtaacatatgtaaaggacattatacaatgtttgacacatagcaattctctagatatgttaggttgctttctttttgatatatgttctagtacacaaaagcaaaataagccaaattttaagtaaacgaaaaacctaatttctgaaatatataagcaatataatttgtgtatcagtgaatcaagtcatgagtttcacatcaatcccaagttacattaatcataacattatttgttattacagttattaatcgtaacaagcaacattacattacttgttaattataacaagagtaacacttttgttatgattaggatggctttgcaagtaaatgctttccttagctacctcttttttctctctttctttctctctctctttccccttccttctttctccctcgtcccttccttttcttccttccttctttccttccttctttctccttccttccttctccctccttccttccttctttcttccttctttctccttccttccttccctcctctccctctctttctttcgtgtcttaaaattgaggtgggttttacatcctctgaaaggacatttttcatgctacttcccaatcattctacccatgacaagccttttcttcttatatctaataccatgggttactttggcctgttctagaactttatataaatgtaatcatacagtatgcattattttgtgtctatattttcactcagcacaaaatgagattcatccatactgatttacatatcactagtttatttttattggagagtggtactcaattgtacaaatatatcatagtgtgtttatccattcccttccattttttgttgttgttgtttttgagacagtctcgctctgtcacccaggctggaatgcagtggcacgatcttggctcactgcaacctccgcctcccgtgttcaagtgattctcctacttcagcctcctgagtagctgggattacaggcacccgccaccaagcctggctaatttttgtatttttagtagaggcggggtttcaccattttggccaggctggtcttgaactcctaacctcgtgatccacccccctcggcttcccaaagtgctgggattacaggtgtgagccaccgcgtctggccattcccttccatttttgcacttattttttgctagtgttttagtttggaaattactatagatcactcttgagcagatgaaaagtttcagggaaagttaacataattagtaattcagaatatcccccaagataaatgatatgtattatttcttaaactttttaaaatttatagagcaatggtcagaaatctacaggctatgagtcaaatctggcacttcacatgtttttgtaaataaaatttcatagaaacacaaccttccctattcatctataaataatttaagtcttctttcatgttaccatggcagagttgagtagttacgacaaaaaagtatgattctaaaaaatgtctatttggttctttacagaaaaagttttccaacccctgtcctagaataattatcagactgattaatgctatctgacctctacaagcccatcaaaatatcttcagtgagtttgttacagctggttagacaggcatgagtgggatgggaaagggctttcatcccacctcccaccccccacccactaggaatatcaggagatcatcaggtgatggttcagcagctatcacattgcttctctaaaattgataatttggcagccagtgccagagagagacaatctcctgatggtccacacctgtcacactaaagtgttatttgaaagcaggctccagaaagaggcaacttcccaaacagataaaaatacttgagattggtaatcagcttccaataaaatctcaggtattgggctagtgggaccgggtatgtgcattgagagacaaaatggcagagcatgaccttccgcaggtattccactggtaaagggaagaaagcttcagatgggcatgtgaacaattcctaaacacactacgcatgctcacttcccaagcctaagaagagcactgtgcatgtgggcagctcacccaaaggaatgaatcatgggaaaggcgcgcaagatgccaggtgtgggccagcatataaagtcctaggatctgtccttcaagttgcccgcttgggtctcttctaagtgtactctcctttcttttctgctctaaagctttttaataaacttccactcctgctctgaaacttgctttggtgtctttttttgccttatgcccctcggtcaaattctttcttccgaggaggcaagaattgaggttgatgcagacctgtagggatttgctgctggtaactctgataccttctacccctaacaagttaagatataatagtaggcaatggggatcatattgctctattttttatttaaaaagaaacacatcattttagaggtttggaagttatcgcacagtacaatgcacctcaaaatgcttaaaattgaaaaaattatctagaatttatcaaaaggatacatttgttttgaagccatggcgcattttcttttaccaaaccttgagaatatctaatgcatagtattttcttttctgcattgtcagccaagaataaatactctacgctaagcttttgttataatttttttttatgttttcataattttgaacgattacttttatatttgcatgtgttatttaagtgtttctcttccagtgaaccaaatcaaatgcatttgaaacaaggaatggcagaagtaaatatgtcaatatatgcataacatagaaatgttaaaatacatcagaatgtgatcacccaatgggttcaccttgcccactgcctagacagagccaatttatcaagacaggggaattgcagtggagcaagagtaattcacacagagccggctgtgtgggagaccagagttttattattactcaaatcagtctccccgaaaacttggggatcagagtttttaaagataatttggtgggtaggggcttgggaagtggggattgctgattagtcaggttggagatgaattcacagggggcaaaatatctcaagcactgaccttaggttttgtaacagtgatgttattcccaggagcaatttggggaggttcagactcttgcagccagaggcttcatggcccctaaaacttaatttttatcttgcagctaatttgttagtcctacaaaggccaaagggtccccaggcaagaagggggtttttacaggaaagagctattatcaattttgtttcagagtttacactataaactaaattccttcccaaggctagtttggcctacacccaggaataaaccaggaaggcttagaggttagaagatgaggtcatttatgtctgatctttttcactgtcataatttctccagttatcatatttgcaaagatggtttcaatcacatcacacaaaactcagaaaattatgaatttcatgcatacaaatagccttcactcatctcgatatgcttgccgagaagatctaagtccacaaaaatttgactgagcataaatttgcattggctttgcctatattcaccaatattatctcctttccttctagttattgttggtatatcattaaattaacacaataaaagaccaaatgtaaacaacagaatattatgaagaccaaaggaaagataaaatgggaaaatgttaatgcttataactgttcctcttaaagtttgatttcttactgctctgtaatggttacctaggtatcatttagtaattgtgcacaaatatccatggccatttaaaatgcaatcataaccacatttgtggatacttaatagtcaatttacagtaataattgaaagcacaaagaacaagtttttgcttaattactatgtgacagactgtattttgtactttcgtgtatatgtgatactgtagtgcttttgaccagtatgctgcattaaaatacaaataaaactttatttcagatgttacttgttatatagggtctgcaactgctaagtgtcatttggccaaaaaataaatatagagtgactggatgaaacctccctgaggacaaacattaaaagattgccattctcaaagatttaaatatgggacacctacatcctacaaagtgatgtaaaatattatggtattgagtggtatgagggtaatgtatgcagctgcaataaagagaaaaatttagatatatttaccctcttacactgtatctgatagtaccatcaagcaatatcacatgttttacggtacaacctgaggctactactttttaagattctacaaaataatctctgtctctctctctctttctgtcattataccgtagtattcttggggagaacagagttgcttaaaggcatcttaacttctaaccttttgggatatttcttttactcaacagactatatctcataacataatagctagaaataatctagtctaaaatatttactatagcagcatcaaagaagtaatccaattcaaatacagaaagagacaaaagaaaaattatttactttaaaagtgtattttttttttcaataaaaaggggggaacctcagatttacctcaatgtttcctttggtgcaaataccatattgaagactaatattatttcagccatggcataaaaatgttttaaccacaagtgttagacttcataacttcacattcaaattggatttcattttgtagttcacatttttatgaatttggagggaaattaagttaaaatatgtaataattgaacgtcaattatatgttcgacttcatgcatgagaattgagaggaagggagaggatgtatcttatttagctttttgtttataatatctagcacagttccttgtacatagtagtaatcaatatatttttgctgaaagataaatgaaagaatgaaagaacattgtattagtcatctattattgtgtaacgaatgatctaaaaacttaatgtctgaaatgtttattatctcattttctgtggatgaggaatactggcttatctgagtcctctggttcagggtctctcacaagcttgaaatcaagttgttggtataggatgagggtctcctctgaaggctcagctgggaaaggatccacttgcaaatttatatggttgtcagaaaaatgcagtttcttagggcctgttgagctgagggcctggattcctaactggctttagctggaaccactatcacttctttgccacgtgagcctctatgacttggcagcttgatttataaaagtgtgagatttgggaaggcaataaagagagtttactagcgagacagaaagtcacaatcttttgtaacttaactacagaagtgacatcccttcaccatagccatattatattgttaaaagcatgccagtagatccagtccacattgagggaaaggatttaaacaggctgtgaatactgcaatttctccttattgcagtaaggtcctctgaacgggctataccatggttgagccactgtgacccctgtgacccacacatacaggcctcctggagtcacaaagcctggagcaacaggagaaccactaaagaagaaacagctagttcctgccttaaccgattaaccgacgttgcaacattccaccattgtgatacgttcctgccctaccctaactaatcaatcaaccttgtgatatcgtgccttgtgacctccccccaccttgtgactatgcaccttgtgacattcttctcctgcccgaaaaaactgcccctaactgtaactttctactacctaccccaaacctataaaaccagttccactcccaccacactctgctgactcctttcttggactcagcccacttgcacccaagtgaataagcagctttgttgctcacactaagcctgctcaggtggtctcttcacacggatgtgcttaacaaataccagtagttagaaatcactggggaccaatgatttgttatggtccccaataacaaatatatattaaacacagaagaaaattcttaccatgcagaaatccttccaattcaaaatgagtcaaaaaatttaaaatagaaatgaacaaatatttactataaagtacaaattatgtgataagtgaggaataagctctgtttttttttagacgaagtttcgctcctgttgcccaagctggagtgcgatggcgtgatctcggctcactgcaacctctgcctcccaggttcaagtgattctcctgcctcagcttcccgagtagctgggattataggcgtgtgccaccatgcccagctaattttttgtatttttagtagaaaagtggtttcaccatgttagccaggctagtctcaaattcctgacctcaggtgatctgcccgccccagccccgcaaagtgctgggattacaggcgtgagtcactgtgcccagccctgattttttttatcctgcccaaattcctacctaaggggtcaggggagtcacgtcctataaaccataatttctcatcagatgggtttcatttaaccctgtatatcgtgacttattttccaatctgactctggcataacaaggaagaaaaaatattttgccacaaagcatgtttctctgccatatcttgaaatggccctgcaaatctatcccttgtgggaaaaatccacattctatagaaattctcttttccttttgttttccttttttcctttccagatccaggagataatcaactaagagccaggcactcttttaggtccaataagaaacattttacaacctgctctccctgaagtctgccatctgagagcttcctctccgcaacaaaacttggtctccacaatcttttatcttaacttgaacatttactttctattgatctcaggtcttcagataaactcaaccaattgtcaaccagaaaatgtttaaatttccaaatttccttatagcctggaaggtccctgctttcagtctttctgaaccaaaccaatacatttctttttttttttttttttttttttttttcagacggagtctcgctctgttgcccaggctggagtgcagtggcaccatcttggctcactgcaagctccgcctcccgggttcacgccattctcctgcctcagcctcccgagaagctgggactacaggcgcccaccaccacgcccggctaattttttttgtatttttagtaaagacagggtttcaccgtgttagccaagatggtcttgatctcctgacctcgtgatccgcccgccttggcctcccaaagtgctgggattacaggcgtgagccaccgcgcccggccagagcaagttttattgtgcgacagagcagtttccaggggagaggggaactgagggggcggccccctacctgaagctaggtagctcccccatcaagtgtggctgagtccagcgcttttatagacccagaattggggtggtgtgggccacaagtagcactggaaaaggcaacattcaattgtttaacttgaatttaaacacttattcagaaagaaccaatcaggaaagagcaggcaaataggaatagaaattttcactccaggtcacaggcttcacctggtaccagcaacccagttttcaggcatcaggctgtttttggtttgaaggtgaggtttcactggggacccgatcctgtctgcctaagatttgtctgtcacctgcctctatcacaaagatgtgttctgggttttcctaagataatggtggttagctaaatcttagtttacaagatttctgcaaaccctatgaaaagtcatacagatcaacaaagataacaaatataaccacaaataacccacacgttcatcataacaagaaggcagaggatactacgtattttatattacctggaagtgagaggtgacagcgtgctggcaagtcctcgcagtcctcgctcgctctgggcgcctcctctgcctgggcgcccactccggcggcacttgaggagcccttcagcccgccgctgcactgtgggagtcccttcctgggctggccgaggccggagccggctccctcagcttgctgggaggtgaggagggagaggcgcgggcgggaactggggctgcgcccggcgcttgcgagccagcgggagttcccggtggggcgtgggctcggagggccccgcactgggagctgccggccagccccgccgatcccgggcagtgaggggcttagcacctgggccagcagctgctgtgctcgatttctcgccaggccttagctgcctccccgccgggcagggatcaggacctgcagcccgccatgcctgagccttaccgccccgccccgcccccccccccccccccgcgctccccccgctcccccggctccccccgctcctgcatggcacgagcctccccgaggagcgccgccccctgctccatggcgcccggtcccatccactgcccaaggacagaggagtgagggcgcaccgcgcgggactggtaggcagctctacctgcggcccggtgcaggacccactgggtgaagccagctgggctcctgagtctggtggggacttggagaccctttgtgtatagctaagggattgtgaatacaccaatcagcactctgtatctagctcaaggtttgtaaacacaccaatcagcaccctgtgtctagctcagggtttgtgaatgcaccaatcagcactctgtatctagttaatctggtggggactgggagaatctttatgtctagctaaaggattgtgaatgcaccaattggcactctgtatctagcttaaggtttgtaaatgaaccaatcagcactctgtgtctagctcagggtttgtaaatacaccaagtgacactctgtatctagctaatctagtgcggacatagagaacttttgtgtctagctcagggattgtaaatgcaccaatcagcatcctgtcaaaacggaccaaacagctctctgtaaaacagaccaatcggctctctgtaaaatggaccaatcagcaggatgtgggtggggccaaataagagaataaaagcaggctgcctgagctagcactggcaacatgctttggtcccgttccacagtgtggaagctttgttctttcactctttgcaataaatcttgctgttgcttgctctttgggtccacactgcctttatgagctgtaacactcaccgtgaaggtctgcagctttactcctgaagccagcgaaaccacgaacccgccgggagcaacgaacaactccagacgtgctgccctaagagctgtaacacttagaaactgtgatttctatgtgatggcaattaatttaaatgcttacaaatatctagtgagttaaatatttgaatttttacaacatttcaaggaaaaaaacatgtccaagtgccaaaacaaaagcaattgcaatcacacttttgctgtcccttacatagcttttcgtaactctgccctgaaaatctaatttagagctttgaaagcagcaaaatgtaattatatttttattagatacacaaactgtaattatattatagttttcttctgtgaatattctaaaatgtgcttttagaggattctttaacacaaatgctgcctaaagtgacaactgcttgaggcaaagaggttatgaaccaccactgtaaaattgtgagagctgcaagacttatgcatgtgatcactgtacatgaagctcaaatttttttcaagtgtttattaaaaacagccaatcaacacataaaacatcagaaaagggctgggtgcggtggctcacgcctataatcccagcactttgggaggccgaggccggcggatcacctgaggtcaggagttcgagaccagcctggccaacatggtgaaaccccgtctctacaaaagtacaaaaattacctgggcatgacggcatgtgcctgtaatcccagctacttgggaggctcagggggaagaatcacttgaacctgggaggaggaggttgcggtgaaccgagatcccaccactgtaaccgtgcactccagcatgggcaagagaacaagactccatctcaaaaaaataaaaataaaaaaaatcataaaagtacaagctgccttatgcaagaactgtagtgtggtaactatcatacaaagtttacatttacttctcaataatgtacatacatatcatatttgaaataatttaagattctttctgtttctcccaaaatggattgtacaaatgcttagttttaggagacaactttccccttccagttccatataaaaatagtttgaaacagagaaaacctccttttttttttttttttttttgagacagggtctcactctgtcgcctagactggagtgcagtggtgcgttctcggctcactgcaacctccgccttccaggcccaagcgattctcctgcctcagcctcccaagtagctgagattacaggcatgcgccaccacgtccggctaatttttatattttcagtggagacggggtttcaccatgttggccaggctggtcttgaactcctgacttcaaatgattcacccgccttggcctcccaaagtgctgggattacaagcgtgagccaccgctcctggctgagaaaacgtccattttaaaaagtcaaacattccttccttttcttcctcctcccctttctcaatctttccattccccttcagcctaacatcctcatcatatacactaatctatacttagagatgcaaataccgtatgtagttgagatatgcatgtatttctacttaactattaaagccttatggaaatggcagttgttcaaataaagcttaaaaaatgagaaactaattttaacttcagaagttttgaaccttctgtagggatcttccagtatggctataatacttttgatcataagaatatccattggtacaaaataaagatgtaattagccactgggtagaagaggttgagacaaattggaattatgtgaatatattttatgtactgtatgtatcccccttgtctggaactcaaatatattggatatgagaacctaagtgagaggaacataatctgttttgagaaaaatcatgataaactgacattctacattgtatttgtttgtttggttggtttttttttttttttttgagacagagcttagctctgtcacgcaggctggtgtgcagtgacgcgatcttggctcactgcaacctttgcctcccgggttcaagcgattctcctgcctcagcctcccgagtaactgggattacaggtgcccgacacgacgcccagctaatttttgtatttttagtagatatggggtttcactgtgttggccaggctggtctcgaactcctgacctcgtgatctgcccgccttagcctctcaaagtgctgggattacaagcatgagccaccgcgcccagcctctacattgtgttttaaagctgatctgtgagagtcttgatattttatttggaaaattatattcccaagaagaaatatgttttttgttatgttcctaatttggagataatctagactagtctttttaagtaaatggattcataagagctaagtcagacaattattatctgcttgtttggtaaatcttttacaataaatatagctgacagctttaagagcataaatgcaggtttctaagataagtatttaaataaatatagtctctaataatatacattttaatttcaaagttataagtcaacagctcttagtaatactgtaacaaaccttttattattggagaaaatttctgttcttttttagcaaatccttaaaaaaccactcgactttatgaaatcaatatatatttaacttcagttgtatttgaacaggtatgtaaatatttattaatctctgttttgctttttcttcttacagtatataatagttagcactgacttgccttctcaaagcacctcccattttcaattgtctctctttctctgatgattttcatgaacctctaagacctgtggattccacctcagttgaactttctagctatggtgaaattgataaatatggaatacataattttgtttccatggccaacatctaaaaataagaacataacatttttcttatcatttgtatttgaatgttcatttctttattcattcagcaaatattgagggctttcattgaagggataggtccagttcttgtccacacagagcttttaatcaagaggaaccaactgacaataaactgccaataccacaatagttttaaaagtttcactgtgctaacttctaccttggagaactataggaggccatgagagcgtaggtcctgggaacctgactgctaaggatcccacaggaagagaccaacacacgcaactgaagggtgagcaaaatttagctgaattttgtaaagaaggagaaagctttttctgctcaccagagcagcccgtggaaattgttcatggtaaaaactaagtgggcccatttgaggaagaatttatgtgggtggagtggagggagtgggaagagcttgccaataaacaaaatgggcaaaataggcaagggtgagaccattcaaggtatggtgaggatttgggacttataataatcagagacaactcaatgttttatgaatggaagttatgttcttttttaatggtaaatttattgaaaggggattaggaaagaagttaatgaaacttctgcagtagttcaggcaaagtgatggcttgcctaagggtgaggggaagatgtagattaagatcaagaaatgtcttgctagtgtaaattgaaagctatatgaacagtcatgaatggcaactagaatcactgagcttatcacttcagtgttgaatacatacccttaacaaatatacataatgttttaatcaattttcagaaattgcagaatggttttttggtctaaaatgagaaagattgaaagaatcacagcaaaaataatgtcacaaaacaataatgataaagatcatttgggtgtggcagtgaagtgatgatattgaacaaaaagagcatgtctttcattgaaagtttatccttgcatacttactgttcaacttaatctcaggatcacagggccaacaagtcatgcaatgaaagctatgttgaccaagaattcctgttactttggtaaatttcctcaggacaatgattgagttttaattaatatatcagaatatcagtaattttttaaaacagaatgtttaataaaatatggtaaataattaaaaaccattaaattataaattatttacaaaattaatatacattttgatatgtaataaatacatttcatagcaaactcaagaaaagtgtctcaatgataaagaaatgaatttcaaagtataatgaaaattattttccatgttctttctctaaattactgcagttttctctgatttaatataaagtatatccatttgattgacaggagaacataataaacataagaaattaatggagtcactgaagacaaattttaaatataataaagttggtaaggtattcaagaaaaatagaggatgatacacaaactaccagaagctattatcttgaaacatctaattttaaaaatgccatctgcacactcattatttttataaatggcatgtttttgaaggggtatttcatttacatgtttttgcttcactttcataagattatttaatagatcaacattttgattagcttgaaataactttattttactcttatataacagcaagaacagtaagtaacaaaatgaaaattgaaggaggaggccaggtgcagtggctcatgcctgtaatcccagcgctttgggaggccaaggcgggtggatcacgaggtcaggagatcaagacaatgctggctaacatgataaaaccccgtctctactaaaaatacaaagaaattagccgggcgtggtggtgggcgcctgtagtcccagctacttgggaggctgaggcaggagaatggtgtgaacctgggaagtggaacttgcagtgagccgagatcgtgccactgcactccagcctgggcgatagaaagagcgagactctgtctcaaaaaataaaagaaaattgagggaggaaaacaagtatacatctggtgctcttcttatctgctttcttttaaacaaaataccagagatttttttaaaaagtgccttcctgaaacataaatattttatctgagctttcagcaattggcattcagtttcagacgaatctaaaatttaggtactatatttttgcaccatcttttttttcctttttttgtaattctgagaaaactcactgaaggacattgagagaattataaacatcaattgtcagtgactgaagatgtaaaatgggccctgtagtatatcactatcacataatatccaactagagctttaaattataataatagtaatatctaacacttatagaacactcactgagaaacggggactttctaaggattacacattcatttacacatttaatcctcaaaaatatcctataaaatgaatactattatcatgtcaatattacagttgaagaaactgagtttacagtgaggtaaagtaattttcttaagatcccacagagactgaatgaaagaacccaagctggccgggtgcaatggctcatgcctgtaatcccggcactttgggaggccaaggcgggcagatcacctgaggttaggagttcgagaccaacatggagaaaccccgtctcaactaaaaatacaaaattagctgggcatgctggcacatgcctgtaatcccagctacttgggaggctaaggtaggagaatagcttgaaccaaggaggcggaggttgtggtgagccaagatcacgccattgcactccagcctgggcaacaagagcgaaactctgtcttaaaaaaagaaagaaagaaagaaagaacccacgctttctgacttcaaactttacatcccaggatatcaggcctgtcacatggtatatggaggtacaattcgcatcacggtctggaagtatgcagtacattacctgtgaataggaatgtggcggcccctagggtcagaggtaagatgaagaggagccagtggtggagatagagaaggagcagccagtgagatagtaaattaataaggctagtcatgaaaatcaagagcagaaagtgcttcaacttggtcaagtggtaaatgttgctgatgggttgagtaagcttagaatacaaatctcactattgtatcatgcctactggaaaaagttggcagtcatgtcaagggaagtcttactagagtgagaacagaagccttgatggagtgagttgattagagaaaacaaagtgagaaggagcagagcaaagggtcaaggatagcaggccaatgtggagtcacagaaagatcaatgacagtttccccagtaactatttgtggtgacagatcaaagccaacatgagagtttatatacaacatgcaaacaaaatacagcaagatgactggcctagggtgaaaccaaatcagtgtgacacataaatcagcaaatcaggcacaaaaaagacaacaggttaatcaaaaaacaatggcctctagctacaaagcacatgaaaaataaaagagaagagtaatgaatctgatgcgaccttaagcaataaactactcctatgaagaaaatctcatagagaaagtcactgaactaatttccagagaggcacaaggaatacctggaccaagagttgcttatgaagaagaaatgcaagtatagggaaaattctgactagagagaatgattcgtaatgttgtacaagcaacgagacaaaacggaatctcaatatacaaagaaaataatattttaatagggtgatattaacaggtttaaatagtacaaaggcatagataaaacatgttggagagatgtcctttgaacagcttgaacagagtctgtgttttgttaattccagcatctctgggactgagcataatatctggcagcaaaaatgtacactagattgttgttgaatgataaagatattaaagtgatccatccttgttacctcagtggtgtataagatgagtgagtgtgaagagagagcacaggagtcttgatatttttatttaataaggtttgatagttttttttggactgagggaaagaagataatggcaacaaatggaggctgatgggaagagaatggtggggattcttatctcctccttatcaggtttatgtagaggagtctgtttattcacaagaaggaaacggtatgaaaggaaaaaaaaaaatcccagtttcgatctgcctcctcactctcctcactcatgatttgccagaggaagaaaaccaacataactgatagtgaatttgggtgaagagctagaagaggagcagacgaacacactcttttctttctttctcaaagtcttgaatccaggattcacactttctcttcctcctgcatatgtaagttctctgtccctgcaggaaatttacaacttgccagcttgggtgaatgcattcaatatttgtgaaaaaattgcattcaataagctcattttgtccagaggtctaggccactgtccaattcatctttagaaataattaacatgacatttttatttccatctgccttatttctacgtctacttctcagttgattttaaattcagatgaggtatgattaattatcactccttaatccctatcacagtccaagccacagagtatagggcttcaatttccatcacaagggatttaggagacaaccggaagtacaaaatggcacgaacaacacaaatcatttgggcactctttaatgtgctgagtaactataattgaattacatacaaagggaaaacagctggttgcctttgcatatagtaaagaataaagttgtactcagggttgtgattagacttgtcccttcataaaaacataggtggaaggcagagagacttaacatagagtgcaggcaagtcagtcacacccttggagtaagggcaaggaaaggaaccaagttatcatcaaatgcctttaagaccagaaaagggagaggtcagctgaatcattcaaatattcaggtaccatacagacagaaaaatgctgaagtcaagagggagctgataaaatctacttctgtgtggcagcgaaaacttgaggagaacacaaaataacatttacaaattgaagtgtctttagtcaaaaaatagatgagcttgttgaatttggtagcactaagcagagaaaaaaagtgttttagtgggaatgatgggtgataagcccgcaaaccttccacttagttatttgcaacattagatgttgtttatgataaaagttaatgaaacagtaaaattaaagtcatattaagaagtatattttcaagaaatatttgagagattgtttttctaatatgcctttcaaatttctcaaaattatactggcagctttcatgtagatcttgctcatcgaggggaaagtgattttttttttcaggtagtaactttaatcaagtcctattataacatttctaatttctttagtttaaaacctgacaagagtgtcaagtagtaaagtagtgagaacatattaaaatatttcccatatacaacatttcattataccgtcctttgtacatagaatcatttttgttcatcaagatagatttcaaatagaaataaattttgaacacaatcttggttaagttcttacactgaaacttaaccattaaacttcgatgaagtgtagcaagattatacaaaacaatcttttcacatctgaatgagactggacatttccaatgtaccatcaatatcatttgttcgcttattaaaattttgtttcattatgaaatacttaacaaatttactttagtcctgcaatttggcagctaagtgttacacatttgaattctgaggttagtccactatattctctttgtcactgatttgcctattaccagtttttgctataaatggaagaatggcttactgggttaaatttaacaaacattttattttaaaagttttctctattagttttactaaagcaaattatgtacctaggttataataacatttccaagagaaatggaattagtttccatctgtccaattttaagttgaacaaataatttagtaatttaaacagtaattgagggagttggcaataaaatagtctactctttccatgtgaatatatttcaattttatttataaatttaagccttgtaattaattttaccttgtttgcaattaaaaattaaaatttactcagacaaaaggaaatagcaactattaaaaacagcataatcaaaaattaattgtatttcctagtaataataagataattcttatattgcaaaattattactaactagctgatgaataagaggaatgtgatttgtgtgagatctcaaacatttttgtgtaattcctaaaaacttatgggatgtagttgaatgcatatgaccaatacttatttcataattctccacatttaagaaaaaaataattacttttatctcatctactgaaggtgaaaggggaattattctggcaatatttttttattcatttacttaagaaatatttaatagttcctgaaactctaccacatgcactgttaagactcttatttgcaagcaacagtactccactttgaacaatattggaagatagtgtggattttatgaagtgaatgaaagggttgagtaatggtcactgcaccagatctataacttgatgagtagtcagataaagcagcctgtaaggggaaaaaaaaatgaagaaaacatgcagagaaaagagattaagagatcccctagctttacattttacagattcagtctctgtattctgactacaaaagctgtgagggaaaggactcatagcccaaccctgatcaggtacccacttggaaaaattagcagtgagcaaggggacacataattgaaggaatattataagaacgtgtggctgatggtagcagtgtctagaagaatagaatgggggtggggggtacaaagtagcctagacagcctatcccactgatatctaccatattggaaaagcaaatgataaatgtgtagaagtagccagttgtcccaattaattaaattataggctggagacctaggatataagttaaaccacatataatcaacagtagttgaccatgtttgcctttaaaactggctacttaatgtgttacaacctaatcattcagtaagtaatggaaaaaagtaaaagtgacagaatcaaactgagtagaatatccaaaaaggcaaaaatgaagtggaagcaacttgggctaactgattggccactctatgacagacactataccttaaacaggagtccttttacaactactttggttttaacattttgcattttgtttggatcttacaatatttaaaagacaaagcaactggacaggtgttaggtcgggttacaatatgaaaaactcagctgctacactctcacacctatgctgtttctatgtttatactacctgatagcccacccaaagtcatctgtatttgccatgatcacctgcatattcttggaaggatggattgaggagcttagcagttacaaagacattgcaatggcccgtgcaagagatgataggatagttaaaagttaaaaacatgatccttgctaaaagatgagcctggcccaataaccaatcttttccactttcaagctattttatctgagcaaggtcatcttgacaaataaccttccttatgtgcaaaatctaaatacactacttgtcacaaaggctttctgagatgattaaatgagataacggtctaattattacaaaacataaatctcttacaacaattcctggaacatagtacacattcagtaaattggcatagatatcaataggttctaatctgggggaaagggcatggtagagcttcagttgcagcagtgtgggccatgtgactgagttctgatcaataggatgtaagcagaaattatgtgtgcaacttcaggtcgtggctttaaaaggaactagcttgctctccactgcaggtgtgactatggaattgaacattcacaggaaggcaacttaggggatagtgggacaacaaaaagtaaagaacctgggtcctcggataatacaaagggacaaaggcactacacttcttgaactacctacaagtacaggttttcatgtgaaagaaaaatgagccagtcttgtttgtcattgttacgtggtcactgttaaaacagctcaagtgcattccttactaatatgtacaaggaatctagatggttttctctttaaaaactacttccaccactcaagtatgagtggaagcatggaagttcacatgcctaattgattatgatgtagcaccatctcagtggtaatggattgtgctgggagaggaagaactatccatattacttcaataatttcttgaattgttaaaaatgtgcatttttaatttaagcaatagaaatgtccactattacattaaaactattttactgtactctgttgtaactccctcagttatatctcatttatatccttttaccactgaaataattagatcagaaacaaagctaataaaattgggattaaagttaaatagaaacatagatatggatgaagcaaactggggaagatattttgttctgcaaaaaattgaatgcttaaatttgtcatcaacttgctatttaaataatatgtaaacataaattgtttaccccttaaattgaatgaaatactgccatagcaatttccccttcaacgtgtattagcttcattccatgttagttcatctggaagtcagttgagaagcaaagtctgcatgattgggatttcattttgccagaccatcatattaactttttgagaaattgtaaggctctaaatgtcagaggaattatgagggcccaagtgcaccatccgaaattcaaatcaagatggttttgtctttctgtgctcatgggatatttcggtccttagcaaattcatcttctgacaaatttggtccaaaaatttgaatcctaaagctgaagctgtttaaatcaaatctttttcattattattagcatctctctgtagctaaaaaacaaatattgcttgctgagaactatacagatctcagaaaaatcatttcacataaaagagggagagaaattgccttgccattatgttagcattttaacttttattaacattgtaattggtagtgtacaaaacacaggaattgtgatattaaacctgactttctagtaggcatcaaatacatctaaaaataatgactgacacaaacatgaataattcttttactaccagggtcaaaacatttcattaccaaaatgcttgcctaaaaagataaaatgcctcaaatcaatattttgatatatattcaaaagcacaaaacatatgtgagcaatccatggattgttcaaaatgtgcttcctttttgctggtgacatttatttctagtaaaacactgatgtggtgttatgataaacacacacacacacacacacacacacacactaagccatgcacacagggttaagaagaattctggacagaaatatagttataattaaacattaatcagactgcacttatacccgtttgtcatcgcgagccacatagcactttcgcatgcctattgttcctacaaacaggatatctgacattagaatcataaggctttcatttaagaattgcttaagatgtttttcagatttcaaattccagcaaaacagctgatgccaaccggtttgaagacccccacagagaaacaaaatcagcatgagaatacagtttcttcatctccctgtcccaagactttgccctgcatgcttcaaccaatcaatgatctgcacactttagcccactccaaaatccttacaaactctagccccagatgcactgaggagacagttttgaagtttcctcctgtctcctcaatcagtgaccctatttttaaacatctttctttgctgtcacccagtgtctcagtgtattgacttgccctatgcatcaggcaatggacttattacagatagatagatagatagatagatagatagatagatagatagatagacagatagatattttgtctgtggttcttggcggatacattccatagtcctggttacagtcttttgctataatgttgggtttgttaggcctgaaggggaaggcctcgggaaacaattgttctgaccttctcctgccctcctctcacctgacccaaggcaggactctcattttcccttgcctttctgattgtgggtcctaagaccctcattccatagaacattccaccccatttccttcccaggggaaggaaagctgctgttacaaaacttccaaaaaaatgggttcagaaagcttctggatagctgaacgtgtgaaggttcctcggggggtggcacgcctggggaggacatggaagctctgcacacccttcccacataccttaccccacacatctcttcttctctatcctttgtaatattcttcatgataaactggtaagtgtgtttccctaagttgtgtgagcccctgtagcaaattaattgaacccacagaggaggctgtgggaaccccaacttgaagctaatgggttagaagttccagaggcctgaacttgctactggtgtctgaagtaaggagagcagttttggggactgagcccccaacctgtggaatctgacactgtcttcaggtagatggtgtcagtattgaattggaggatgcccagttgatgtccattgcgattatttcttgcttgctggtggggaaaaaaatctccacatatttgggggttatagaagtcttctgtgttgatgattattgccattttgatgtgagaggagagaaaaaaaatatgatttaagtattttttcaaacaactggatatttgaaaaataaaataaaatattttaaattatgttggattcaaaattagctgccaaatttacaagtaaaaccctgtaatttatatacaatgtattctttatgcttgattacaaaaaatatttcgacattttatctaattcatttcaaattttctatttatttaaataaaaagcattttatctaagattctgtttctaaaattaaggctgcaacacatggtctcaatcattgctaaaaaaaatcacaaaaagacagtaaggaagaaattaaagtcagctggtagtggaaattgttgttataataggtttttctcttttcactgttgacagaatcacaatctatgtctcataaatccataaataactttaattactgtcatttgggagtgtgacaacaattaaagacaacaaatgtaagagctgagcacttgctgagaactactcaaataatacattgaataaaaaaaaggtcaatcagcactttgcaattcaagaaaactaagtttttaatatttttaaaaagtattcatgactgtggttctcttaccccttagcatcttcattacaattctctgaacccctttttagacatagtgcacaacctgtcagtcgtgagacaggactccaaaaaaatttactagttgatgtgacatctactttatttctacctaattactggagagaaatacttccggttactttgactgttagtgtatatgatcttaattgatatatccgaaaataaactgtcataaaatatgaaacttccttggtatacaatatcctgtcattccctctggtgtttataaataaataaatgatcaaacaaatattttaaaataaatgtatgagtatatacaaatatataaacacacacacattctgccaaaagagtgattgctaacctgttaaacagtatgtaaagatgagagaaatgactagcaaataatatgcaaaaagacactactacagagaatacaatggaaagatatggactacatttaaaaagactaaatcgatacataggaaatctgctccatgaatataattgtatggcattcaactggtgactgtggacatgtgaatttgctcattgtggccataaaaaactctataagaattctgcaaaaatcaatgtgacattgtaacaaatattttctatgtttttgtgttttacatcatttttctattgaaataattcttaaactacttactcaaatgcaccttaacaatgtgtatataaacatatttactaaaatattttaaattgtagtttttgaattgtttttccaattacaaaatagactgcttttttatttgaaaaataactataattaaaattaattatctcaaagtatgtttaaatatgagattggatacttatgtagcatatgcatagttttctatataggataaatgagaaattcctagtgatcttatgggaaaaaatataatttatctgtacagagagtaattatacaaagacatgatatcaatatctttcctgagcctagctttagggtattctggagccatgttaactaagagtcaaatacataggaatattatatctctcaaatatgttaaatgttacacttttttttgttttttttttgtttttgttttttgagatggagtcttgctgtgtctcccaggctggagtgcagtggtgcaatctcagctcactgcaagctccacctcctgggttcatgccattctcctgcctcagcctcccaagtagctgggactacaggcgcccgccaccacacctggcttactttttgtatttttagtagagacggggtttcaccgtgttagccaggatggtctcaatctcctgacctcgtgatccgcccgcctcagcctcccaaagtgctgggattacaggcgtgagccactgcgcccggcccttttttttgttttttaagacaaggtctcactttgttgcccaggctggagtgcaatggctccatcatagctcactgcagtcttgaccttccaggctcaagtgatcctcccgcctcagcctccctagtagttgggaccacagatgtgcaccaccatgcttatctaattttttatttttcatttttgtagaaacagggtctccctatatagcctaggctggtccctaaccactggcctcaaggtctctacctcagcctcccaaagttctgggattacaggcataagtcatggtgcctggccatgttatacttttattaagtcagatgcacagaaaatataaattgaatttaaggaaaaagagaaataatatagatagcagcttttggaattttgtatgttgtttttgtgaaatgaatattaatgtattcacttaaactgaaaaaatggttgtcatcctcagatttatgtatatttgcaatatgtagtgcatttgtagtataataaaatattaaaaataaatttatttatttgttcatttttttttgagatggagtcttgctctgtcgccaggctggagttcagtggcttgatctcagctcactgcaacctctgcctcccaggttcaagtgattctcctgcctcagcctcccgagtagctgggactacaggcacgcaccaccatgcccagctaatttttgtatttttagtaaagacagggtttcaccatgttggccaggctggtctcgatctcttgaccttgtgatccgcctgcctcggcctctcagagtgctgagattacaagcgtgagcctccgcgcccagtcaataaatttattttttaattctaaaatttacagattgatatcaaacactctaggcttagaataaatatgtgaaatatacaatacagatagaaagtgagatgtaaattaagatatttacgatgactgggaaagcatacaagctattctgattataactaccttcattgtcttaaagcattacattggaaattagtgtgataaaagttacaattggcatcatgtcactcgtcttgttctataagcccttaagaaatttgtgtcctggcaatgcaaggatcattccatcacaatggattcacatttgattgtattttcactgtcacagtgaagtccttttccaattatctgactcagtgggtaagagcacataagaatgcacaaaaggaaaagatggttcacagaataacaacaacaaaaagtattttgggtttgactatagcctgtgtgacagatacagaaaatgaaaatatataaagtaaaatattgatagatgatctaattagaaaaggcaaagcatataatctcctgtgagctactaagcaaataatagagatcgacccaacagaaatttatatatatcagagtatataataaatatacagcatatatagaatatgtacactatatatatagagagaacttatataatacatatcaatacaattacataaattcggttcttaacggcatttgtatataaaaattagtaatatatacttgtgctctttgataaaatgataacaatacctagaacatgatctatttcacaatattaacattactatttgtttttgttagtgtaatccaacatacactagatagaaaactcatgtttaatttaatgatccagcaatatccaagccaagaagataaaaagaacatgtctatatcacttatatctttctggatcttatgcagaaatctggtaaaacagatatgcaagaaatttatatttttatcttttcatgtactttgttttagactgaaaatttctgcttttttattttcaatttgagaaaaggaacactgtagaaaattcaggcaacattactgttagaattacaacagggcaatatctaggctttattacataactttgatcagattattgtgtattataaattttaaactcttcatctctattgaaaatacacaataaattagctttaaacacacacacacacacacacacacacacacacacacactctgacattgttactggcagtgaatccatatgggtctgcagcaacctcagttcttgcctctccagaagaagaattagactgaggggcataaggcagaaggagagactgaggcaagttttagagcaaaagtgaaagtttattaaaaagctttaaagcaggaatgataggaagtaaagtacacttggaaaagggccagcaggcaacttgtgagatcaagtgcatggttttacctttgacttaggggttttctatattggcatgcttcctgggtctgcatcttctcccctgattcttcccttggggtgggctgtctgctgctcagtggcctgtcagtgcttgggaggggccacatgtgcactgtgtttactggaattgtatgcatgctcacttgaggtgttcttcctttaccaaccaaatgtccctagaaggtcatacaccagttaaattccatcattttgcctcttaatgtgcatgcttgagcccacttgcccaactcctgagattgtatcagaaagctcctggtcaccagcttcagtttttttccacctactggtagactgcctttctctggcactggctatgaccaattactatttaagagtggcagtttaacaacctcctaaccatcacttgatggtcgcctgacattcctagtgggtataggtgccaggggatggacccgttgtgccctgttcatgtttgactagctacctactgtaacaacatatagtagctatcaaatatttacacgttatatatttgtaactgaacagtaagaattctgctcagttaaatttttaacagtaagtttaagaagtgacagcaaatgtaccactggagttttgaatttttactccaattgttaaaattaatactatataaataatggttttggcttccaacctgggatttaggagttgaaaggagtattgcttccactcttacaacagcaaaagaaaggtaggttaaacaagattgataagcactagatatctgctatacaacattgtacctatagcccatactaatttgttaagagggtaggtcttgtgttaagtatccttactaaaataaaacaaaataaaattctagaccaatttcaaaattagcctttttcttaaaccaccagagagctgaggttgctggtttcaaatccaagggcagctcatgacttcagggagagatgagcgataaacaggcattcacctagagtggacacaatcagatagtgataatatcagtctagctaaaatggatgacaaattaatgaaggccaagtatgacctagtgagacaatgtgaaatctctgagggcatcagacattgtaggagtccatgcactcctgcatgttctttttctgcaaacctcaccaaaggctcacagaaaaaattaggaaaaaaaaaaaccctaagaaatattcattgttgcacaggcctgtaggaagaaagcaacagctatatgagatgggcaagaaacttgttaaaattcttctcctctagcgccaatacaggacaaaagcctatatgtttgtggggagaagggcaatgaatactgttggttttagggaactgatgaacaataatcccatttaagatagtggaatgaagaatgggtgtgattattcattgagcctgtgtaaaacctggaaagaagcaagataactaagaaggcatctacctgatgctcttcattacaacactaccatatctactgccagggtaagaagctttgaataacaagtaacaggaaaatatagctgagatatgacaggagagaaataaaaatgtagaaagaaattttccatgtcacattataaagcaaaaacttaaaactcagattttaagagacattgctttggtaaactactccgcaccctagacatgaggtgtctgtacaagaatttgaagcctgtagcatactgggggtaattgtagaagcaataaatctcaaactcagtcaaacatctagctagattagccaaacatcccccaaggcccaagcagaataaaaaaaatgttcatctacaagcacaaaaaaatatttaactcaatatctactgtcttaagaaacatgtccgaaatccaatgaaaaatgtaaatacgaaatggcaaggaaaaacacactgctgagaaaaaaatcataatcagagccagattcaaatatgacacaaatgttgggaatatctgacagggaatttaaaataatcatgattgatatgttaaaggttctaacagaaaaggtgaataacaggtaattttagcaaagatacaaaaagtatcacaaaaaatcaaatagaaatgctacatttaaaaagcttggtaacaataatgaagaatgactttaacaagcttatcaggataaattggctaaccaagaaaagaagcaataaatgtgaagatatgtgactagaaattatccaaactgaggcccgaaaaaaaaaaatttacaaatttaaaacagaacattcaagatcttttggacaatatcaaatgttctaatttaaacataatttgaaatactaaaagacaggataaagaggatggagcagaagaaatatttaaggaaacgatggctggaaatttttaccaaaattaatgaaagacacatatctgaaaagaaaaaaaatataaaaaccaagcaaacaaaaattatcaatatcatattcacactgcttataggaaaagtcaaagaaaaaaatctttaagttagctaaagaaaaaagaaacattacacacacagaagaagataaaatcattgcacacttttgtcagtaaccatgcaaacaaaaagacaatggaatactatgtgctgatgaaaacacacacacacacacacacacacacacacacacacactgactcagaattctatatccatcaaatttatctcttcagaatggaaaagagataaagcctttctcagcaaacaagcatggaaagaattcattgccagcagacctataaaagtgtagcttaggaggacttttagggtcacggaactgttgtctatggaaatgtagtgatggacataaagctatataaatttgccaaaatgcaaaggaatgtagatcagaaaatgtaaattttactaaaagtacattttttaaaaatcaactagcatgtgcagtgaaacatggaatgcagactggacaaattaaaagcattacaaattcatcacataattaaattgaagggcataggaagaaaaatacttctgaaaaactgttttgtctgggtactgcaagaataaagacaaataactgtatacagacaatgtcttctagttgttacatttattttctgccagtgtatggtttagcacttactaaactatttgtatactaaggttgatcattgtagataatgagatataggtttttctctgtcagagaaagaagttaaaagttaggctgggtaaatctgtaattaagcttgtgttgctggattggaactggatataacaatataagcttactttaaaattttatgtggagaaaaaaatggatgcagaaataaattcagatctgtgtgcacacgcatttcttagatttatttcttagatcctggacttatttcttagatacatatcttagatctattcgttcagaagagtgagacgcagtgataccccagtagcaatgagctactcctagcactcagatctgaatttcaaattctctaaacatgctctaataagaagaaccagtgcaccttgaagagctgactgattccagagttggggcaaaaaaaaaaaaaaaaaagaaagatgagtctggagtatctggtgatgtatgaagttaagaaagtgcataaaaagagagttggaaattgaggcacattaaatactgaaagagcacacagaagccagcttgaaagttcccaatagccatagactgaagcaacaaaataaataactattgtatcggattataactcaaaggtcaaagtagttatgcatgagatcgataagcagatggatagatagtttaggcagatagatatagatagatagatagatagatagatagatagatagatagatagatataattagggaaaaagcaacagctctttctcttagaagaatttcaattttaaaatgagagaaacagaaaattactgttggggccgggcgcagtggctcacgcctgtaatcccagcactttgggaggccgaggtgggtggatcacctgagatcaggagttcgagaccagcctggtcaacatggataaaccccgtctctactaaaaatacaaaattagccaggcgtggtggcgcatgcctgtaatcccagctactcgggaggctgagacaggagaatcgcttgaacacaggagacggaggttgctgtgagccgagatcgctccattgcactccagcctgggcaacagagcgagactccgtctcaaaaaaaaaaaaaaaaaaaagaaaagaaaattactgttggaacaacatagtaataattgttgcaggtattatccagtgacagactctaaagtaggtgagtcagagtttagcacaaataggatgtttgcatagtctcaaatttcagtcaattctcattattcacagtaataatatcatagtcctgtaatatcaccagtgacactgaattagcaaatactaaaccattgttcccaaagaacaaaacagggtcaaattcctgtaagatcctggtcacattttgtcaatgaatcaatacagaaccctgtttgatgtatttctgtttaaagatgttttacctaatatatattgttgatttgttaacattgagctcaaaaacaacagcactataactcatagccaaatgaagtttatctaacatatgattttctccataaagcacatcacaaccttcttgaacttagggacactagacagcacatcaccaacttgtgggccattttaaacagtgaaatcaccaatgaaaacacaatatttaaaacatagcattagacagactgaaaataatgacacgtttatagtatgagacctaaaacaagaaggcagatcatcagcttgtttgatctcagttgggaatgtgaatgataggttacaaatattttgctgttctgtgtatgtccataagtgactgtaaaattgacataattattaatattaggtttacaaataaattttagtgagtaggcaaattctcaaatatgaactctgtaaatgatgaggatcaattaccttttttccacaaaactgtttagaaaatacaaaggaaaactagtaagcttatactggagtgtcctggcagacaccgtgttaggcaagtgatcaaggttaaacatcaccagttatgaatatggacattgtgtgcctctgatattgaagcatttagaagggcccatcatctctgtagtatcctacctattctaataattgcataaccccaatatgattattagaatacatcagacaaaccaaaattgaagaacattctagaaaatgactgactagtattctccaaaagtatcatgatcatgaaaaacaaggaaaaaaatggagaactgtcacatattggagtagactacagaaccataacaaataagtgcattatgagatcctgcattggatcatggatcagaatttttaaaaaatttaatgtaaaactggtgaaatctaagtaagttctgtaaattagttgataatattataccaagataaatttattggttttgaacattataccatcgttacataagacgttaacagagaaagctgggtgaactccattattttcaaaactcttctattattataaaattattgaaaaaatctgtttttaaaaaggctcataaataacactttatgggacaaactttgctctagatcagccatgttcctctcatctcctagaaattactgatctttttactgtttccatggttttctctttatcagaatgtcatatagctggaattacacagtatggaactttttcacattgactcttctcacttattaatattcatttaagcttcctctacatcttttctttatgtcttttcatgacttaatagctcatttctttttagcaaggaataatgtttcattgtctagatataagatactttatccattcacctactgaaggccatcttgattgcccccaagttctgaccattatgaataaagctgctataaacatttgtgtccaagtttttctgtggatataagttgtaaactttcttgcataactaccaagaaatttaactgatggatagtatggtaagaaagtatggtaagaatatatttagttttgtaaggaacacccaaactgtctttcgaagtagctgtacaattgtgcattctcactagcagtgactgggggctcctcttgctccacattatcaccagcatttggtgttgtcagtgtttcagattttgcccattccaatatgtgtgtagttgtatcccactgttgtttaaacatttaactgataacatataatgtacagcatcttttcttgtgcttatttgtcacctatttttttggagacagagtctcgctctgtcacccaggctggagtgcagtagtacaatctcggctcactgcagcctctgcctcctaggttcaagccattctcctgcctcagcctctcgagtagctgggattacaggtgcccaccactgcactgggctaatttttgtatatttagtagagacagggtttcaccatattggccaggctggtctcgaactcctgacctcaggtgatccgcccacctcagcctcccaaagtgctgggattacaggcgtgagctaccacacccgacctatttgtcatctctatatcttcttttgtgaggtgtctgttaagatctttggcccgtttcttaatctggttgtgtgttttcttattgttcagttagtttcaaaatgtatttgtatattttgaatcacagttctttattacatgcattttttgcaaatatttttgcaaaaataaatggcttgtcttctcattctcatgacattttatttttcatatcagaaggttttaattttaatgaagtgcagcttatcaattattttcttaatggattgtgcctttggtgttgtgtctaaaaactcatctccatacccaagttgtggtcatctaggttttctcctgtctattatttagtaattttatatctttgtattttacatttagatttatgatccatttgggttaattttttaaaggataaggtctgtatctggattcatatatattttctttttgcatgtggatgtccctgtgttccaataccattcactaaaaagactattttcgttccattgcattttctttgctcctttgtctaagagcaattgactatatttatgagggtctacttctgggatctctaccatgttctatttaatctatttgtctattctctcatgattataactctttattacagtggctttatagtaagtcttgaagtcagacagtgttgatggatagcaaagtaggggcactaatactaatatggctctgggtacttgacagaatgtgggatagaagcagcctatagttaattttatttcaatgttgctgatttctagctttcaccaacaagaaggcgacaggaaatggagcggctttgtgcaaaaatcattggactggttgagagaccaggtttcagtcctagcactcccaccaacagggctgctcacttcactacttaagttctttcgacctcgattttattatttgtgcaaagaagatatgtaactagagggcctctaagatcctttaaaattctgatgttctctgactctaaaataaacctaccttgacggcttttaggaggtggcacttctgggaattcaagaataggatatatctagtatattgttgattttttccactgtgtattctcatagttttaattagaaattgaacattttgaagttcacaaaaactagaaacagttttaatgttagtataaaagagtttagtctttattcacctaatggtattttgataattcgtgtagtttaactatgtcacagagaaactgagtatgcaatagtaatcacttcctgcaaatagtgattttataaatattttaaagcaaatcctgggaatttatcaaaatgaaaaagtgtaatacaactataatgggattaaattaagattaaagcaccttattcatacatttaaaggtttatattattatttgtacacataacaaaactgtcattaattagagatattacagaacccatgggttatattctaaattggattggtgaaggatgaaacacaaaaaggaccattcagtacaggacttcagaaactgatgaggaatttacttctgagagataccagttagaagaaagtatttgtccaaatgttctgaattcaccatataccatcaagagaacatcactcatataaaatgctttttgtcactgctgaagatagaattttttttcagtgaaatatgatactgcaggaatggtagaaagcattaaagaatagttaccaaaggatcaaaaaatgtgtggaagaaatacatacacgtaatacaaattcataatttacatttaattaaacataagagcaaatatttatttttgtaccatcattggagtttgattaaatttcagtaagcaaagagggtaacagtaatctacattctggcaataagatagtatctcctaatcatggcagtgtatcagagtgtccatcacttcatgaattctagccactatcatcacttggttaatagtagcttaaaaaaatcctacactttgcccagacatgcatgtttaaggttgtactctgatgttcattttatgttatcctagtagtcaccaattttccagtcaaaaaataaatctctttgcatgtctccaactatgatttattgttaatgatacttataattgaatgtgttaatcactttaaggttcaaatcaacagtggtacatactgtacccatataacatatattttcctcctgagtatataaattggttttagtcaaaataaaataatttcctttcaatattcttatttagagtttgccttttcatctctgtatttaattcatcaatattgtcaattcatcatttgttctcatcatctgaataataattttagcttcctcctggaaggaatacaatatatgtgaaacataaaaattaatttaatgttgcaaatatttgtgaaatacaaatttagcagcattactaaaaatcagaatcctttagtaattatcaatttatcaaaatcactttaaaaaaattacaacatgataaattgcaattgtactgtcaccattttacctcaagaaatatcaatcaactctatttaaaaaattgtctacccttatttctctgtgaaatgtcaaaacggacagccgaggttttggatacagatgagaaaccacaaatttcataggtctatcaaattttacagaaaggtaaattacataaaatcccattagtttagtttttttaaaaaaacctttgatgtctggtgtattatttccaccctgtaacaggttcgagtctccatttgaagcctcaaaattgctatcggtgatcacttttcatttccttgactgattcaagatgggtatcaaagattacttgtaaaagaaaggggaaatgtttcactcttgtgaaagccagaattcatagttattgattgcattttcttatgtaacaatgtattagaatttctcaaactttactgggtataaaaatcacctaccgagcttcttagaaagagagataattaagcctgcctcctgaaattctgattcattcactctggctggggcccagaaaacttcctttttaaatcaagagctttaattaaaagctaaaggattcatggctgggcgtggtggctcacgcctgtaatctcagcactttgggaggccgaggcgggcggatcacgaggtcaggagatcaagaccacggtgaaaccccgtctctactaaaaatacaaaaaaaattagccaggcgcggtggcaggcacctgtagtcccagctactcgggaggctgaggcaggagaatggtgtgatcctgagaggcggagcttgcagtgagccaagatggtgccactgcactccagcctgggcaacagagcgagactccgcctcaaaagaaaaaaaaaaaaaagctaagagattcagaatcagatgattatggggccatactttgaaaaacaacatatttgtggcaggtatttaaaagttgcagaatatatgagttttgactttctgttatgactggaatttcaaacaacaatgacacttttctatatactatatagtactcaaagacattttgccaaaaatgagacgtgttcctaaaccatcaatgagttcaaagaggagagataaattttcaccatctgcagtacgtcttacttaagattgttattattttccaaaatattcactataaaaagggcttataggagtaggtttgcttccttttgttcttctgccttctgccatgtgaggacgcagcaagaatgcccttaccagtattgatagcttgatcttggacttccaagcctccagaaatgtgagaaataaatgtctgtttttaataaatcagccagtctatgatattctgttatagcagcacaaaagagactaagacagaatccttagcaacagaaattaagctagcaacaaaattacattttgaatgttaaacacgtaatctatctacagtaatattgtatgcaaggctttctaattccaagtatggaaatcagatttcagggaattgaagaaatactatttggtaggaaagttgtctgtatgcctcattcaaactgtggaaatggaaatgaagaaattaaaagaaagagatgaaatgaaccgattaaagtgaaaatcatcagatggggtttaaaatgttatatactgtttacaagagacacatctaaagcatatggatacagaagagttcaaagtaaataaatgtataggtaaaaaaaagcattatttgcaaatataaagcaaaagagagtttgtatagttaaattcatacagaacaaattagactttaaaaaaatgattactgaaaataaaagaaaacattctgtaattatgaaagtttgaattcactagaagaattggtgtgtgggttttttgttaaaaaaagctattaaaaatttgatagaaattgtattgaatctacatattgcactgggtagcctgggcattttaacaatattaatttttacagtccatgagcatggaatatattttcacttatttatattttcttcaatttctttcatcaatgtctttatagttttcagtgtacagatatttcactactttgattaaatgtattcctaaatattgcattatttttggtgctattctaaatgaaactgttttcttcagtccattttttgaatagctcactgttagtacagaaacacaactgatttttatatactgatgctgtatcctgcaaccttactcaaatcatttactagttgtaacagctttatggtgaactctttagggttttcttttttttttgatacggagttttgctcttattgcccaggctggagtgcaatggtgtgatctcagctcactgcaacctctgcctcccggattcaagcgattttcctgcctcagcctcccaagtagctgggattacaggcacgcgccagcacacctggctaatttttgtatttttagtagagacggggtttctccgtgttggtcaggctggtctggaactcccaacctcaggtgatccaccacctcggcctcccaaagtaccaggattacaggtgtgagccaccgtgcccagccagggttttctttctatgagaacatgtcacctgtgactagaaagaggttttattctttgtttccaatgcgtatgccctttatttctttttcttacctaatcgctctggctagaacttcaagtataatgtttaataaatgtgtcaaagtaggcatcctctttttcttaatcttagaaaaaaagtattctgactttcaccattaaatattatgttagctgtagatgtattgtctatcatgttcagaaagtttctttctattccaagatcgtggattgtgtgatgatgagtattattgttgttgggtttttggttatttgcttgtttaccttcattccactaatgtggcatattacattgattaatttttaatagttaaaccaatttacattattgagataaatttctgtttgtcatggtgtttaatctgtttaataggttggtgaactcagttggctagtatttttcccagaacttttgcatctatattcttcggaagtattggtctgtggttttatttctttggtctttaaatgttagggaaaattctccgtgaacatatctgagcctgggcttttattagttggaagatttttatttactgatttcatctctatgcttgttataggattaagattttacttttcttcttgagtcagttttggtggtttgtgtatttctagaagtgtgcctatctcttctagattatctaatttgttgacatacaagtattcatagtgttctcatagatttttttatctgtaaggtcagtagtaatatcgccactttcatttctgattttagtaaatcgaatcttaccctttttgttctcaatttaacttatagtttgttgattttatcttcaaagaatcaacatctacttttgtttattctactgattactcattctatatttgtttatccctattctaaccattattatttctttctttctgtgagatttctatttagcttattcgtctttttctactataggactttatagccataattttttctctgagcactacctcgctaaattccataaattttggtgtgttatgtttctattttcattcattaaaagtattttctattttcttttgtgatttctttgccaacccatatgttagttaagaatgcactgtttggtggtgcagcagcccacctgaaagccacatggggcaggggagcccccaccccccagccaagggaaggagtgagtgagcctgctactcagccagggaaaccatgctttttccacggaattgtgcaacccacggatcagaagatcccactcctgaacccatgccaccagggcctagggtcccgacccaggagccatgcagattctcaacagcctctcagctagaatctgcttaagcctgccaagtgcccagagggaggggcaaccagcatcacagctgcagctgcctgctgtctaagccacttgagctccttcagggaggggcagcagccagcactgggactcataactgcctaacacgctaagttccctgggctagggaagggcagcatccatctctatacctccaggtcatgcttttcccctgctagagccagggaggctggacggccttgttccaagaggtgtcccccacatcccaacacaccggctatggcagactgcagcccgagcacctcttcagacctgaccctgactcatccttccttactgggtggggcctccctgcaggaactccagcaactccagtcagaggctcagggacagaaccctgatctccctgggccagagcccctagggggtggaggggtggccatagtctctgtggaccagcacacttagcctttcctcctggtagttctgaggaatccaggcagcccaaacgagtgggtttccccctagcaaagcacacctcctccaccaagagacagtcaaagttcttcactaaatgggtcctgttccctgtgccacccaactggatgagaccttccaacaggggttgtcagacactctatacaggagtgatctattgtcatcaggttggtgcccctcgaggtcagagatcccagaaaaaggaacaggtacccaactttgctgttctccagcctccttgagtaacatctccaggtgcaggagcaaaacagatgattacagcctgaagtgaacccccagcaaacctcagcagccctacagaagagggacctgaccactgaaagaaaaacaaacaaacagaaagcaatgacaacagcatcaacaacaacaaaaagtccctgcaaaaaccccatccaagggtcaacagccttaaagatcaaaactagacaaactcatgaaggtgagaaagaatcaatgaaaaaacactgaaaacacaaaaggccagagtgcctcttctccacatgattgcaatgcctctccagcaagggtgcagaactggacacaggatgagatggatgaattgacagaagtaggcttcagaaaatgggtaataaaaaactccactgagctaaaggagcatgttctaacccaatgcaaagaagctaagaaccttgataaaagggtagaggagctgctaactagaacacccagtttagagaggaacataaattacctgatggagctgaaaaacacatcatgagaagttcatgaagcatacacaagtatcaatagctgaattgaccaagtggaagaaaggatatcagagtttgaagaccaccttgctgaaataagcatgcagacaagattagagaaaaaataatgaaaaggaactaacaaagcctccaaaaaatacaggactatgtaaaaagattgaacctccaatttattggagtacccaaaggagacgaggagaatagaaacaagctggaaaacacacctcaggatattacccaggataacttagccaacctagcaaggcaggccaacattcaaattcaggaaattccagagaacaccactaagatactccatgagaagatcaaccccaaaacacataatcatcagattctccaaggtcaaaatggaggaaaaaatgttaagggcagccagagagaaagcccaggtcacctacaaagagaagcccatcagattaacagtggccctttcagcagaaaccccataagccagaagagattgggggccaatattgaacattcttaaagaaaagaattttcaatccagaattcatatccagccaaactaagcttcataagcgaagaaaaaataaaatcctttccagacaagcaaatgctgaggcattttgtcaccaccagtcctgccttggcaaaagctcctgaaagaagtgctacatgtggaaaggaaaaaccagtaccaaccactgcaaaaaacacaccaaaatataaagaccaatgacactatgaagaaactgcatcaactagtgtgcaaaataaccaactagcatcatgatgacaggatcaaattcacaataacataacaatactaaccttaaatgtaaatgggctaaatgccccaattaaaagacacagactggcaaatcagagaaagagtcaagacccattggtgtgctgtattcaggagacccatctcacgtgcaaagatgcagatgggctcaaaataaagggatggaggaaaatttaccaagcaaatggaaagcaaagaaaaaacaatcctagtctctgacaaaacagactttaaaccaacaaataccaaaaaagacaaagaagggcattatgtaatggtgaagggatcaattcaacaagaagagctaactatccttaatatatatgtacccaatacaggagtacccagattcataaaacaagttcttagacacctgcaaagagacttagactcccacacaataatagttctggcaaagtcaatgttgaatgtgtatgttgatagaaataatccagtaaaaattttaaattagtatagagaagatccgaaccaaatcaggctgatcaatgtaagggaataaacagacaatttgactctgatttttctctatattcttagttaagcacaaaagaagaatatcagctaagagtaagaaaggaagggagtgctggatgtcactagtagtgatcaggtttcaaattactgtaggaaactttactatagcaaatattactaaaggaaaaccatctctcatcaaaaggtcatcactctctcagaatttacctatgcaaaaacacaccaaaatataaagaccaatgacactatgaagaaattgtatcaactagtgtgcaaaataaccaataataaataaaatctatttgcttttctctcaatctactcatctacatatacatctaccaatctacctcttgtaatgtcgtcatatcctataatttcctaggtagatattagtcctctctgttacaataagcacctatattactgaagataagcaaattgcattaaataacaagaaagagaaactatattactccttaagctttgtttcacaaaccagacctttataagctatttcagtaggttctattttttgttgttgtttccttcacacagaaaaaaaatactttactggtataacaaggtctaaattacagactgtagagatttttccaaagggcaggcatccaggcatcattgaataacaagaactatagctttatgttttaaaataaaatcagctgtttcgctgattaggtagaaaatccaactgcttcatgctgtaaataataattacaaatctatattactggaatctgagctcagttggggagaaaattggccattacatgtaataagaagtaaaattttataaaatatgtaaaacccaactgggcactgtggctcatgcctgcaatcccagcactttgggaggccgaggtgggtggattacctgaggtcaggagtttgagacaaacctggccaacatggcaaaaccccatttctactaaaagtacaaaaattaggtgggtgtggtggcaggcacctgtaatcccagctactcaggaggctgatgcaggagaattgcttgaacctgaaaggcagaggttgcagtgagctgagatcatgccattgcactccagcctgggcgacaagagtaaaactccgtctcaaaaaaaaaaaaaaaagtgtaaaacacatgcttagatgttatcagtatttaataaacattcatggcaatggcaattatccgtggaccttgatgtgctttatgtcaggccacagcacacatcattaaatgtcactaaacactgtgctcttaaagataatttccaattcaaaaaatagcaatattttatttcaaaaaagttcttatttttccagaaaacatttttcttatcgattgtcaaactacataatatatgttaacaaaaatcaacattatgagacatgatgacaattatcccccataggaaaataaattaaatttcctctttgctaaatactcactaaagccctacaattcaatctctgattatcagtaattaaataagcacagatgatgcatattttatcttttagaaatagtgtagagtttccaaaaacactgcaaatttttatccatttgattacttgctcagcttattacatcccttcccagagccaatatatttgagatagttctaatttttttagaatgtgtttttcttgtataacatttgatttatgaaaaagttttttcctaacagaaattagttcattgcaataataaaatgcatataaaatttacacatatatttaaattaaaggaaatgtattataattaagttaattatatttagggaaattattaagtattatatgatatatgtcaagatccaatatattaataagtgaaattaatgaaataaattccaactaattaactagttagaatcactgctttgtgctttgaatatattatctactacttgtagtaaagttgcaaaacaaacaaaaaaacccaaatgtatttaaaaatgtaaaacttccagttagacatttatagtcacaaaatggaattaattttaaaatatttttaatataaatttcatttttacatttttttacagttgcaaaaattgtgcatttatttgtgtgtgttggaataattatggtctcactctatgccccaatgtcatgaagtgtgttgttttcctctctattgtcttccaaacttggaataatgcctaaaagaaatgttggttaaatgaatgaagatgaatgaacatgcatcttggaataatcttttactttatagatataaatatttgtgtaggcaaaaaatttacaaaataagtaatactttatggtgaaaaataatattaatctctagtttctaatgactaaataggtaaatgagtcagtgttcattcattcaacaaatattttttattcaatgtttactatatgcattccagtgttagcatcaaagatacagcattagcagatatttatccaaaccccaacctctttgaatataaatttttgtagtggaaaaaagataacgagcaaataattaaaatacattttatgtcagattgtgatcattgatatggacaaaaataaattaatggataaaaattatatgaactttgagattgagattttttttttttttttttttttttgagacagagtttcactcttgttgcccaggctggagtgcaatggcgcgatctcggctcaccgcaacctccacctcccgggttcaagtgattctactgcctcagcctcctaagcagctgggattacaggcatgcgtcaccacacccagctaattttgtattttttagtagagatggggtttctccatgttggtcaggctggtcttgaactcccgacctcaggtgatccacccgcttcggcctcctaacgttaacgtgctgggattataggcgtaagcccccatgcccggccagggattgagatttttaaggtgaaggaataatttactaagaacataacgtttgagcaaatacctaaataaagtaagagaatgagccctatgtttatctaggtgaagagaactcctggaatatgaaacaaaaataaaaaactacagcaaccctgaggttgattattcaaggtaaattatggcagctcgacaggggagagatcatggaataagaggaacaagagtagtaagagataaaattgtcaaagaaaagagtcaaactctgtaaaatatccaaagagatttattctgagccaaatatgagtgaccatggcctgtggcacagccctcaggaggtcctgagaacatgtgcccagctcatgggggcacagcttggttttatatattttagggaggcatgagacatcaatcaaatacatttaagaaatacattggttttgtccagaaaggtgggactactcaaagcaggggcttccaagctataggcaaatttaaacattttctggttgacaattggttgagtttatcaaaaaacctgggatcacagaaaggaaatgttcaggttaagataaaagattgtgaagaccaaggttcttttgaagtcttatagtggctgcccttggagacaatagatgacaaatgcttcctgttcaaatctttaaaaggtgctagactcttagttaatctctttaggattgggtgggcctggaagaaaaaaattctagctatgttaatagagattgtttacagatgcaaatattccctcacaaaggactttgcagggccatttcaagatatggcaaagaaacacgttttggggtaaaatattttgattttcttccttgtctcataacgttatgccagagtcagattggaaagtaagtcatgatatataggattaaataaaacccatctgatgagaatttattatttgtagggcttgactccccagaccccttagataggaatttgggaaagagaaaaaaatcagagtttagtcctgaaaatcaaatgaagtatctggtttatggtaaagaattttgagttaatttttgaatgaactttgaatgagatgggaagtagtgggagagcgtggagcaaggaagagacctgatttgacttcagctgttaaaatttttctctttgttggtagaatagagtttggagaacagagaaagcaggaagagcagataggaggctattgggatgatttaggtgtgtcataaggtgaaagctgggactagtgtggtagaatatgttgtggtaagaagacaatgattctgggccgggcgtggtggctcacacctgtaatcccagcatttgggaggctgaggtgggcggatcccgaggtcaagagacatagacaatcctggacaacatggggaaactccgtctctactaaaaatacaaaaattagctgggcgcagtggcacacgcctgtagtcccagctacttgggaggctgaggcaggagaattgcttgaacccggaaggcagaggttgcagtgagcgaagattgtgccactacactccagcctggagacagagagggactgtgtctcaaaaaagaaaaaaaaaaaagagacagtgattctggatatatgttgcaaacagagtcaacaggattagttaaaagattacttgagggaaaagacaaggatcaagttgctactaatgaaaaagactatagaaagaggtggtttaaagagggagagcaggaagttagtttagaacatgttaaattttaagatttccattagctatccaaatagagataatgtgtaggccactgaatattcgatcacaaacttcagaaatttgtacaggctgaaaaaagaaatctgaaagttactcgcatataaatgattatttgaagccatgaggcttgatgaaatcacttaagatatgcttgtagaaaaagaagataagatattgaaaggctgagttctggaatactttgacatttagaggatgtgagaagaggaacaataagcaaaatatattaatgctgtgagaagaaaggtaagaagaaaatgagggctgtattgtgtcttagaaggcaagtgaaaaactgtttcaggggtagcagatgattttttttgatggcctataattcaaatctgggaagtgtttaggagagaggaaagttgtggaagagaaaagagctactatatgtaatgtctgggcagaggaagcattgccctcataggtgagagtcacttttcagctagagaaagaagatacagggaacatacagaaaagttgataaagggatataggtgattttcccaatgacagattgcagtttacagaagatggtgttgtagggctttagaatttggaaatgggtgagaattctggtcagaaatgtagatgtacactaccctgggggaaaagggtacagagaattagggatgacctataaaacttgtttccttgtggtgacagatataacagggataaatccataatgaaatgtttcctgatagaaggaagatagatagttatagtaagatctcatcgccttccattattttggagggtgagcctttggggatgagaaaaaatggggagctttgcaaacatacactacatataaggggccactaatggtttgaaaataatccaccaattatttaatacttcttaactacctaaatgtaggggtgtgtgtgtgtgtgtgtaggtacagatatagatatagatcttcttatatatgagcttaatattctccaaactcagccctcacaaataacaaaccaatgtcatatgtggaaagcttattaatatgcccaagaattcagtgtttgggtataaaatgaatgtctcaccatttacctttttctttctatcaattttcttcctgatagaacttgtggtaaatatcacaataccatttatgggtgacagcaagataaacggaactcaataattactctgtctgttcctatcaagatggcagaggccctagtacctgcccagttgctatagaaaaggatattcattttagctaccacaactcaggaaaaataaatagcaacaaaaggtaggagtgattgtacctagccaaaataagaaaatccaaaaatgaaggcttttcaaaaataaaatgcattcatcatttcccttatatgagataaccagaaaattgtaaatctaatccattctaaaagattaaatgatgattggctcacagagctggtaatgatagagatttttatttgtgtacttatttcctcctcatagagatcatggcaacttgtattcatttgtattacttttagacctataaagatagtgataccagctaaaagaagaaaaagacaaccatttcatgttatgtgtaattggatatttgacattttagatagagttctgattatacttgacagatgtatttttattttcattttatactctctttttaacaagcatagtttatttttcttgatttttttctctaaaataaatgtttgaaatagtagaagattttaatttcatttttctgaatgtaatatttatgctagaattaaaatttgaaagacattaattgtatacattcaaaaacaaaggtaatgagaaacaatattcacgtataataatacaggatttttagttttttaagaatgtaccagatgcaaaaggaatgggttagtacaacccttagtttatcagagtctaataagtcttttttttaatgctgtctacaaaattacattaagcttctaaaaaaaatcacccattttagctaaagcaatcacaacctttattttctctccaaactttcttgtacattgtccacctcttgagactaaagtgagaaaatattttaccatatccatggatttcaaaggggaaaaatacaggcaaaagaaacattatttcccagtgatctccactatgctttcacagatttctttttggtcatataagcctgtgaatcatcacccaatttttagcacactttattttgtttcctccaagacaggcactcgaaatataatctcaatatattaaagatattgatagacaagtaatacttgaaaaagcatgtttcattttgcaaaaccaaatcccactctcttattctcagctccttttgttctgaagttggtaaaaatgtgtataatttgcctttcattctactatctgagcatttttattttaaatttttattgtgtatgctacttctaccacttaataagaaaagtgttccattttttaagaaacagaaaagtattctcaacttagcataaagattagaaaaaaggaaacaaacctacagagaactgaattattaactgacatcattaaccaaaccaaaggacaacagtatttttgagttctaattgaatgatccacaagtataaccaccttctgaatgcaaaaaatatattctagacatacttaacagattgtcctccaacaactctttgaaaacatcatctaatgaggagtttgtatttcttaacacatctttttcctttatggagtaaaactggacaattctttttgtgttttagttccacatctcactgcctggaactttcagtctctggttgaagttctagtcttagagcaatgtacactattaatcttccctttccacacttaaaaagacacttttgcaagttcactatcatttgttctctcaagcaatgaacacagttctgtgaattttccaatattgtgctagttcgctagatctccaaggatttaagatcctatcttgtgttttctaggtccttctgtagtagaccaatcatgaataaggtaagctagttgcttttacattttagcaatgatgagtgatcatgtggatctccaaataccgtccctgaatttttatttccttggactacctgtccattgaaatacagccattactacctagattacaacatactgaccattgtaatatctcagtctgttgagaggttgtaacaaaatatcttacactgggtgatttataaataatagaaatgtatttgtcacagttctggaagctgggaagtacaagatcaaagtgccagcaaattcagtgtctgatgagagtatgtttctcataggtgccaccttctctgtgtgttcacatcacaggcagagtttcacactgcaggcagagtaaaagggaaaaactcactctctcaagcccttttatcaaggcactaatcccatccatgaggacgtaaccttcatgacctaatcattttccaaaagccccatctcttaataccatcaacgtggggttaagttccaactttgggagagacaccaacattcagactatagcattcttcccctggcttcccaaaattcatgtctttctcatataaaaaatgttattccaatagccccaatagtcttaacacaatctcgcatcaatattaaagtctaagtccaaagtgtcatgtaaatatcacctaaatcagatatgggtaagactcaaggaataattcatcctgaggcaaattttccttcccctgtgagcctatgaaatcgaataggttatgtgcttccaaagtacaatgcttagacaggcataaagtagacattcccattccaaaagagagaaatagaaaagcagaaaagagcaacaggtcctgaccaaattcaaaacccaatacagcaaacaatattaaatcttaataatttagtggtgtgatctcggctcactgcaaccttcacctcctgggttcaagcaattttcctgcctcagcctcccgagtagctgggactacaggcacgtgccaccatgcccggctaatttttgtatttttatttgagatggggtttcaccatgttggccaggctggtctcaaactcctgaccttgtgatccacctgcctcggcctcccaaagtgctgagattacaggcatgagccaacatgcccagcctttattcagattttctatttcatcaggatacagttttaataagttatgtgtttctagaaatgtatcaatttcttctaagttttccaacttgttggcacgtaattgttcatagtttcttatcctttatatttctgtagtatcagttgtgatatgtcctctttcatttttgattttattcatttgagtcttccttctttttcttttagtataggtaaagttttttgattttgtgcatcttattttaatattaaaatattaaatgaaaccacttaatttcatttgtattttctattgtttttctagtccctatttatttctctgaactttattataatttccttccttctattatgtttggctgaattcttctttttctagttccttgagatgttatgttaggttatttatttgatttttttgttttgttttctaatgtagaggtttactactatatatttgtctttagaactgcctttgctatgttccataaattttggtatgtttgtgtcagagtatgctgacacatgtatatctcaagacattttttttttttttgagacagagtctcactctgtcacccaggctggagtgcagtggtgcaatcttggctcattgcaaactccgcctcccggattcatgccatgcttctgcctcagccccctgagtagctgggactacaagcgcccgccaccatgcctggctaattttttgtattttttattagagacggggtttcaccgtgttagccaggatggtctcgatctcctgaccttgtgatctgcccacctcggcctcccaaagtgctgggattacaggcgtgagccaccacgcctggccatctcaagatattttttatttccctcttaatttattctttgacccatgaggtatgcaagaacaggcgttcaggagtatgttgtttaatttccacacatttgtggattttctaaaattcctcttattaatgatttctaatttcataccattgtggtcagaaaagataatttatataatcttaatcttaaaattgttaagacttgttttgtgccctaggatatgatctatcctggagaattttttgtgtacttgaacaagtctgtattctgtagctttggaataaaatgtacatatcttttaggtacatttgatctacggtattgttcaagtctgttgcttctttattgattttctgtatggatgttctatccattattaaatgtgggtattgaactctgccactcttattgtgttactgtctatttcttcctttggttctgctaatgcttgcttcacatatttaggtgctacaatgttgggtacatatatatttgcaattattataacctcttgatgaaatgatctcttaatcatctcttatgatgactttctttgtcactggtgacagctcttgacctaaagtttattttgtctgatgtacatatagccattagtgatctcttttgactaccatttgcttgggcatgtaatatgtttttctattcctgcactttcactctgtgtgctcttaaaactaaagggagtgtcttggaggcagtatatagttagacctcacaattttagatattcagcaattctgggtcattttattgaataatttaatacatttacatttaaagtaattatcaatataggtagggacttactattgtcattttgttcattgttttctgcctggtttgttgtttacattcctttcttctcttgctgtcttcctttgtgacttgattctttgtagtgttatgctttgattcctttctctttattttttatatatctacgagagttttgttttctttgtgattaccacaaggcttccagaaaatgcattatagctataacggtttattttgagctgataacaacttaatttcaaccgcatacaaaaaaatctacattttaactttttccctccacattttatattattgatgttgcaatttacatttttttgtgaattgaatagccacacaaatattaataaattatcatagctataattactttaatacttttgtctttttttttcttttttttttttttgagatggagtcttgctctgtcacccaggctggagtgcagtggcgcaatctcggctcactgcaagctccgcctcctagattctcctgcctcagcctcccgagtagttgggactacaggcgcccaccaccacacctggcaattttttgtatttttagtagagacggggtttcactgtgttagctaggatggtctccatctcttgacctggtgatccgcccaccttggcctcccaaagtgctgggattacaggtgtgagccactgtgcctggccacttttgtcttttatactagagttaaacgtttcttaagcaccacccttagagtattagagtattgtgaatttgactatattcttaccttcacagtgagttttaaaacttttaaatattttcatgctttcttttgtttcaacctgcataactttaagatttcttatagaacaggttcagtggtagtgaactccattaactttttttgtctaaaaaagtttcatttctccttcatttctgaaggacgctttatgcagcatggtattgttggttggtatttgtgtgtatgtatattttagctcttttaatatatcatcccacagtttcctggcctgcaggttttctgctgagaaatatgctgataatcttatcatggttctcctgcatgttacaagaaacatttctcttgctgttatcaaaattcttttgtgtgactattgaggatttgattataatgtgtctcagtgaagacctctttatgttgaagccatttgatgcttttgggcttcatggattgagaggttcatgtctctctccagttttggggaacgtttctgttgttatttctttaaataagctttctgcccttttttctttatctgtttcttcttcaactctcataatgcatatattgacttcttgagagtgtcccataagctctctgggttttctttaccatttttaattcttttttctatttattcctctgatagtgtaatttcaaatgacctatcttcgaactcacttcttctttcttttgtttaattacatatactgttgaaactctccataacatttttcagaagggccaggtgcagtggctcatgcctgtaatcccagcattttgggaggtgaaggccagcagatcacgaggtcaggagatcgagaccatcttggccaacacggtgaaaccccgtctctacaaaaattacaaaaattagctgggcgtggtgcatgtgtctgtaatcccaactattcgggaggctgaggcaggcaaattgcttgaaccagggagtcagaggttgcagtgagccgagatcacgccactgcactccagcctggagacagacaagactctgtctcaaaaaaaaaaaagaataaaaaagaaaaaaaaattcggaagatagctgactagacacaatcaggaaatgtctcttgcactgagaggaaccaaagtttcatgtaaaccattacacttcagacagatctttagagagaaaacacttaatgagacaggtagtacagacaccatagatgaaaacagaagttgaaaagtctgctcagagatgttgggtgccaggattggctcctggcccaaaaccaaatctaagagaagggatgagtgaaggaactccagggcaccatattcctgccgcagatctctggggtcctagccacaggaactcccacaacccccacagacctttgaactggcagcggtagccacccagagatcaggcagaggaacagctcgaatctgcatggagcctagaagggttttcttgccgtgcagccgcagcaaaattcaaacataggcccccatctcccaagcatctccatcttgcactcagcagcttcagtccctgctggttgccagaccagaagaaagcaggactgctattgccataagagtgcgggtatctgattcacatgtcccctgacctgctgccccctctcaagactgcccacctggcagctcttgcaggagggtacccgcagcacacccccactgccctgccggggtgatttgctggtagcctaggagcagtttggccctcctagcatggccactgctcaaccccaaggtgctagaggacaaatccatggtcccagtcccaactccctgggattgaagcataccacccaagagtatcgagctgagattgggtcctgaactcgagcatggggggagcccccacattgataacacataggagacagtatgctgtggatttctacgctagcgtaggagttgagcttttctcccttcccaagactgttctgggacggatgtggcctgataggcaactgcaacttcttccccagagagatccatagccagaacaacaggacaggttcagagatctggatgcagaaggcttgggataatcctaaccagtatagccttctcttggggcagatgccagagggtgacctgctgggtcaggggagcgtgacctgggtggaccccacagttgtctgccaagctgaaaattctgggccctgagtgctttcctgattacatacccacaataccactgctctacccaagtgctctactgcactactctgtccctcacccaggtcactacctgacaccagcagacatacccaacaaccctctctctgactcttgcaagcataggggatgagtgagccctcaggaacttgcaggtctcctgatgacctgaccctcagctgggactgcccctaagggaggtgggagtgcagcccaccaaacccttccttggggcaaaggaaacatgagcacagcaccagtacatggaaaagatgttacaaaggcctgggaacagacttggagagggagttatctcttgcccctcacatcctctccttagagcgctgcttgcataagcactgaaaacctcaaaggttgagtgactaggaggatatctgctggctcttactcttaagcaccagctactggactgcagtctgaattacactaccaaacaaatatccctccactatgcaatgcctctgaagcctacagttacctatctgaatcctacaggtacctatctacagcttaggaaacaatatacaaccttggtcctctgaaagcacccagaaaataagccaattgattatacacaacattcaccatagtcaagccctcaagagaaagaagaatatggaatcaagctgcatcgaaatgaccacaaatttacaaagaaaaacaaagctatctccctcctatgagaatgaatcagtgcaggaactccagtaattcaaaaagtctcaatgttttgttacctccaaatgatctcactagttccctagcaatggtgcggtggctcacgtctgtaatcccagcactttgggaggccgaggcaagtggaccacttgaggtcaggtgttcaagaccagcctggccaacatggtgaaaccccgtctctactaaaagtataaaaattagccaggcgtggtggcaaatgcctgtaatcccagctactcgagaggcttaggtgagagaattgcttgaaccccggaggcggaggttgcagtgagccgagatcgtgccactgcactccagactgggcaacagagcaagactctgtctcagaaaagaaaaaagaaaagggaaaagaaaaagaaaaagagaaaggaaaggaaaggaaaggaaaggaaaggaaaggaaaggaaaggaaaggaaaggcaaggcaaggcaaggaaaagaaaagaaaagaaaagaaaaaaggaaaagaaaaggaaagaaaaaagagtaagtgacgaatttccaggcaatgttaaaaatttaaagtcataaattcattagatgcgtagactagtttggtggcttggcttatgtaactaatataactggattccaaagctgctaatttgtaccttgttaatgtcagaaatgacttcaccccagagctttactcctaccaatgtgaatatttccattttcatgtatatgttgatagacaacagttaaatattcagccatcaaatattttttgagaattaattttttgctgattactctgtcacactctcatatgtacatttaaaaaattagttcatatttgaaatatgtttatacacacaccattcatatatatatatataaatcattgtatttgattttgagtgccgtcttaaatgtgaaatatcactgttacatattttttaaagtttcataaatgaatgaatgaagcagtaattgatgcctataaagtagcaattttgattacttttctactaatatagctatagtttggagattatttactcttttctcctaacccaatgttaaatgtaatattagtgatttgattcagatgtttaaatacaggtagattctgattcagattaaattatatttcctaaattgtaaaagtaaataacaccagggatataggagtgcataccaataagaataatgtattagttttagagatatcaacttccagagttgataattgtaaaccaaataactatgataacttcatgttgactttggtttaacatgtattatgcttgtcataaattacatactaataactagtcacaattatgtatcacctgaaatccaacaatttggtctgaagtgaaccatatgtcataaccaactgtgaaggtgaatgttgagctcacatcctaatgtggaaactgaagaggcatagcaaagatttgttattaagcaaaaagcaatcaatctcactccactgaacctagtcaatgcagctaaaattctctttagaaaataattatgagtctgttgtaatgcatagacatgtgtgtgaccaaggtatccaaattctgttccaaatggcacagacagacataatgatttttagtctggaccttctttattcaattgcagtgaaatccactcattttaaattgcagaattcagtggtaattagtacatttacaatgttgtgcaatcaccatctttgtgtacttccaaaacattgccattttcacaaaaatcaaatcttgtgtcttataagcagtcactccctaatcccttctccagtctctgacaaccagcaatctgctttctgtctctatggatttacctattttaggtatttcatataaaggatttatacaatatgtgactttttatgtctgtcttctttcacttaaagtatagtttgtaaggtttatccacattgtataatagcatgtattaatacttctttcccttttatgccacaatttgcttatctatttatccattgatgaaaatttgggttgtttctactttttgacttctgtgaatagtgacactatgaatatttatgccacgtatttgagtataatagtttttcaattatttttgtgcgtaaatctaggtgtagaattgctgggttatgtgataattcgatgtgtaactttataaggtacggtcaaactatattccactgtggccaaaccatttaaaattcccaccagcaatgtataagtgttccaccttctccacatccttgccaatacttcttatttttcattaaaaaaatgtgaaatgatatctgattgtgattttgatctgcatttccctaacaagtagtatatattatcagctatataatttggcaaacattttttcccaatctacgagttacctagtaagcttcctgaaaatatcctgtgatatacaaagggtttttaaaaaaaaaaaaaaaatttgttgaagttcagttttatctattttttcttttattgcttatatctaagaatccactaccaaatctaaagtcaagagggtttcttctaagagttttttagttttagcttttatatttaggttattgatccattttgtgttaacttttgtatatgctatgaggtagggttctaaatttactcttttgcctgtgggtatcctttagtctcagtaccatttgttaaagagactatcctttccccttgaatgttctgtctctctctctctctctctctctctctcccttcttctccctctcacttgaatggcctgtaaataattctcatatgcctactcatgctccttttttgccttcaatgttcttcttcacatttctcttctgccacacttttagtcacccttctctgttcaggtcctggctcaaatgctatctctttccaggtcttctctatacttgctaagcctggaatgattacttcccttactggcactgcatgacagcttgtgcatacctttattggaatatttttcatgtttattgtggatgtttgtcattattgtgagatatttgagagtggggtttgtttattaagaacttttatagcaaatgggatgaaatatccaaaatgacatgaggagaaaagatgatagagaaataagcaatctaaaagtttgataatgagtttcaattctaaaaattctgtcttcttgaaaaaatagtgaaattatatatatatatatatacacacacacacacatataaattcacaaatatacatgtgagagtgtgtatgtgtgtgtgtgtgtggacagagagagagagagagagaggatacagtatttgaaaagatgagagatcactcacgcccaggaatctccctcttggtgctaagagtcttgctatcaactttccacttacaaggattctgtgaattctgcagatgattctgcaacatctgcagaaaaattcacatcatctgttgaatgacagcatagttttatcataaaataattttaagacatttacaaatatttaaatgagaaggtattatttagtaccatatgttaatgagtagcttcggaatatatgtcaaacatttttactcttcttgtcagtcatgtttccctgctgcttttcaacaatttaggctacattacaaggcttgttcattaaggaatatgtgtgtaagaagatacatagatggtgcctacataaaacacaaaggagagaaggaggaggctacaacagagacaaagatcacagagtaaagggaaggaggatctttttcatatatgagagggagatagagaaagaaaaggtattagagtcagtgtctttccttgcgctgatccctattttgaattgcagagagggaaggagaatgagtagattggcaaatcaaaatcattactgggaaaatcaggcctcagaagcaattttgtgccacattaagtttgggaatctgggtggggagcatctcaaagtgagcatcttgtgaacacatggcacccacattgcaatgaaactagaagtgtgaaaagtaaaattcaggcagaaagaattagaactagtaccagcagatcctctatgacaactatatggaacttacccatgagtttcttattgccatattgtagttacacaaaataattgatggtgtaggctggaggtttccctacaacaaggttggtcaaagagcccatctgattgagggctacagggcctggaaatgcctgctctgtggttccattggagttgtaatcaacatcatggaaatcatcaagctgaggtaaggcctggccagcaagaggatgtagtctagccctttgcaattatctatgacaagagaaccacccaagccttttaccagccttagatttaaatagagaaagctatcgtgaaccaagaacaaagtactaggactcaactgttgatctagagatacttctagttttcattggaaaaacattccagttgtctactgttcagtcctactgacactattatatgaaagaaaactgggagacactctgagagtctaaagatttacctaagagagagttagtttacttaaaagagattgctttgaactgaaaaatactgatataatttttattgtcaagtttactatttttttcctgctatatggcagaaagtagcttaaaccagttgtgggaaattaagacgccacaaattagttcgcaatttatttctattgttaaaatattgatccaactgtatttttataatactttcttatccatatgttttatttattatttaatcacttggttaaaaattttctccaagaacatataaaatatttaatatagtaaatcatttttatttatgatcagagagattaaattatttatatgtatgtggctaagaatgcatttatagaacaacatatataaatgaaatatttattaccaagaggataaggaaggagttggtacacagacccactggtcaaattcggccaattgcctgtttttgtaattaaagtcttattggaatgtagacatcatcatctgtttatgcattgtctatggctgctttgcactacaacagcagagttgagtagttgcaacaggaactatatgggcctcaaagacaaatatatttactacttggccctttatagataaagtttgttgagtcctggcatgaggaatcattccttgcagatatttaacacatttttactttattgtgacactaacaaagtgtctctaaaacctctatttgtgaagggacttaaattacaaacaagttaaaatatttttataaccatgctaagtatctgcattataatggaaaggcaaaagtagttaacaaatggttgtttaatttttggcaactttgtaaaataaatcttggatggcagaaatcaggtaacttgaaaccattgaaaatgagccaatttaaaaaacaaggctatgttttcttatttccccaagtgtcctggaattctgtagcttttctctgcttctatgctaaaactcatgctgctattattgaacactgtaagcagtagaacactaatatccaacagatgccctagccattgcttaaattactcacttgggcacagagagggaaattaaaaagtaacccagtgaacatgtgcattttgaaaaacaagtaacatttttagcccatcttaattgcagatttcttttaaaggagaggcagtaaactctttaaagatccaatttcaatgtttctgaaagctaaaacaagttggaggtaaagagaataaatctggcttgcacattgagctaagcttcagggtgtcagcctgctggaaatcaatagagcattccatagacagtctgcaagatcacagactcatgctgggttataaaaacactctgattttacattttctttcttcctttctgctagtctgacctttggttgcagagtcaaacaatgaagtgagaataaaatacacaatggaaattctttgaaaattaaaaatggaacaactttttgttgaaagaaaaaaagtctcagaatataatctttgagattagagagtcctcaattccaaaatccactgattactattgttccttttactctgttttgcagtaatgcagtcttatttggagcttctaacagaataatatgagttcgtgatatttgaaattgtgatgtcttaaccaaattaatttcaagattcaaaatctgcacaaaacaactctggcctaaagattttttgccatgcagagctctttacatggatccaaaatagaaggaaatgaagtggataataatccataaccatttccttcagttcagaaaagaggcacaatcagaaatagttaaagcatatcctataagcactgccattagctgattctagattagtcagctactcagttgtgtgtgtcagttcagatacatttaatcagtgaaatcaaggaaagacataaaatctatataagttattttcttaatagttataagttatgcaaacccacagcaaatatcatactgaatgggcaaaagctagaagtattccccttgaaaaccggcacaagacaaggatgccctctctcaccactcgtattcaacatagtgttgggagttctggccagggcattcaggcaagagagagaaataaggggcattcatataggaagagagaagtcaaattacctttgtttgcagatgacatgatcctatatttagaaaaccccatcatctcagcccaaatgtttcttaagctgataagtaacttcagcaaagtctcaggatacaaaatcagtgtgcaaaaatcactagcattcctatacatcaacaacaggcaagctgggagccaaatcatgaatgaactcccatttacaattactataaaaataataaaatacctaggaatacagctaacaagggaagcgaagatgctcttcaaggagaactaaaaaccatcgctcaaagaaatcagagatgacacaatcaaatgaaaaacattccatgctcacagatagaaagaatcaatatcgtgaaaatggtcatactacccaaagtaatttacagattcaatgctattcccattgaactatcattgacattcttcacagaattagaaaaaaatatttaaaaatgcatatagaaccaaaaaagagcccaaatagccaagacaatcctaagcaaaaagaacaaagctggaggcatcacgctacctgacttcaaactatactaaaaggccacagtaaccaaaacagcatggtactggtacaagaatagacacatagaccaatgaaacacaatagagaactcagaaataagaccacacaccttcaaccatctgatttttggcacatctgacaaaagcaagcaatggggaaaagattttctgtttaataaatagtattgagagaagtggctgaccatatgcagaaaattaaaactggaccccctctttacaccttatgtgaaaattaactcaagatggattaaagacttaaataaaaaaaacaaaaatccaaaaactataaaaaccctagaagaaaatctaggcaataccattcaagacataggcatgggcaaagatttcatgatgaaaacgctaaaagcaattgacacaaaagcaaaaactgacaaatgggatctaattaaatttaggagcttctacacagcaaaagaaactatcatcagaataagtagaaaacctattgaatgggacagaatttttgcaatctacccgtctgacaaaggtccaatatccagcatctataaggaacttaaacaaatttacaaaaaacaaaaaacaaaaaaacaaacaacactattaaaaaagtggcaaaggacttgaagagatactcctcaaaagaagacatacatgtggccaacaaacctataaaaaaatattcaacatcattgatcattagagaaatgcaaatcaaaaccacaatgagataccatctcatgccagtaagaacagctattattaaaaagtcataaaacaacagatgctggtaaggatgcagagaaaaaggaatacttttacactgttggtaggagtgtaaattagttcaaccattgtggaaggcagtgtggtgattcttcaaagacctagaggcagaaataccactcaattccagcaatcccattactaggtatatactcaaaggaatataaatcattctgtcataaagatacatgcacgtgtacgttcattgcagcactattcatgatagcaaagacatggaatcaacctaaatgcccatcagtgatagaatgaataaaaaattgtattacatatacaccatggaatatgcatccataaaaaggaatgagggacatggatggagttggaagccattattctcaaaaaactaacacagtaacagaaaaccaaataccccatgttctcacttataagtgggagctgaatgatgagaacatatggacacaaggggaaacaaaacacactgggacctgttcggggtgcggtggggggaaggagagcatcaggaagaatagataatggatgctgggcttaatacctaggtgatgggatgatctgtgtagcaaaccaccatttacctatgtaacaaacctgcacatcaagcacaggtacccctgaacttaaaataaaagttgaaggaagaaaataagttaggccaaacccttagatcttaaaaaaaaaacctgaagtttcattttttaaaaaaatgtagatgtctgcgtgtacatgacatatactgtatttttaagacttcatttaattaatgctttgtaatgagctgggtttttgttgttgttgtttgcaaaggatgacacctggataaactgaataaaagaggaagatccaaatgattcaggaatgaaaagggcagaaaaaaaattacaaaggttagagtaatacagtttaaaggttgaaggagtctgcaaccagtggctgaaataatgaattattgattcaagtccagccacagataaattcttgaagatttgttacaacttgtaagaagatgctcagaataaaatcaagcatcagtgcttaaccagtccacaaaagacatgagttgcttatttactttgatttcttttgtgtttggcaaagaatttcactttcaatttgtaggctaggattttccaaagctttaggattcagaactaataatcaccattgtaacttgccagactatgtttgaatagacgtttacagcacaaatgcaagcaactacattttctccaagaattaaaggaactctaaccctgctgtgaagcaatcacttgacaaaataacttgttttttgtttgtttgtttttttcaaaaaaacccctctctttattttcctttccatatgaatattactttccttctttaattttttggacaatcaataattttttgaaaatgtttggtttaggtaatgtataagccaattatgtgttagtttcaaaacaatttttctaacagtaaattgcacgtttttttgaaaaagataacacttcattcacccacaggccctgcactgaatccaggatctctgtattttatttcatttcactaacggtaacagtaaaatgttatctaaaattgttattggcagtaaaagttacaatcacttggcaaactgtaggtagctgtgaaagtagacatgaagataagctgaagccagacaacctgggttcaattctcggctcaacctcttactagctgctttgtcttgatttctgtgtttctcagtttcctgatctgcaaaatggaattgataataatactttcacttataggattgttgtgagaatgcactgagataattcttgggctgctctgtagcatatttggagatgctgtaaagaaattattgtttttttaaaaaaatattatttaggcataatgtacagataaaattaagtttaaagataacacaatatttgcaaaattaaactttccacatttttgtatttaagttcatgaaaagttgaataatataacccaagtcagaaaaataaatgccagcaatttggcatttgcattaaaatatctatcttttaaattgtgatgctgattctgtttgattcaagtgatctaaggattcaaatatttactgattttgaaattaattcgagttgctccaaaaaatgcaccatcatactttaatagagtggaagttgtttgaagtttgataatcagccttcctgagagcaaaattataagactgagcagacacctctatgatgaagtgaggtggtatgatcagttgtgcaaataggcaaaacaaaagagaaacaaaaatcagtatttttgtttgagttggagtctttgtgcactgagaataggcagggttgatgtttgggtgattaatgacttgccttgcacagattctccattctcagaatgtgtgctctgtgaatattggtaaggcagaccatggtaaacagtgtttattatgtttacagcatagttttccctcagacactgagtgcatggagttactggatatataaaaggaagccaggattaatttttaaagctgtgttaggacctccaatgttagaaacattcttttattttaaagcccgtggcatactgtctatctcatggtacatataaaatcatcaggaacttaaaattgtaggcttggtgaaatcaaagaaaataaattgaacataagcatagataaagcatacctttttactgtgcaatgaaattttccttatccttctaacaaatacacactcagggtgcaactgtgatttgctagaataacttgagtctgtccagtattagattgagtttccacattagaaactgtgaaagaatccagcaactccaatgcaacataatgagaactagaatatcttctgtaatccaaatgccacaatgggcacaatataatatttaatatcaacatttacagaatgataacatatctaaaaagtaaatcagtttcttattagtggattttgccagataatatttgaaaaattacaatggcaattcagcagcatcagtcagtgtttgtaaaatatagcacctggttctcaataaattctcatagttatcataaaatacaaataaaaattaattttatatttatagtagagtcacctccttaaaatatatgcatgttttatctatagcctatatttttatttcagactggctctccctctgttatctccgtgtttcaggattttcagttagtatacactaactgtgacaattgagtaaagttgtattcacacttgacactagatgatgtagaatattaatatgctcttaagaaatataacatgaagtatgtagtttcaaaaaggcgtgatgcttaaacttactttcatattgaatagtaaacactttatagaggcagggcacggtggctcacacctataatcccagcactttgggaggctgaggtgggcagatcacttgagtccaggagttcaagaccagcctggccaatatggtgaaactccatctctactaaaaatacaaaaaatagccaggcgtggtggtgcatgcctgtagtcccagctactcgggaggtggaggcatgagaattgtttgaacttggaggtggaggttgcagtgagctgagatcacgccactgcactccagcctgcgcaacagagcaagactctgtctcaaaaaaaaaaaaaaaaaaattaaagagaagaacaagacaaagacaaatgtgacaaatctttagtaatttatgacactaggagaaaaacatgagtttgttctttgtattattccttcaacttttgcatgtttctaacctttttcacaataaaaagttaaaaggaataaattttctattatattttccttgataagaagtctatgcttacttattaaactattaatgggaaatctgtattttaaaatgtttatttatgcaaacatgaatactatataatgaaaaccaatagtatagtatatttgtgtgtgcagatagatagatagacagacagacagacagacagacagacagacagatagatagatatagacagacactgtattggtccatttgtgtaactataaggaatacctgagacagggtaatttataaagaaaagaggcttaattagctcacagttctgcaggctgtacgggaagcatggtatttgcatctgctcctggtgagggccttaagaaccttacaattatgaaagaaggcaaaaagggagccagtgtatggcatgacaagagacatctgctgtatattgtatttgttttcccttggatcacagattagactcttctctaacagtaatgataagaaatatggcaacactgctctctaatgaagaatttcagttgtatttaaactataccttaaacaccatgctccatacaacttaggaaaatatagtgttgagataccagcacacatgtacactttaatataatttttctaatatgaaaataagcagatcatttcagtaatataatatttagtgatttttaatttcccttgttttggtagttgagcatctcccactgaaagactagaccatcaagaagactggcacactgagagcagatccttggaagaaaggcattgggaatggatggagggagaatgtagaccctggtctgaagagggtggaagctggaaatacagcacaggactgccaagcattaggactcattactggccctcagcagcttttggggaaagggtgggttaaataggtgaggagtggaccactgttaccacaggcctccggaatcctagcacaggagattccatgaccactaaagacatttgagccaacagggagagcttcttagagaggtggcagggacacaactctagcatgtgcagagcccagagggtttggcacaggaatggcagcagtggatcaccgccaggatgcccatcccccaaggctcgccacactcctctaagtggctttggcctttgttgactgtcggacctgaacaaagcaggtcagtcttgcctgtgggacagggccagtctgatctgagcaccacctgtctgccagtattttccagggtctctgcctggccatgccccattgcagcgcagactcagatgaccaactggagttcttcctggcagtcccggccatagctccttcactggaagaccctgtctaaccattagagagcttcagcagatgggtccccaatgaattgcacccacctgcagcctctttctaccgctttgccagcacacatgcatgcatggaactcaccacctctaccccgcccctgctggtgcacatggtccctgttgccccatcactgctggcgtgtgctcatgaatgcagacctatttgctggtattcagatgaagcactttgctggcacctcccccatcagaatgttgtcactagtgggaagggaacaccttgttccctccagcgtagcaggtgcttaactaaagtggccagagagcaaagctatgggcctggttacagccactcagggttaaaacatgcagctcaggagtgctgaactgaatctttgtcaactgaagtaatccagaaatgaagccagttgactgaatccaacttataccacagtcaaattctcaaggcaacaaagactataaaagcaaaaaacttatccaaagtacaacaacatcaaagattaaaagaatatcagcccagacagataagacaaaaccagctcaagaactctggcaactcagaaagccacagcatcttctgacctcctaatgactactctagctcttcagcaatggctcttatccaggctaaaatggctaaaatgacagacatagaattcagaatatgaacagtattaaagatcattcagattcaggagaaagtgaaaacccactccaaggaatctaagaaattcaataaaaagataaaatagctgaaagacaaaacagccattttaaaaaagaaccaaactaatcggctaaagttgaaaaattcactacaagaatttcataaaacaatcagaagtaataacagcagaatagatcaagttgagcaaagaatctcagggcttgaaaactggtgtgttggatcaactcagtcagacaaaaataagaaataagaaataatttctttttttccccttaaggatttcactttaatgcttatagttatagcctaatttggttcatggcactttcaagggtgaaggctgtaagagttgcttagttatagagagtctttgtatgatggcttttccgtatgctggttgtagaagcaatgtgtttggtgtgtgagcaagttcactgtctcctatggagttgaaatggtagaggtctcttgaagcttatctcattccctcatggcatgcactttttcatttatttatttttcctgagtattttatttacttgattgatggttcaggtttcagtccagtagggatgtatacctgggtaagaaccagatgtggctaaagcaagtgggtaaacacaatacccaatggtgggcagaggtcccagccttgacggaggtggctggaggagctcttagtgagtcacactgagggcttatcaaggggaagtgttggagccacctaagctcccctgccaggtcagcaggaaagctattcacctctcagacacattgccatcccagtggtctggctattcaggtcagacaagcacctcttttcatctgtaggaaagttgatgttccaagcagagggaaattgtgactctgtctcttgtgcaagcctgaacctggagggtgctcctactgaggggatgcagttacccagaagatctccagaagggctgttaatagctgtacctatgctgagctcctgtggaagaagcactgggtagtgttaaggccttcctgggtggcctggactttcaagctccatggtatgggtgcatagcccagaggcattctctcccacctcacactctggggattcttagccctttgcttgactcagtgtaggcggccgcctgctgcttccttgaaagggcctgtggattccttcagtattcctattcagttcctgcattacgtcttgaaaaaaagttcacagtgtgaatctctacacactattttgtcctttccagtaggagaggtatgctagcaatgcctctaatacaccatcttggaaaaaaataaataaatttttcatgcaagatatatttctgtattatttcatatcaccagatacacagaaaaagcctaaaagtctcctgagaagaaagaaacaaaatctcttcaaagcaaatggtacttcagaattctcatcagtaaatactagatgttgggaaaagatagaccaatgctttcaaagtcctgaggaaaataaatttgaatgagaattctataacgcaccagttaggtatgagggcataataaaggttctgagaatatgcaagaatttaaaaagctgatcacacatgaatattttaaataatttttctgagaatataattaagtgacagtgaaagtgaaggaagatatcagggggactctctaaaaatgaggaaactaacagaggaagacaataaaagatacctaattgtaaccaataaaagcaaagatgaaagtgattctacaaaaatcaaacattgctgttggtttgagtaatgtgcaaaccaaaaattgataatcagatgtagcaatatgaaagtaaatgctggcctttataaaagcagcttctatggaatcttaagaacgaaagtctaaaaggaatttaagacaaattggaagcaaagacattggagacaagaggttcattctttaaagaagttttacattaaagacaatagagaaattgaactgtagttggaggagaaagttctccttagcactttgtactttccaaactacaatgtcttacttatagtgtttattctgtgcacactgactaaaacttgtagagtacagaacttttttgtgtcattcactgacacatccttagtgtaggacctgatatatagtcagtggtaactaagtgtttatataatggatgaacaaaaacaatgcaactatcaaaattaaggaggaagaaagggtgtatgtggtgtctcttaactaaataatcatatttcatagttagaagtcagaaaataatatctatagtaggtaaatcaataaataccaataaataagttattacatattgaaaatttggaagttttcaaagtaatggtccgtgagggatcggagagggaggtgtaaggcagggattattgttttcctttacagtataatttgtaatgtttacaactttaccatgtttattttaattagaggcacacatataatatcctatatattgggccctgagatgggtgctagggaaacataaataaagagacggtgtttgactttcttcagatttcattcattgcagcaaaagagaaaataaaataatgtggtacatttgttaagagttatacttccttctgaaagagcagttctcaaaaagcagttccaagagtaattagagaactgcagatatcactggaaaaagtacagaggtttcaaaggtgattccagaaagaaaatcatttggatttgaagggagatcagatctccctgttatagatatagagcaggcagtaataggactccttaaaatggccaccataaagcacctatgaacctaccacattcttgcctttattatcccagatcagggaggcctgaaatcaaagagaacacttctaattttaaaatttttctttttttctcattgaaatgtaagtgcctatagagaagtaaatgaatagggtgaggggtaagcaactgagtttttattggaggaagaaggaaagactgatgtagttctaaaattggcctgcgcaggcccatgataaatttttcactggtctgctgtgaaatcagagagaaaacaagagactatgtgttatatatatttttttttgtttgagacaagagtctcactctgtcgcccaagctggagtgcagtggcacgatctcggctcaccgcagcctccgcctcctgggttcaagtgattcctgcctcagcctcctgagtagctgggattacaggcgtgaaccaccacacccggctaatttttgtatttttagtagagatggggtttcaccatgttggccaggatggtctcaatctcctgacctcatgatctgcccacctcagcctcccaaagtgctaggattacaggtgtgagccaccgcacccagcctatgtattatatttttaatttaaccaaatgtaattcaaagcatgagtcctcattctaaaattatgccattattttccgtggttaaaattacattttattttaaaaatgaggttgatactaggtggtaggtaggctcactttgttttgtgtatttacacattcatgtgtgtacaattgtccattcataataaaaaaataggttggcaattctaaatcaagcgcccaatttggctggcttgaattcaaatggtggcagctgagatgtaaagaagtagataaatttcagatatggaaatttgagtggatgtgtatggtcaggacgagggttatatttacaatatttaatcattggtccatgagcactgccaatcacaatagatactaccaataaacaacagtggtggtatgaatgtaggctaccagaatacaagacctggctagtgacttttgtggataattgtacctctcagggagattgggaatagtgggagagaagcaatttgcaggaaacaggtaaacacttacaggaaaatcactattttaaaagcaggttaaagagacaatttatagatataaccaattttcctttattcattctgctatgaaaattctaatcaagaaatatattgtaaggctaaataaactatattccataatattcttatttttaaaatgagaatcttttttgaaaatttcttcttgcttaatatccacttcaattaattaaactgagagacagaatttttttctaaaaaagaacctaattatttttatactaaaagtatatctgttattgttatgaaattgaagaaagctatatgaaactctaataaccactgagagtttaacaatgactttagaggtcattggaaaagtcacttctaattgaaaatcacaggattaaaaaaatacacaataggactcaaaggaaagttaaagtaactttctaaaatgttttcatttaaaaaataaatgttccaatattatatcactcacagttctgtgagttactttcctttttaaatatttggtattctgaaaaattcttgtctatattcagataagtttgttattcttcaagtaatcacttaggtaccctataaatattagataaacaaaaatacgaatcaaatgtactttaacattatgttatttcctccttctaatgaaaaaccaaaaccagaaaacgtaaaactcacagtcagaaagcatggaaaacagtgattgcacagtctatacggactgctatttccttatttggatgcaacatctacctttcagggatatgatgttaaactgtacagatctttacaaaatattaatttttattattatctctcaaaataattgaaagattttttacttgctttactgacattaatagtaaagtctcaaagaatcattgttccccactctaattatccagaaacttgtgcagctctcaagaaattagttacagattcaaactggagcaacttagaaaaattgctttgatgtggccaggcgcagtggctcacgcctgtaatgccagcactttgggaggccaaggcgggcagatcacgaggtcagcagttcaagaccaacctggcccatatggtgaaaccccatctctactaaaaatgtaaaaattagccgggcatggtggcacttgcctgtagccccagctactcaggaggctgagggaggagaatcgcttgaacccaggaggggagacggaggtagcagtgagctgagattgtgccactgcactccagccatccagctagggcaacagagcgagattccatctaaaaaaaaaaagaaaaaagaaaaattgctttgatgttttgcattagagtattggtagagaaagtagacccgtaagctgtgactcctcagaaaacataacagaaacacacattaagggactgtcttgtcttttctaattgctcataaagattgtttgttctaagagtgtgccattcaatactgtagccatgtgcctcttagcactttacatatgactaaattgagatgggctgtaaatccaaatacacaatgagttttaaaaccttaatataaaatagaaatgcaaaacatctcattgtttatttatatagattatacattgaaacgatattttggttatattgagttaaataaaatatgtctttgaaattcattttgcttgttaatttttatatgtaactaccagaaaattaaaaattgcatttgtgggccgggcgcagtggctcacgcctgtaatcccagcactttgggaggccaaggcgggcggatcacgaggtcaggagaccgaaaccatccttgctaacatggtgaaaccctgtctctactaaaaatacaaaaaattagccgggggtggtggtgggcgcctgtagtcccagctactcgggaggctgaggcaggagaatggcatgaacctgggaggcggagcttgcagtgagccgagatcgtgccactgcactccagcctggatgacagcgcaagactccgtctcaaaaaacaaaaacaaaaacaaaaaaaatggcatttgtggctcatattatatttatatcgggcaatgctgcgctacagggcaaaaagaaaaaaaaaatggggtcctgtacttttcttcaagctgtgtgctatacagcaaacttcaggcccagttgggtgtttacactaacactcttaaagtgttcacatacatatatgaagcataagtaaatatatctgtatgaattatgttaatgcctggagacattttttgtaaaagtggcttcttcagatttatatatattttaattctgatgataataatcataagaattcaccatttatcttctaatatcccttttttagagctagaaaaaaaataagagggttgctttcaatttatgtgtcaaagaaagttttggctactaataattcaaggtagtcataaaaaacataggacaaagaaagaattctggaataaggaaatccaaaagaaaatgcatgtttcaggtattaaattaatgctggttattctccttcactcacccatggtcattttatccattaagatcttgagactgtattctctccactgccaccctaacaccctagtccaaacaactatcgatgctcattgcaatgactttaaaagtctgtaacaggtctccatctttgcactcatggcccctacaatttcttctctgtacaacagttataagcatgttttgaaaacacaaatcaggccgggcggcggtggctcacgcctgtaatcccaacactttaggaggccgaggtgagcggatcacgaagtcacaagatcgagaccatcctggccagcatggtgaaaccacgtctctactaaaaatacaaaaattagctgggcatggcggcacgtgcctgtaatcccagctactcgggaggctgaagcaggagaatcgcttgaacccagggcgcggaggttgcagtgagccgagatggcgccactgcactccagcctggtgacagagctagactctgtttcaaaaaacaaaaaaaaccccacaaatcagatcattcattttttttctttacaccctctattggctaaatgctcatggactaaaatctcttcacttgcactttggtgccctatgagatctggccctgtcaacacctctgatcacaagtcaccccccttccctcctaccaacaacctttcctgttccatttccagcttcctaagcttcttctctgctccaggactgcctgagctccttccttccaggttactttccactcggctcattttgccccaagggcttgggcatatgctaacctgtctagctgggtgcactgccacagtcttaaagccaccctcagtgtcaccctggaatatttctgttcatagaactatcactgtctaaatttatcttggttatctataatgggtaaaccagatagaataaaattggtggagtgcaatctgaaaagtctgtctctcccactactactgtccaaagccttgaagaagatgcctttctccaacaacttttgttatctcaggatggttctcagtgccagaagagtctcctttagaggtattgcagaaatccaaaatcaacactttcttctgacatgcaactgaagcttctcctgatcctccctttctggcaccccattctcactctcaagcttgtctgggaattttgcagactgctcctggggaaggaggtaaatacggcctgatcttttcaatcccctgcttcaacttcctctcctgtgatcatggtgctgatgtggctccttcaggttgcaggacgaaatgggatgataggtaaaagacaaatacctatgtacttaattggtgctacttgatctactccaggtgacatgatgggttccttttgtcttctcctatcgtgagttacccgatgtagactctcctggagtcatctcaccctagcagaacatatcttaggctgggtccttccaaataagcccaaacctaaccttctttcattaagtcgaattcactttggcccagtacatcttgtcacgtgctgatggaagtggcatcttgctctcagtttaaccatcttccctccctctgcggtccattctgttggcaggaactcaccaagagccaggggcattaaactgtcagcttcttctccttaaagaagacagctccactgtcttggtgttctggccatcacagatatgtgttggcagtggatgatgggctaaagacttctctccgcccttcatgtgccagaaacatcatctctccgttttgtaaattttaatggagagatgatgtttctggcacatcaaggaggggagaaatctttgatgatgtttctggcacacagcatgaagatgtcacttggcagcagcttgtccagctagatatatcatttctcagaccctctttcacctgggcataactgtatcactagttctctccagttgtatgtgagtgaaagtgatgtgtcacctccatgaaaaggccattaaaaactagtggaaattctcttctgttttctctttctccagctatacacaggaatctctgagtctcaaaaggatgaaggagtcacaagatggaacgagcctggctccctgaatcacaacatggaggatgccacccaccaaccaggaacacattcactagatggttacaattgttaaaaaaatcttttactgtgttaagccattgcaaatttagggtttatttgctgtatcagcgtgatataccctaaaatacatatttagcaatttctattagtacccaactgcctttcctaacatagcgatgagattatctatggttctcaggtttgtgactttatttgaaaatccagctggaaaccatcattctcagcaaactatcgcaaggacaaaaaaccaaacaccgcgtgttctcactcataggtgggaactgaacaatgagaacacatggacacaggaaggggaatatcacacacgggggcctgttgtggggtggggggaggggggagggatagcattaggagatatacctgatgttaaatgacgagttaatgggtgcagtacaccaacatggcacatgtatacatatgtaacaaacctgcacgttgtgcacatgtaccctaaaacttaatgtgtaataataataataataaaaatccaagataaaaaaaaactttccatgaaatacctcatttcaatcatttgttttctctgtaactctgctataatgttagctttgtgaaaatagagccttatttgtattgttaatcactgttccctcagcatttggaaaagtgccaggaatatcagagacattcaataaatatttgttaaaaaataaaatgtgcattttataagaggcgttagtgtttgtatataaatctaactataactatatatctatatatataactatatatctaaatataactatatatctaaatataactgatattctggataacaccaacttttaactaaataataaaaaaaatgtggaaatctgactcaggaggagtttcaaaatctccagttaaagcaggcttctttcttgctaaagttattcagtgaagacagcagcttcagataggagaaagacagtagattaactttgttacttggtttccaatttgcatctgctcctaatgggaataacttcactcactaaatatttgagctgaacttcatcacttcctgctctcactgggtcagagtaaataaagattatgtttttacccataaagagcttgattgagtcaatgagtcaataataatttgatataatctagtgggaaatacatttcactacatcctctctcagaagataatcatcagttcattataaaagaatcatttctgaggtccaaaaccaacaataatattacttcaagtacgatatataattgtggaaattgctgattttattttttttccatttgaaaatattaacaagtcaataaacaaatggtaccaaagggaattttgaaaagtacaatcccctttagagtaagtgataaccataatctgtctcaataattttcctcattgaaaagtcagtgccagtagttcataactgaggaaccaggtaagcagctgtaattagaaatgccattgtcattcctctgctactgccagtagcacaataccatatctacagaagccatgccttatatctaacccccatctgcaatcttccaccgtttgatctgaaatatacagaatgcaaaaggtgcaatctaggtgagttgctcatgctgggttggaagagatgtggattgaggatgcattaataggcacctaggaattgtggaaaagccagaaatcactggaagagcctatggacttattcagtattcagacatattacatatcctagaggcgaaaaagaaaattgtgaaaagctgtgagaaatagaaatatatcaaattgcagaggcagatccctaggaagtactcttctgtttaactgcttaagactgtgtgtgtgtgtgtgtgtgtgtgtgtgtgttgatccacatacagttatctgtgtgtgcattattgaaatactcattttgactcttaattatcatttaggtaagttattttgaatattatttgtcataagtacagagaacttttttgtcataagtacagtgttcagatacagtatacatgatttaaggaaccagcatgcggtaattcttgatacaatgagggggcacttgccttttttttgcatgacaggtgtttggacttgtatgaatgaatgtaatttcacattcagtcaattcctcctcagctgcatttatggaagaaggcagaggaaagaacagtttgtaatttaaaaagtatctaaaaattgttcattttttgctttggcatgttttctgagcttgtattagaataatggtgtttcagatatttgcaatgttgattgcaactacatataatactcctgaattggaagtctatataaaatattggaagtctatataaaaaagaattgggaaacttgggatttttctactctacactttcctttccattccctgaacacttttttttctttcactcagggatatagagagatttcaaaatggtcataacttactctttcaaccttcccaaagtgggagtgtgagcttttttttttccccccaatacagagtcttgctctgtctcccagggtggagtgcagtggcatgatctcggctcactgcaacctccgcctcccaggtttaagcgattctcctgcctcagtctcccaagtagctgggtttacaggcgtgcgccaccacacccagctaatttttgtatttttagtagaaatggggtttcaccatgttggccaggctggtcttgaactcctaacctcatgatccacccttcttggcctcccaaagtgctgggattacaggcatgagccaccatgcccggcccaggagtgtgagttttaacaaacatcctccattgtgtaaattggaacatgcccataaagccacacataaatacacacacacacacacacacacacacacacacacacacacatatatgtacatatacacagagtgacgtagttcggctctctgtcctcacccaaatctcatgtggaattgtaattcccaatgttggggaagggacctggtgggaggtgattgtatcatggggacagatttctctttagcttttctcatgatagtgaatgagttctcatgagatctggttgtttaaaagtatgtagcacttcccccttctctctttgtcctgctgcccccacgtgaagacgtgcttgcccccactccgcccttctgccataattgcaagtttcctgaggccttcccagtcttgtctcctgtacagcttgtggaactgtaaatcaattaaacctcttttctccataaattacccagtttcgggtttgtctttacagcagtgtaagaacagtataatacacaggggaacaacaacactatcacaaatttcaaattgcagccaaagctttctaacccaatgcacactgggcaggattgctacagcctgaatgaaacaaaaaaaagttcatcttttgtcactcaacataatcttatcaaaaatatattataagttttgttttgtattaattctaatgctatgagataaatcacagtttggaaggatacttgcctagccatttattttagtcaataaagaagaaattaaaagtttccttagcaaggagtagtgaaaatgagaagacatacaccttcttcaagacttaaacttccttctgaagacaaggcacatctcagctccttcactgacttttccatcggcatttgggaagctttggggatgctctcctgagcctcaggaaattcagtggagacaacaggaaattcaatggagagagctcccgattttctctattagaagaaaagattgaataactacaccatgagaaatgcagtgtggcatttgagcttcaggaatatgtaggatcagagaaccaaagtccaacaggacaatgtttcacacatttatgcaagtatatctgttccctatttctgtctttttagtgcccttccctgcttaattattttcaactttattatttctaaagtcagctcagtttcctccatagggtagaaagcatggtagtcaacagctctaacatcttacactcatcagcaaagagaaacaaattttctttcttagtgctcagtactgaacgtatcaggaaagcatgcttattggcttaaatttggtctcacatccaccactgaaacaattaataaaggagagagggatgaggacatgtaaagcaaaaaaagaaaaaaaaaagaaaagaaaaagtgatagcagaatgagaaagacaagttgtgctaacaaaacaaaagttatctgctatacaaaaagaattagatatatttcagaaattaagatctgagtataatgctgtgaagtagaattgcaggtaacctactaattaaacactgtcaagagttgacagcatcggccgggctcagtggctcaagcctgtaatcccagcactttgggaggccaaggtgggcgaatcatgaggtcaggagttcgagaccagcctggccaacatggtgaaatacaaaaaattagctgagtgtagtggaaggcgcctgtaatcccagctacttgagaggctgaggcaggagaatcacttgaacccgggaggcagaggttgcagtgggccaagatcgcaccactgcactccagcccaggtgacagagtgagacctcatctcaaaaaaaaaaaaaaaaagagttgacagcatcaaagatttgggtactttccaattttctgttctactatcctcagcatgttgtggactcaggatggctgcagcagctccaaggcatcaaggtctcacacagcatccacagaacagaaaagacagtgatgtttcagtgttattccacattcccattcctgaatcaattaatagcatgaggaataaaattgccatttgaggttagaataatctggattcatcccagactccatggagcacaaagacatataaaacatgatgtaactctaggttctgttagcaaaaatgattggctgagattggctgtggggtggaaagatgggggaatggagggacagagtcatggtaatttgaagattggtaaccacagtacatttgtcatgtatccaacatggcctcaaacagttttgtcaacttgaaaaccaaataattttgcagtaactttaatgagtggctctacagttgaaagcaacagaaaaacaatgaaagttgtgaagatgtggattgtatggacaatctgcaggcaatggcaccataggctgaggggaattatcatcagcaaacatatcttacttgttccaagaatatttcttgcagaaatattatgctatttttacacttcttaattgagtggcattagctgtgaattattttaaaaatcctgtttccctgccagaatcgccagtctttgggttgactctgtgagtttctgagcattccttcaataaatccttctcagcttaatttaaccacagtttgtttttatttctcttaaccaataatcctgactggggtgtttatcctctcccacaaaaaattaaaatctgcttcagtaattcagagttgtaattatattcaaatatcagttctgatgaaaagtagtaataggaactaaattctgctttagcaaggctaagaaatagtatatgtttcttcttctttatgtacatactaaaaaagtttcagaaaaatgttttcttgtcttcaaaaaagtagattatcattacaattctatattgaaaaaaaattcatatatatttgtaagcggtaaggtaaaattcctgttcttaaaacacatattctatcattaagatacccctgatcattgagaacatagagatattcacaaaatattaaagaaataaaaatgaaaggggaaataccagtggcgtgaatgtaataaatatcattcttatacttaatttcttatgagcatgctttagttgaatatttgacaattaaaatgatacatttgattattatcaattaaaatattgagtattaacaacaaataattaaatgtaattaaaacaatattcatagcaattaaaattgtcttcatttttcatttaaaccaagaccatcaaatttgcctttgttaaataatcctggacacagaggtaataacaaaataatgttacttttagtctctgtcatttaaaacccaaaatctataccaacttctccaaatatttatttccaagtgaaagtcctgctgtagaaaaaagaaagaatcaatactgatagtctttagcgctcaattcagctcttaccataccagtgagggaaaggatttaaagttaagctcactctagcaggttaaacatgatttgaaacatgctcatcaatgcagtcaatataatatagtatataactgaaggaagttttcagtaagtatttgtgatacatattattagattttaaaatacaattgctatgatggaataatttatctcaatatgataatttaatatatatttttctggatagcaatgaaagtatacaacataagttctatctgtttgcaaaaagagattatgagaacttaatgggctcttacgagagcaatacacttcattgcaattatatttatggatggtccagcagagatacggatctcaagataataccagactcttaaactgctaacaccatcaccttaaaaaaaaaaaaaagtagcacttccaatataggcttcagaataccctactgaacatacaaatttatgaaacatgattatacaacatttttaaactctttttaaagaacttatttgtcaagagcactgaggaaaggctatgtttgtgagctataagagacgcatcatcctgtatgattatcaaagtgccctctgcaaagctctctgccccaagggaattctgaatggagtagttactaaacagtgagaatatgagatttatacctgagataccaatattttttctttcatttcaacttttactttaggttcaggggatacatgcgtaggtttgttacaagggtaaattgtgggttgtgggggtttgatgaacaaattgtttcatcacacaggtaatgaaaatggtacccaataggtacttgtttaatcctcaccctccttctacctcccaccctcaagtaggccgtggtgtctattgttctcttctttgtatctgtgtgtactcaatatttagctcccacctaacagtgagaacatgtggtatttagttttccgttcctgcattaatgcacgtaggataatggtctccagttccacccatgttcttgcagaggacataattttgttcttttatatggctgtgtagtattccatggttaatacgtaccatatttttttatcccatccacctttgatgggcatttaggttgattctgtctttacaattgtgaatagtgttgtgactaacgtacacatgcatgagtctttatggtagaatggtttatattcctttgggtatatgtcaagtaatgggattcctgggttgaataacatccgagccaaaagccaaaagaagaatgaaatctcattcacggtagctgcattcacaaaataaaatatctagggatacagctatctaggaacgtgaaagatctctacagtgagaattacaaaacactgctgaaaaatatcagagatgacacaaacaaatggaaaaacattctgtgctcatggatagaaagtatcaatattgttaaaatggccatattgcccaaggcagtttacagattacctgctatacctatcaaatggagttagaaaaaaactattctaaaattcaaatggaaccaaataagagtcaaatagccaaagaaatcctaaggaaaaagaacaaactgagaggcattacactacccaacttcaacctatacagtgaagctacagtaaccaaaacagcatggtactggtacaaaacagagacgttgaccaatggagtggaatagagcgcccagaaacaatgctgcacacttaaaaccatttgatcttcaacaaagttaatgaaaacaagcagtgcagaaaggactccctttctgcaatcaatgatgctgcaataactggtgagccacatgcagaagattgaacttggccccttctctttcaccatatacacaaatcaactcaagataaattaaagacttaaacgtaaaacctaaaaatacaaaaactaggagaaaatctaggtaataccattctggacacaggccctagcaaagttttcattacaaagactgtaaaagcaattacaaacaaaacaaaaattaacaagtggaatctaattaacctaaagagcttccgcacactaaaatacattatctacatagcaaacaggcaactgacacaattggagaaaatatttacaaagtatacctctgacaaaggtctaatactcagaatacatgaggaacttaaattaacaaaaaacaatgaacactattaaaaaataggcaaaggacaggaacagacatttctcaaaagaagacatacatgtgaccaacaagcatatgcaaaaaatgctcaacatcagtaatcattacagaaatgcaaatcaaaaccacaacaagaccccatctctcaccattcagaatggccattattaaaatgtcaaaaaataacagatgctgttgggcctgcagagaaaagggaacacttatacactgctggtgggaatgtaaattaattcagccactgttgaaagtagtttgtagattttccgacatatattttaaaaaataggtgtttctgcccaccaggtgtacccagagccacatactcccaccctgaaatctgacctctgatctgttttacaaagttgactttgtactggcatcaaatccagattctttcatttgtcatcggttcaacttctcacttggataatattttgctctttattattgaactacttcatggtttaagatgtcttccacttttagcaaataatatgcatatttatatcagtattgtcaaatttaaaagacttttcaaaaatgctatgtttgattaatttccttaaataactcactaacctctctgggtctcagttttctcataataaatgaggggaccagactagtgaaaaatctcagtgccttcctcttctgaaagtattcttcaccagtgtattaatttgtctgttattatactacaatgcatcactgtggttgtgtatcatattgtatagcattgtgccttacatagtgcattgcactgccttttaccatgtcatgttacactgtaccaaatactatttcatttatagtgatatgttaactatgaagaagcacttttagaactggtggatgtgacagcaatcagcaaatgtgaaggaaaaagagaggagatccaggtgaattgttaatccaaacatctgcaaagggtttttgagggcaaaatgatcttttatattttacattgcctcttgtgtcatttgttttataaataattactaaattacttaaaatcattaatgggcaaagaataacgttatcaaattaatattgatagattattgatgcaacctctgctcacatttgtattggctgcttattcagttctgtgaaagtgctttaaatgttgttattatgtttaaagtttctcatccaaaaataaacacaaattcttagaatgaaaactatttccctttttaggtagctcatttaaaattttaactgcgtctttctaatgtttttacccacattgaaaccacaggagaaataattctggagagacaaagaatactgctacttcataactctgggtttgtgccaaaggcaatagaataattaggggtcagaagaccagtgttcaaatcccaacctgatcactgttatcttttgatctctggcaaagtaactaaacagtcttcccatctgtggaataggggcaataacagctaccatttgtaatagctatgattaatatatgagacagtatttgtgaaacagctatttcctacagcattaaaaatgtatattaaaaatgaatttactccttatgattagattagcgaattattttattaaattcagaatgagcaagcatttaaaaaatgattactatgtaactttattacttaactacaagccttaaaatacactaatgtttttctgttctaaataacatcaactacagcaattttaaaaattcttgacaagtataaaaaagataaaaattatctataatctcatgaccaaaagaaacccaattaatgttttcttttataaagattcaaacaataaatcaacatagatatggatatatagatgtagacattataagacagatttatataactggaatattatatgcatgaatataagtatatatacatgtgattttaatatatacatgcataaatgtaatattaatcggagttcattcacaattaatcagaacagctacagtgaacaaccaattcacataatttttgtgcacctttctggttattttcttccaacaaattccttagaataaaatcactgattcaaagggtttgagcaattttaagatcttaaagaagtttctgaaatcatgctagaaaactttttatcaattcacatttgcattacaatgtatgagattgtctttcacttgatcctcattaaaactggacattaccattgtttgttaatttgcttatttgacagacaaaaaaatcttatttatgtatttgatattttcatttatttgatgaatggaaagctagaaggtttttaagttttgtttttgttagtttggtttggttttggtacagttttaataattttatagtccacatgtttcccctgtgacttgtccttttgaggcatttgcttatttttttgagggggtaattttatctcccactaattaattaattaaatttataaagattgcacattttctctactttttaaattattttatattttaaatgcaatgtttaaaatgcaggttataaagcttttgctttatcctttatttcattacatttttgccataaatagccttatttatcataagatcagattaaaaaaatgcatatgcctattctgttttagttcttctaaggtttcctcttacacatttattcatttaatcccagatatagtttggatgtgtgtcccctcaaaatcttaacattaaaatgtgacctctaatattggaggtgggtttagtgggaggtgtttaggtcatggggatggatccctcataaatggcttggtaccctcctcactgtaatgagttaccatgatatctggttgttaaaaagagtctaggaccaccccattctctctttttctccctctcttgctatgtgacacagctgttccccctttactttctgccatgagtaaaagcttcctgaggcctcaccagaagctgagcatatggtagtgccatacttgtacagcctgcagaactgtgatccaaataaccctctttttcttataaattaccaggcctcaggtattcctttataacaacacaaaatagattaatgctaaaaattggtaccaggagtggagtgttgctgtaaatataccagagaatgtggaagtgacttttgaactaggtaatgggcagagatgggaagagtttggagggaaccaaagaagaaagaaaaatgaagaaaagtttggaacctcctagagaccgcttaagtggttgttaccaaattactgatagaaatgtggacagtgaaaattaggttaatgaggtctcagatggaaatgaggaacttattgggaactagagcaaaggttacccttgttatgtcctatcaaagaacttagccatattgtgtccatgccataggggtttgtggaaggttgaacttaagagtgatgacctgggctgggcatggtggctcacgcctgtaattccaacactttgggaggccgaggtgggcagatcacctgaggttgggagttcgagaccagcctgaccaacatggaaaaactccatctgtactaaaaatacaaaattagttgggcatggtggcgcatgcctgcaatcgcagctactcaggaggctgaggcaggagaattgcttgaacctgggaggcagaggttgcaatgagccaagatcacgccattgcactctagcctgggcaactaagtgaaactccatctcaaaaaaaaaagacaaagaaaaaaagagtgatgacctaaggtatatggtggaagaaatttctaagcagaaaattacacaagatggggcttggctgagtctaacagcctttaattagatattgtagcaaagaaatgacttacagttggaactcgtgattataaggaaagaaaagtgtaaacatttagaaaatctgcagcttagccttgtggtagagaaggactcaggtgtatgagtccattttcacactgctatgaagaaacacccaagactggtaatttataaagaaaaagaagtttaatggattcacaatttcacgtggctggggaggcctcacaatcatggtggaaggcgaaggaggagcaaaagcacgtcttacatggcagcagccaagagagcatgagcatgagcatgtgcatgggaactgccctttttaaaatcatcagatcttgtgagacttatttactatcacgagaacagcacgggaaaaatctgccccgatgattcaattacctcctaccaggttcctcccatgacacatggggattatgggagtcacaattcaagatgagataaatccaggaaggctacagagcaaacatttgatagagacgttgtcatgactaaaagatagccaggtgctaataaccaagacagtggtaaataggcctggaaggaatttcagaaatctctaaggcagcccctcacatcacaggtccagatgcctaggagaaaagaattgtttcaggggccaggctcatggtgccactgccctaccccgctttcaggggctactctccacatcctagctgttccagctccagctgaagctcaaaatgccccaagtacagctcagctggcaccttggagagcactagctgctgtaagccctggtggcttccatgtggtgttaagtctgcaggttgcagtgagccaagatcacgccattgcactctagcctgggcaactaagtgaaactccatctcaaaaaaaaaaaagacaaagaaaaaaagagtgatgacctaaggtatatggtggaagaaatttctaagcagaaaattacacaagatggggcttggctgagtctaacagcctttgattagatattgtagcaaagaaatgacttacagttggaactcgtaattataaggaaagaaaagtgtaaaaatttagaaaatctgcagcttagccttgtggtagaggaggaaaaagcattttcaggtgtatgagtccattttcacactgctatgaagatgccaaggaggcttggcatctttacttagatttcacaggatttatgggaaagcctgggtgaccaggcagaagcttgagacacgagtggaggccctgtagggcagtgccaaggggaaatacatggttggagtccccacacaaagtccccactagggcattgccttgtgtagctgtgggaacaaggccaccatcctctagactctaaaatagtagagccatcagcagcatgcactctcagcctgcaaaagctgcaagtaccagagcccaatcatcacactggcgttttccaggatgtgggacacggagtcaaggattactttggagctttaaggtttaatttctagcctgctaggtttaggactcacctaaaccttattgttcctttcttttgtcagatttctcctttttgaaatgggaatatttactcaatgcctgtgtcaccgttgtatcttggtagtaaataactactctatgaacttacaatctcataggtcaaaggaacttgccttgagtctcagaggaggctttggacatagaagctacccaaacagcaatacttttccacatacttaaatatttttatatttttttaaaggtttgcaattttctttaaaaatgttccttcagtttgtgggtgaagttattgcttggtattattctatatatttttgttattatgaatggaacattttcatgtatctcctgctgttttctgctattccaaaataagtaattaaaaaatttctctctatttagtttctctcaatatcttgtcttttaaattaagttgactcttattatagtcagtcctatcttagaagctttattaacagcaaataactacctaaattatttcttcatatgctttctcttcttaagaagcttttcattaaatgaactttattgtatatgttattaaaatatgttttcaaattatcacactataacaaattatgtcatatggctatttcaggcctattacattcagactgccccaatagctccctttaaaacaacacagaaggttactggccgggtgcagtggctcacgcctgtaatcccagcaccttgggaggccgaggcaggcgtatcatgaggtcaggagatccagaccatcctggctaacatggtgaaacccagtctctactaaaaatacaaaaaattagccaggtgtggtggtgggtacctgtagtcccagctactcgggaggctgaggcaggagaatggcgtgaacttgggaaggcagagcttgcagtgagccgagatcgcgccactgcactccagcctgggcaacagagccagactccatctcaaataataataataaatgaaacaacatagaagtttaccaactggtatatgtttattcgtattaatggaatatattgtatgacttaaattgaagttttgaaaattaagactatgtagatttattttctctgaaaatattacctgtgatacaggcacaaacttttcttccaatggaccctttaaaaacctccttataatgacaaagtactcaaaagtaaccagtcagaaaagtttgcaactatcagattgttaaagtactttgtataaaattagctagatttaaacaaaaaatatgaattatttttttaaaaaatcaaaagttaaacatgcccttaaccttactaaatttgttattcttcattgagatttcagttcctggacccctctgtactctcttcacatgccatgggctctgctatgttttatttttcttttctttcataattcaccttagacccagtggttaaccactttaatgctgttttctcttaagcaaccttgattctttcggtttaatatccttttactagacatattctgttaatatccatatattaatgaatccacacattgtgtttttcctgctctgggttgctatatggtgctgagaagctctttaattatacctattagctctgacatacgtttggacatctcagcctcttctgggctgtaataactgtttgacagtcttttaacttgtacctaatcagttttcctttgcattttcttgattgcaaattcagatatttatcactattctcaacacccccaccttcatcatcacagaaaatgaaggctatcaatcatgctttcacacatctttcttttcttccatatctaaaaataatttaaattgctactcaaacttcttatatgtagtcagagtttgagatgaatactctactcttcacagtagtctttatctattaatggttggatctttccctttatatctacttcttgttatgataaataagctcctttatttcctagattatcaattgttaattcccttcaaaatacttcatattaactttgaaacatgaagttacattttaaaaaatatgcagaaagtcttataacttttcccattgaaagattacatctatgttccacacccttgatcacaggctgtgtggctacttgaataatagaatttgacagaaaggaacttgtatccgttttcatgttcagtcttaagaagcttatagtttccacttcttgtcacataggatgttctttcttgaactgtgctataaggaaggccaggcacatggagacatccatataaagatgaactgagatatcccagcccagttttggttcaattaccaaccaacagccagcatcaacttgccgttcatgtaactgagccatcttggaagtggatccccctgcctttagttatacttcctcagtggacagtacatagagcagaaatgagctttcacatcaagaactttttaaattgttgttttcagtccctaaagattgaggtggattgtaatgtagcaatagaccatcacaatacttgcttaaatgtctcccatatttgagaagataagcttgatgagatcaaaaagaaatagtttagtcttctttttcttgatattcaagttctagaagagttgtataataataataatatattatataaagtataataataatatattatactttttgctccctgaacccattgtcttttctgacaataccaccacattgaaattagagacttggtcatgttcactggtcatatagagtatataccaaactctttataaagcatgagagaacctatattatatcatttcactccaactctctagcactcatttttcacaccatatatatactgttttctcttacacatacacgcctattgtattagtctgttctcacgctgctaataaagatatagctgagactgggtaatttataaaggaaagaggtttaattgactcacagtttagcatggctggggtggcctcaggaaacttataatcacggcagaaggggaagcaagtacctccttcttcacatggcagcaggagagagaagaatgagaacttagtgaaggaggaagacccttataaaaccatcagatctcatgagaacttactcaactatcataagaatagcatgggggaaaacatcccccatgattcagttacctcccactgggcccctcccacaacatgtggggattatgggaactactattcaagatgagatttgggtgggggcaaagccaaaccatatcacctatcatattgtttaatttataaattaggcacagtaagattaataataactggtaataaaattgaataattataacaatatactataataaaagttacatgaatgaggtctctgtctctctccctctcaaaatatcttattgtactgtactcagctatttttctacctctcttgctcacaggtaactgaaactacagaaagtgaaacttcagacaaaaggggtctactgcaattatacttctttttgcttagactgttagaaatctcaagacaaacttgaagatcataacactgtggacttctgtatttggtgcatgtttcaggtacctatggctgcaaaacaaaccaccccaaaatttaatggcataatcattattttctaatattctgtgacttaacggggctcatctgttgtcttttaggatctctcatgcagatacagttagaaggaggctggactagagtcatctgaaaattcaattggactaaatttcaaagataatgtattagtccattttctgttgttataactgaatgccatagacttggtaatttgtaaagaaaaaaggtttatttagcacatggttctagaacccagtaagtcatagagtgtggttcatttggtgaggatcttcttgttgtggcatgacttggtggagagtattagatgtgacaaggcaagaacatgtgtgtcagctcagatctttctcttcttatgacaccaacatttttatcatgaaggccccactctaataaccttatctaattcttattacctcccaaaggttacacctccaataaacatatgaatttgaggattaaattttcaacccttgtgctttgaggaacattcaaagaatggcatatggcttcttcatcgacatgcctggcaacatagctggaatgactaaccccactttgggcaggccagacccaatctagctctctttctctcccacccacacctgcagcctctgtgcatggcttcctcacaacataatggtcatcaggtagtggaactttttaatgactgcttgattcatctagggccagtattctaagggagccaggaggaagccacgaggtgtttctgacatagccacacaacttagacagcttcactttcactgcattttattgattaaaagcaagtctttagttcaaccctgattcaaggagaggaactacaaaaaaacatgaataccaagaagtgtgatttttttgtggatcatttttatagactagctactacagtatacttagattttttttcttagagtaggttttctgctttattattttataatatgttttttaattaaaggtgatttttactgttttatggagaagccaagtaatattaaatgataaactaatggtacagatgtaataataacactatatacacaggatgttatgagaattgcttgagttaataaatatgtgaatagtttgtaaataagatcatactagtgtaaaggtatatttaaaaatagtgtgtcatgggagttcctgattttgttaaaattgtaagaatttttgcttcagaccaatggtcttaatatcagccaagttattcacagagtgtttaatgagataatacaaacagcctttagtaaattgggcagaagcaaagagaattatgtcttagtaaaatttctggaaattttctacatagttctataaaaatctcagagaacttctaacaacttgtgggacaatggaattaagagataaaattaaaaatataatctttatttctcaatgtaagctccatcaagttcgagacacttttgtaagtggtattaccaaccatttagtccattcctaaagaactgagagtcattggactttgaccacatcaaagcagtctttttttacattattaactaaacagaaatgagtgccctttaaagattttttaaaattaggaaacaaaaagaagtcaaagggagccaaagcaggacttgcttactgatttcccattaaaaccctcaccaaagtgcccttttttctttttccttttcttttcttttcttcctttcctttcttttcctttcccgtcctttcctctccttttcctttctctttccttctttcttttctttttctttctcccttccttccgtcttttcttttctttttctttcttccttccttcctttctttgtcttttttttgacagtctcgctctgtcaaccaggctagagtgcagtgacgtgatctcagctcactgcagcctctgcctcctgggttcaagggattcttgtgcatcagcctgtagctgggactacaggagtgcaacaccatgcccggctaatttttgtatttttaatagagacgggtttcgccatgttggccaggctggtcttgaactcccggcctcaagtgatccacctgcattggcctcccaaagtgttgggattgcaggtgtgagccaccacgcctggaccctccttttttttttttttttttaaatgagaggaatgcacaggagcattgtcatggtggaaaaggactcttgtgaagctgtctcagacatttatctgctagagctttgactaactttctcaatcacgctaataataagcatatgttattgttctttgacctaccagaaagtaaaaaggcaaaatgccttaaacttcccccaaaactgttgcattttctttgctcttgaccagtcaattttttgctttgactggaccacttacacctgttggcagccattgctttagttgtgctttgtcttctgggtcatactggtaaagctacatttcatgtcctgctacaattcttcaaataactgttttgaaattttcatcacacttgtggaaagtttgctcaactttaattttttggtcagaattgtataagatgaaccaattgagatatctatggtattggctactgcttgtgctgttaattattggtcctcttcaattcagactcaagtaaggttaatttttttttcacaaatttatgtgaacagtctgctgttgcaggtttcatcttcaacatcatcttgtactttcttgaaacaagttacccgtttgtaaactgctgatgacttaaggacgttgtttccataaaatttttataaagcatcaatgatttccacgcaaatcaatgggtggaagaagcttgagtattcttccacccatgcttcactacaaatttgattgttcttgcttcaattatggccgaattcatgttgttctgacaagggctccttttagactgatggcgtatccttcttagtgcctcagactaacttctcttcagacatatcataacaagttagtatgagtttatttgggtgtaaaaattttgaaatgtatgcatggttttttcataatacacattttctctgaactttttgaagatctctcatataatcacttgaaactatatattaacattttatgtctatttctatctctatttcatagaaatgtctcctaattaatacaacaaaacataaattaggatttcattggtacattcataatttgatgaagactgtgagtggactgagtaatttctagggtttcttgtatgattatgactcatttgctttttgacccatagtgtagtaagggctttactttggtgtcattttgatcttttttctttttaattactcaagttatttctgttggcagaaacccttccctctaccaaagggccttttattctacttgactttggactatccaactctgctgtatttggcaaaactgcaggccaaccctcacagaaattgtgccctctttggcgtctatacacctaaatatgccatttaatctaatcataatgttattgccactttgcagtgccaaatcatctgcctcaacgattagaaactttctcaaggtcggctgggtgtggtggctcatgcctgtaatcttagcattttgggaggccgaggtgagcggattgcctgagctcaggagttcaagaccagcctgggcaaaatggtgaaaccccacctctactaaaatacaaaaaagttacctgggcgtggcggcatgcacctgtaatcccagttacttgggaggctgaggcagaagaattgcttaaacccgggaggtggaggttgcagtgagccgagattgtgccattgcactccagcctgggtgacagagcgagattctgtccccccccaaaaaaaaaagaaaagaaaaaacttccttaaagtcaatgattctaattatacaataagacctctttctctagcctttttacaagtctaaacacaagaccacttaataggaacagccttaatttatctataaatgttttctacatattttttattttctttggttcatttttcttccttacaaaatcaagcaactgacttcaggaattttgccttttatttcccttaaatctcctctctgcatccatctaagtgttgagcattcagtagatagccaacaaatgtgttgatgaaagtcagcagaagaccctgatagactataactttctttgcttcacttattgcagttaacaaaaagagatattgtgaaggtaatttaccattagaagagtgttttgaaatccttgaacagagaatattctccaaaaattgcataaaatactgctgcaattacaatgatttctggataccactctactacaaatctgtcacccaggaacaaaaatgctgtgcaaggccaacatgtcacctattccaccatacatgaaatagtggagttggctgtaatacctggaaactagaaaagttaatttaaagaaaatttcagctaaggtaaaactctttgaaaaaaatggaaggatgctccacaaagtgttccagcctggaatctggaatgactattttctttttttcaaatacatcttgtgaaattagaatgattctccctgtggactgtgtactgtaaatcaagttttaataagtggacactttatgaaagacattttgaactcatagctaggaaaacattctactgatctaatgacaagaatataattagaagataagatttcaatataaaatgatcataactaaaaattgaatgaatgatgcaattgaaacattacaataaaaagcccccaggtcttgaaagatttaatgaaaatacactggataattagcattatggtttaataatcaatataaagcttggcaattcttgggaaaactactgacttccattatttaaaacaatacttaatattttataatgaaaaatgcttacataatgcttttgaatcactcttattatcaaattgctggggtttttttctctctggaatctttaatcacttttactcttcgtcagacaaacctcttttcatttttcaaatctcagtctaattgtctctttttcaaattgatctattctgaacccttcaatattagctattttcccactgatattctctccaattgcatatttttatattaatttaaaaggtatactattccttgtatttgtagatttattttggatttttctttaatgactgtctccttcactaaaccataacatccttgaaagtagggtattggtctcttctttgacattctacacctgacatctaacacaatgtcttactctcaatacatgcttgttaaatgatcaaaagaattaaaaagtcataatgctgcatcaagccaccagtgcactaattcattttgatagtttaaaatgtataatataaaccctatttccaatttacaaaggattaaagggtgactaagatactctcaattgattggtagcagttagatgggcagcctgttttactttctcttctcattatttttattttttcaataattcttagctttatagatttagggggaagttttgttactttttaaaaataatttcaacttttattttagattaatggggtatatgtgcaggtttgttaaatgggtgtattgcatgatgctgaggtttaagagaacaagttatccattcacacaggtaatgagcctagtatcaaataactagtttttcaactcttgcccccttcactccttccccactctggtagtccacagagtccattgttgccatctttatgtctatgattactcagtgtttagcacccccttataagtgagaacattgtggtatttggttttctcttcctgtgtaaatttgcttaagataatggcctctcactgcatccatgtttctgcaaaggacattactttgttctttttaaggctacatagtattccatggtgtatatttaccacatattctttatccaatccaccagtgctgggcacctaggttgatccatgtctgctattgcgaatagtgatgtaatgagcatataagtgcaactgtctttttagtagcataacttattttctttcaaatatatacccagtgatgggattgctgggtcaaataatagtttttttaaaggtctttgagaactctccaaactgctttccacagtggctgaagtaatttacattcccacaaacagtgtataagcatttccttttctccacagccttgacagcacctgacattttctgactttttaataataggtattctgactggtgtgagatggtatctcattgtggatttgatatacacttctctgatgattagtgatgtggaaccttttttaaatgtggtttttggttgtttgtatgtacgtgaatataccatttcatggtgaattctgggcttttagtataatcatcaaccaaatagtgtaccttgtaacaaatgtaccaaaatacccaaaagaagggaaatcagtatattgaagagatatctgctctcctatgtttgttgaagctgagattttgaagcaacctaagtgttcatcaacagataaatggataaagaaaaagtggtacatatacacaatggagcactagtcagccatcaaaaacaatgagatccagtcatttgcaacaacatgtatgaaactagacatcattatgctaagtgagataagccaggcacagaaagacaaacattacatgttcttacttatttgtgggatctaaaattcaaaacaattgaactcatggacacagaaaatagaatagttaccagaggctgggaagggtagtgaggggtagggatgtttaaagggtacaaaaagtagttagaaagaatgaataagacctatatttgatagcacaacagggtgactacagtcaataataacttaattttaccctttaagatagcttaaagaatgtaatttgattgtatataacttaaaggagttaaatggttgatggggtggatacccctcttctctttgatgtgcttatttcatattacatgccagtctcaaaacatctcatgttctcgtaaatatatacatctactctatacccacaaaattttttttaaaaacagatcagcatggcccctgaacaaggatgacaggcaaattcatgaagtgtttcatatttttagctgctcttgccatggtggaaaaaaaatgataactatgtgggaatatgaatatgtcatcttgttttataatagtaccaatttttctatatctatgtatcacaaaacatctggttgtgtatgttaaacatacataacaagatttattttaaaaaagaaacatataaatactggggaaaaaactattattcatatttttaaaaagctgtgacatggacttaaggagtcataaaatgtcaatgaaggcattaagaggtttctgaaacctaataacttaattatttgcatagaattaggaatgaagaaccctcttgggaagcatactttataatgctcctcttcagtctttcttacttttgactatttattagggtatatgtgttgttacagtgactgaattagatgagatttttaggttttgagggagcatttagaagaaaaaagtattgacttctgacttcggagttacgtttcctgagtttgatttgatgcttagctatttaccagctgtgtaacactggccaaacttcctaatctctctgtgccttagttttcccatatttaaaatgagatgagattttaaacatgtgtcagcccctctcattacaggcctggaagcctaggaggaaaaacttgtttgatgggaagggcacagcgaccccctgctgtgtgcagcctatggacttggtgctctgcatcatgaccactccagctgtggttgaaagaggccaaggtatagctcaggccatggcttcagacggtgcaaaccccaagccttggcagcttccacatggtgtcgagcctgcaggtgcatagaattcaagaattgaggttttggaacctatgcctagatttcagagaatgtatggaaacacctggctgtccaggcagaagatttctgcaggggcagagcaatcatgcagatcctctgctagggcagtgcagaagagaaatgtggtattggatcccacacacagagccccactggggcactgcctagtggagctgggagaagggggccactgtcttccagaccccagaatggtagatccactgagagctctcaccatgcacctggaaaagccgcagacactcaacaccagcccgtgaaaactgctgggagggaggctgtaccctccaaagccacaggggtggagctgcccaaggttgtgggagcccacctcttgcatcagtgtgccctggatgtaagacatgaagttaaaggagatcattttgggactttaaagtttaatgattgtcctattggacctattggattttggacttgaatggggcctgtagccccttagttttggccgatttcttccatttggaatgtgtgtgtttgcccaatgcctgtatctccattgtatctggatagtaactaactttcctttgattttgcaggctcataggcattgtctcaaatgagatcttggacttagacttctgtgatagtgctgaaatgagttaagatttcgggagactgttggaagggcatgattgtgtactgaattgtgagaacatgagatttgggagtggcaaggggtggaataatatggtttggctatgtccctacccaaatctcatcttgaattgtagttcccataattcccacacgtcatgggagggactaggtagagataagtgaatcatggaggcagtttcccccatcctgttgttgtaatagtgagttatttctcacgagatctgatggttttataaggggttttccccttcactgggcactcattcttctccttcctgccaccctgtgaagaaggatgtatttgcttccccttctgccatcattttaagtttcctgaggcctcctcagccatgctgaactgtgagtcagttaaacctctttcctttataaattacctagtctcaggtatgtctttattagtagtgtgagaacagactaatacatacattaaaactgaaagatatagaatctttgaacagactgataacaagcagtgatattgaaatggtaataaagaaattgccaacaaagaaaagcccaggaccagatggattcacagctgaattcaatcatacattaagaagaattggtaccaattctattgacactatccaaaagatagagaaagaaggaatcctcactaaatcattttatgaagcagtatcaccctaataccaaaactagagaaggacataataaaaaaagaaaactacagaccaatatccctgatgaacacagatgcaaaaatcctcaacaaaatactagtgaaccaaatctaacagcatatcaaaaagataatccaccatgaccaagtgggtttttcaccagtgatgcaggggtggtttaacatatgtaagtcaataaatgtgatacaccaaataaatggaattaaaaacaaaaatcacatgatcatctcaatagatgcataaaaagcatttgacaaattcctacatccctttatgattaaaaccctcagaaaaatcggcgtggaaaggacataccctaaggtaataaaggccatctacaacaaactcacagccaacattatactgaatggggaaaagttgaaagcatttttcctgagaactgaaaaaagacaaggatgcccactttcaccacttctactcaacatagttctggaagttctagccagagcaatcagacaagagaaagaaataaagggcatccaaattggtaaagaggaagtcaaactgtcactgtttgctgataatatgattgtataccttgaaaactctaaagactcatccaaagagctcctagaactggtaaatgaattcagcaatgtttcaggttacaaaattgatgtacacaaatcagtatttctgctatacaccaacagtgaccaagctgagaatcaaattaagaactcaacttctttcacaaaggaatatacctaaccaaggatgtaaaagacctctacaaggaaagctacaaaacactgctgaaagaaatcacagatgacacaaagaaatggaaacacatcccatgctcatggatgcgtagaatcaatattgtaaaaatgaccatactgttaaaagaaatccacaaattcaatgcaattctcattaaaataccaccagcattcttcacagaactagaaaaaaatcaatcctaaaattcacatggaaccaataaagagcctgcatagccaaagcaagattaagcaaaaagaacaaatctggaggcatcacactacccaacttcaaactatattataaggccacagtcaccaaaacagtatggtatactggtattaaaataggtacatagaccaaagaaacagaatagagtgcccagaaataaagccaaatacttacagccaactgatcttcaataaagcaaacaaaaacataaagtggggaaaggacaccttattcaacaaatggttctgggatcattggcaagccacatgtaaatgaatgaaactggatcttcacctctcaccttatacaaaaatgaactcaagatggatcaaagacttaaatttaagacctgaaacaacaaagattctagaggataaaatcagaaaaagccttctagacattggcttaggcaaagacttcatgaccaaaaactcaaaagcaaatgcaactaaaacaaagacaaatagatgggacttaattaagcttaaaagcttccgcacagcaaaggaaataattagcacagttaacaaacaactaacagagtggtagaaaatcttcacaatctatacatctgacaaaggactaatatccagaatctacaaagaactcaaatgaacaggcaagaaaaaaaaaaaatctcatcaaaaagtgggctaaggacatgaatagacagttctcaaaagaagatatacaaatggccaagaagcatatggaaaaatgttcaacatcactaattattagggaagtgtacatcaaaaccacaatgtgataccaactcactcctgcaagaatattcataatcaagaaatcaaaaaataatagatattggtgtggatgcagtcaaaagagcatacttttacactgttgatgggaatctaaactagtacaaccactatggaaaacagtgtggaaattccttgatgaactaaaagtagatctactgtttgatccagcaatcccactactaggtgtctagccagagaaaaagaagtcgttatacaaaaaagatacttgcacacacatgtttatagcagcacaatttgcaactgcaaaaccagcccaaatgcccatcaatcaacaaatggataaagaaaatgtggtgtatatatattatatatatataatatatatatataaaatatatataaaatatatataatatatattatattatatattaaatatattgtatatataaatatatataatataatatatataatataatagatttatataattatataattttatataattataattatatataattataatatataattatataaaattatataattaaaaatatataacatatattatattatatatatttatataattatatattaatatatatattatatatattaatatatatataaaatggaatactactcagccacgaaaaggaacaagataatggcacttgtgacaacctggatggaattggagactactatcctaagtgaagtaactcaggaatggaaaaccaaacattgcatcttctcactcatatgtgggagctaagctatgaggacacaaaggcataagaaagatacattcaactttagggactcaggggaaaaggtggaggggtggcaagggataaaacactacagattgggcacaatatattctgctcaggtgatgggtgcaccaaaatctcagaaatcaccactaaagaacttattcatgtaaccaaacaccacctgtttcccaaaagcctattgaaataaaaaataaaataaaattcttgttttaaaaaaaacaatgccaatcttctcatctttggaggaagtttgaaaatgtatttatctttcattaaaatgtttatattaaaatgtaataaatttgtaattgttttaaataaatgaataaatatttttttaaaagaattaaatgagttattatttgtaaaacatttagaataatgcttggcatacagttagtgctgcctaagtgtatattaaataaaaattaaatatcagaaaaaaaagtataaacattttcttctagtaatataacttaggatgggccagagtttaattttatgatgctggatggcattatgagatcaataaggcatcctaagatttagtgtgcctaatgttctttgtcttttattgtgtatcatagaacattaaaggatgatggctgtagaaaaaccaagaaggagattgaggaaatgatttggtctgatttaaaatgtatactcttagataatatttttagagagaaaataaattttattcttatgctttcaagttatcacaaagcataaattaatggaacaaaaattaatggagtttagccgagatgttttaagctagcaagatctgacacgttaaattgaggttacacataaaattaaaatacacagaactcatttgggaaacaattcattctattttatgcttccaaaatcctctttagcacatcaaagaagactttgccacttattagctgtgtgattttgggagaatcactcagattacctaaagcttttttcttgtcagtaaaatggagtggacaagtattccaaagcttatctcccaaaccccgtgtcatcccacattcttcagagggcaatcataaatataagagttttttaaacaatagagatatatagataaaactgagtgtatatcttgaattgagtctccctgatagcagatcatgagacaattatttgggaagaggagatttattgacaggttatctacagaaacataaacaaaggagaaaggagtataatagtgaaaaagaggaaaaccaataaggagctgatttttcctgtagacagataggctcagtctccctgtaaaccctatgagtgacaatgtagagtgaactaaagaattggcttcccccatgggataggtggctggcactttttaatacagacccccatcccccaccagttaaagtttttctttgatgacattaaaacccctgatcggacctgaaagaaggcagaaagaaggcttaaggcagaaaagcaaaagaggccaatttgcttttgccttggcaccctaagagtgtgcaggttactgtccaatattgctataggtgagatcagaagtaaaccataaagtaaagaaatatatatattacatatttcatatataatatatatattatatattatatattatatattattttatatattataatatacaatatatataatatatataaatatataatatataatataatatatattatatataaaatatatataatataatatatattatatataaaatatatataatatatataaatatcataaataaaatatatataatatataatatatattatatataatatataatatatataatatataatatataatatatataatatataatatataatatatataatatataatatataatatataatatataatatataatatatataatatataatatataatatataatatatataatatataatatatataatatatataatatataaaatatataattacatataattatatatattttatatataatatatataatatataattacatataattatatatattttatatataatatatataatatcagagaaactctgaggtttaatttattttaaatgtgctacttcaaggaaaatacaggataaaaaaatcaaagagtatctaaggggtatatatatctttgtgtgtgtatgtatgtatatctatatatgtatatatacacaaacatatgtatatctacatatatagatatacacatatctatacatatatataaacacaaacacacacacagttattgagagtgccttattttcatttcaccaaatgaaaagagaacaatagaggattatatctcatcggaatttaaaatagactttttatatattctgaaggtagcagaattgtaattacttgcattttaaattaattgatattgatttttattagttcacagtctaatatggatcgaagtggaaagaaaacgtggaaattcaaatatccttctgaagctgactatgctaaatatcatgcaaacagaggaaagctaggtatctcggttcattttctgtcgctatgacagaatatgtgagactgagtagtttataaaggacacagacttatttctcacagttctgaaggctgaggagtccaagaacatggcactggcatctggtgaaaacctccttgctgtgttatccagtggtggaaggtgagagggtaagccagggcatgcaaagaaggagaaaacatgaggggctgcacttgctttataacaacccactctcacagcaactaacccatttcctcaataacttcattaattcattaatgagaatggggaccttatgacctaattacttcttaaaggccctacctcatgagttttggcaggggcattcatgttatagcaataagtgtttgatatatatacatatatgttatatatatgatatatatacatatatgttatatatataatatatatagttatatataacatatattataatatataataatatataatatatattattatataattatataatatatattatatataattatatatattatatattatttatatataataatatatattatattatatattttacatatattataatatatattatattatagattttatatatattataatatatattatatagttatataatatatataatttatatataatatatataaatatataatatataatttatacataaaatttatatatatataaattatatatatataatttatatgtattatattatatattatatatattataatatataatatatatattatatataaatatgatatgatataaaaatgaaccgagatacctagctttcctctgtttgcatgatatttagcatagtcagcttcagaaggatatttgaatttccacgttttctttccacttcgatccatattagactgtgaactaataaaaagcaatatcaattaatttaaaatgcaagtaattacaattctgttaccttcagaatatataaaaagtctattttaaattccgatgagatataatcctctattgttctgttttcatttggtgaaatgaaaatatctaagtcactctcaataactgtgtgtgtgtttgtttgtatatatatgtatagatatgtgtatatctatatatgtatatatacatgtttgtgtatatatacatatatagatatacatacatacacacacacaaagatatatataccccttagatactctttgatttttttatcctttattttccttgaagtagcacatttaaaataaatgaaacctcagagtttctcttatacattggctgaaatccccagctaacaacttcattactttaaataaataagtacctgcagacctttaggaagaagaaatattttctttcctttaatattttcatagggcaatactctattaaaaacgcataattattattcaaaagttatgaaagacaagtaaattgtggatataattaaaagttcaaaaattactaaataaaatgcagtttaaattattaatggatctttaagttaaagtagggatactactttatgtttttattgaagacaagagatgcctggatgatgcttaaaatatatgtctttttgggctaatgtcaatattcatattatacatttcaagttattgcagatgtgtgaaacactttgggaccaaaattctaaatttctacctggaaatcaaatattaatttatttggagcaacaaatgtcacattttatttttatttttatttttatttttttagagacggagtctcgttctgtcgcccaggctggagtgcagtggcacggtcttggctcactacaacctccgcctcctgggttcatgcgattctcctgcctcagcttcctgagtagctgggattacaggcgcacaccaccacagccggctaattttttgtgtatttttagtagagacagggttccactatgttggccagattggtctcaaactcctgacctcgtgatccgcccacctcagcctcccaaagtgctgggattacaggtgtgagccaccgcgcctggcccaaatgtcacattttaaaagtgtctttaggacatataattgagatcacagtgttaactgcatccagccactatttttttctttgaataattatcaaatatttaataaaggtttatcatcaaaatacagctaaaggtaaacctttatcttttttatacctacatcacttctaagacttaagcgaaatttgtaaacattataaagtttaaatttattactatgaattctaatcattttattaatattaagcatataagcatgagtgaaaaggtaaatcaaaaccattaaagtattattatcatggatgatgtggcaggtagaatatttccctgaagatgtacgtgacctaatctccaacacctgtgaatacattaccttaaatgacaaaggacttttcagatgtaattaagttaaggatcttgagatgaagaggctattcttgattatttagttaaatccaaagtaatcacaaagatcttaataaaagaaagaagagtcagaattagagaaggagatgtgatgattaaagtagaggttggaatgaggatgccaatgccaaggagtgcaggtgatctctagcaggtgtgacaggcaaataatcgattctctcctagagcctccagaaaaaatgatagccctgatgacaaactgatctcaatcctgtaagacccattttgaattctgacctccaaaacggtaagataatacatttctgttggttttgaggtataaaatttgttgtaatttgttagagctgcagtaggaaaataatacaggtatgtataatttaaacttcccatattataatagcatgcttttatatttctaaagatgtcttgcatagcttaaatcagacacctaactaaatacaaaatgtataatcgttataattcaagttagcaatcacatgactccaagaaacagagactcactcaagatagttaaaataagtagggaatttagtttactttgttgtaaaaggagaaccttatagggcccaatatttagaagtagagcttaacctgcagaaactagaagagcaggcagatagtgtcttattcttttattccctgacttttgttcttgctctctcttcccagccttcatcaatcttaatataaaaatggatcctaagctggaaaaatatttttaaaaaatcaatgttgcaaagtgtaccaagactatattattactggcctgccaagaataagacagcagtaccacaaacattttagtatggaatctaaacatcaaaacagtgcagaaactttactttctcataatacaagccattctaattagatgattctgtcaaaatgtcttcttcagtggtagatggacatacaactattttctaagacagagttaaaggaatcatttggtagcttacagaaagccaaacctctacttctgtctctaaaacaggaacatccctgctctgcagatatggagtaatcataaagtaactcaataattattcttctagtacactggtataatgactataattttttccttccttcctcaaatcacctcaaaaacatttcgttttctccgtatctcatgcagtggtcctaagatcagggctgcaactacaagtggtggaagaagggatggtttctaagcaagaaactaactatttttaaaacttatgtcagaatttctaggggcctgatgagagtggattgtgcctttaccccatccgtcaaaattagggctaacagtgaatacaactatatcgtctggtggcagaaacagcctactagttctgtgcctatgtaaccttatcctaactgagtgtgagtggactgagaggaaggcacttgctggactagtattgctatcagcaatctggtccagcacagtggctgagcctaatgtcccttccaaatgtggaaaagtgtgaataaaaataaatgacaaatggatgaaaagagaatagctgagggtaaagaaatgaatcaatgggtaacaaattgaggaaaatctaatattaacaacttgacagagtctcagagcaagagatgacgttgtctcttagctcaattattccagatgcttgaatggatgaagctatagatctgccaaaatgactcttgcttttggaacctgacaaaattgaaagaaagtctacaaacgtgagtggtctcactctgggagacagccatacaacatgatggactgaactaattgttaatgactgtgtatatttatttattgatgtaaaggatccatggtagaaaaccaggggttggcctgtggtgttattacacacactatatatatatatatatatatatagtatgtgtgtgtgtgtgtatatatatgtatgtatatatatgcacacaataacaggagatacatgtatatacacactatatattttacaatatataaatgtacgtgtatattatatatattgtatacacacacatatatataatatatataccataacctatatataggtttccatccagggtttctggcttatgacacccatagcccttgttacagttttgtgttataatgatgggtgcattaggctacaggggcaggcctcaggaaacagaatctctgacattatcctgtcctcctttcacctgcccgaagcaagactctaacctttccctgcctttctgattgtcggtcttaagaccctcaccagagtggattctgtcctatactctggggaaaggaattctggcagcatgaaacttccataaaaccccaaggaaactgggtttggagagcttctggatggctgaacatgtggaggttcctggagagtggcacgccaagggatggcggggaagttccacacccctttttcgatacctctctctatgtttatctttatccgtatcctttataatatcctttagaataaactggtaggctgggtgtggtggctcacgcctgtaatcccagcactttgggaggccaaggtgggcagatcacgaggtcaggagatcaaaaccatcctggctaacacggtgaaaccccatctctactaaaaatacaaaaaaattagccaggcatggtggcaggcacctgtagtcccagctactttagaggctgaggcaggagaatcgcttgaacccgggaggcggaggttgcagtgagccgagatggcgccactgcactccagcctgggcgacagagcgagacccatctcaaaaataaataaataaataaactggtacttttttaaaaaaagaagaaaagtaattatcttctttaatgcataggatctttaataataataacacccagaatttattatatattataaaaatcagtggctatcatgggccagagacccatactgaagtcatttataaaatatctttaaaattccccacccaagtaagaggcagaatcagattttggatcattctatcccctattaataaaaacactactccatttttgtcactgtagtgataagaacactgtacattcttgttggttataaaaaataggctgggcatggtggctcatgcctgtaatcccagcactttgagaggctgaggtgggcagactgcttgagctcaggagttcgagaacagcctgggcaacatggcaaaaccccgtctctacaaaaaatgcaaaacttacctgggcatggtggctcacacctctagtcccagctacttgggaggttgaggcaggaggatcacttgagccagggaggcagagtttgcagtgagccaggatctcaccactgcactccagcttgggtgacaagagggaggccttgtctcaaaaataagtaaataaataaaataaaaacatacacagctctaaaatctacaaattgttatttaatactactagaaacatataaagcaaatgaaaagaaaaaataaaaccaagtgcaatattttcgagcttttctacaggatatttacattattcacaagtcatttacctgaatcagagacctaaccacaccatcttttatcactttcagcctagattcatccttctcccagcagcggtgatgaatggccaccagatgaaaaagcataggctgtatcgaaaaaactgacaattcttcttaagaggattaactatgcagtggttgttgtaacaaagataagattattttcaaacttggcagcaagtgcatccagggataaatccaggttctgtagtgcttgaagcttgtttgatttgcacagcctctttaacagaggagaatataaaattaaaactaaaaaacaaaagtatgaaagggaatatttatttagcataggaaaagagatcaaaacaaattataaattttgaaagctaataaatatcacaagcaccacgaaattcagaaaaagaataacttaattgactgacacatttctgaaatgcatttagcccctatatttcttgtctatatcatcttttattccctcttcatgtgacaatgatttttgtatcatcattttctataggaagtattattttctatagataatggtatcattttacatgcatagctgattgaatttttaaatatacgtatatttcagctttataacttattcatatcatacacattcttaaaaagactgtcaagtttgtgatgcctcttttaaagttattttataggtgagttgtaaaatgtcagggcacttacaattttcttatgcagtttctaatcttaaataatatttggcataacacagttttttgatgtcttcattgaagtgccgtattatgagttttgagctctttcattaataacactatttcctgtcaaaacagctagaaatttaaaaaattgcagtgtatttatatgattcattcatctttattaattgtattatacattgatacaaaggattatttaatagatctattcaaaatgcatctcttcttcatgaattactgttttagttattttcaaaaaaaatacaacttgttttttttttagctttgtagaggaatgttctgtgttgtctaggctggtctcgaactcctagcctcaagtgatcctcctacctaagtcttccaaagtgctggtatttcaggtgtgagccaccatgcctagccataacttgctttttgatgttataataatttctattgctttttatcatgcatttttgtaacatgctacagttaattattttagttttaactgttcttttttaaattccacatataagtgacattatgtagtatttttctttctgtttctggcttatttcacttagaataatgtcgtccaagttcatccatgttgtagtaaacgacaagagaagataaagagaataaaaggatggttaccaggagtgggaggtggggaatggatacaaatggataccaggagtggtggaggtttatgtcaaaggatacaaattcatagatatataggatgaacaagcctgaagatctaatgtacaacatgaaaactatagttaataaaataatctaaagttttttaagttcttcaataaagatatttaataaagataacaacagaaggtagctttcatatacatccaaattagatgtctatatttcatacttctttcatttatggaacactttgaaatgttctttaagctgaaaacttcaacatcccacttcagcaatggactgattatccagtcagtaattcaacagagaaacaacagacttaatctgtactgtagactaaatggaagtaatagatatttacagaacatttcacccagtggctgtagaatacacattattctccacagcacgtggattattctcaaggatagactggattctaggccacaaaataaattattaaaaattccaaaaagttgaaattatatcaactatcttctctgaacacaatgaaataaatctgaaaatcaataacaagataaatacaacttgtatcccctgtgacctgcacgtatacatccagatggcctgaagctactgaagatccacaaaagaagtgaaaatagccttaactgatgacattccaccattgtgatttgtttctgccccaccctaactgatcaatgtactttgtaatctcccccacccttaagaaggttctttgtcattctccccacccttgagaatgtactttgtgagatccaccccctgcccacaaaacatcgctcctaactccaccgcctatcccaaaacctgtaagaactaatgataatcccaccacccttggctgactcctttttcagactcagcccacctgcacccaggtgaaataaacagccttgttgttcacacaaagcctggatgcgtgaaacatttagtgctgaaggcccaggtcagagggactccttcgggagaccagtcccctgtcctcaccctcactccatgaagagatccacttacgacctcgggtcctcagaccaaccagcccaagcaacatctcaccaatttcaaatcaggtaagcagtcttttcactctctttgccagcctctctcgctacccttcaatctctctgtccttccaattccagttctttttcctctctagtagagacaaaggagacacattttatccgcagacccaaaactccagtgccggtcatggacttgggaagccagtcttcccttggtgtttaatcactgcagggacacctgcctgattattcacccacactccattggtgtctgatcacctgccttggtcattcacccacgttcccttggtggcaagtcaactgaggggatgcctgctttggctgctcacccacattgcagcccagggctgctccctaccccacttctctgtgtctctacccttctctttaaacttgcctccttcaccctccattcctccttcttctcccttagcctgtgttctcgagaacttaaaacctcttcaactctcacctgacctaaaatctaagcgtcttattttcttctgcaatgctgcttggccctaatacaaactcgacaatggttccaaatggccagaaaatggcacttttgatttctccatcctatgagacatagataatttttgtcgaaaaatgggcaaatggtctgaggtgccttacatccaggcatttttcacacttcgttccctccctagtctctgttcccaatgcaactcatcccaaatcctcctcctttccctctcacctgtcccttcagtcccaaccccaaacatcactgagtcttgtgaatcttccttttctactgacccatctgacctctcacctccttcccagactgctcctcctcaggttgctccccgccaggctgaatcaggctccaactcttcttcagcctctgcttccccacactataacccttctattacctcccctccccacacccggtctggtttatagtttcgttctgtgactagctctccccaacctgcccaacaatttcctcttacagaggtggctggagctgaaggcatagtcagggtacatgtgcctttttctctatcagacttttcccaaatcagccagcgtttaggctttttctcatcagaccccactaaatatatacaggaattccgatatctaactctgtcctataatttaacctggaatgacttaaatgtcatcctaacttctatcctcttcccagatgaacgggaaagagttttttctctagcccaatctcatgctgataactgccagcttcatgagccagacctccaggaaggcattagagcagttccccgagaagaaccccaatggaactatcaggcagattccccaggtatagctaggcgagattacatggtttcctgcctagttgaagggcttaaaaaggcagcttacgaagctgttaattatgacaaacttacagaaactacccaaggtaaagacgaaaacccagcccagttcatggctcgcttagcagcaacccttagacactttaccattctagacccacaggggccagaaggccgccttattcttaatatgcattttatcacccagtcagctcctgacattagaaaaaagcttcaaaaattggaatccagccctcaaaccccacaacaggaattaatcaacctcgccttcaaggtgtacagtaatagagaggaggtagccagacagcaacacatttctgagttacagctacttgcctctgctgtaagacaacccacaaccacgtctccagcatacaaaaacttcagaacatccaagccacagctcccaggggctccatcaaaatatcctcgtggaccttgcttcaaatgccaaaagcctggccactgggcctcagaatgcccacagcccgggattccccctaagccatgccctgtctgtgcaggcccccactggaggtctgactgtctgactcacatcaccatcgctcctaaagctcctggagcccaaacccaacattccttggccgactccttcccagatctccttggcttagcagctgaagaatgacactgccctattgcctcggaagccccctggaccatcacagatgccaagcttcaggtaactcttacagtggagggtgagtctgtccccttcttaatcaatacagaggctacccactccacattaccttcttttcaagggcctgtttcccttacctctgtaactgttgtgggtattgacggccaggcttctaaacctcttacgactccccaactctggtgccaacttggacaacatccttttatgcactcttttttagttatccccacctgcccagctcccttattaggtcaagacactttaaccaaattatctgcttccctgactattcctgggctacagccacaccttattgctacccttttccccagttcaaagcctccttcgcatcctccccttgtatctcctcaccttaatccacaagtgtgggacacctctactccctctttggagactgatcatgcaccccttatcatcccattaaaacctaatcacccatcacccttaccccactcaatgccaatatcccatcccacagcatgctttaaaaggattaaagcctgttatcactcgcctgctatagcatggccttctaaagcctataactcacttgtaaaggttatagcccagggacggaggctcactaaaagactgagacctaatcataagattatagaattaattctcactctcttccatgatttactactccgttgatagatttcctaaataataagagtacattgcagttcaaagaactgcccacctcaagttttatttaataaggagtttctagggaaacccaatggcaacagggaggtaaaaacaaggacactagaaggcattttagcttctgagaccacaattatggcaaacagtaaatataatttaaatcccatcaagataaacataaaacctcaaattaaagttctattatctcatttcctttcatatgctacattgtgtctggctttcaataacaacaacaaaaaaattaaaaccatgctaaaaggcaagaaacatagtctgaagagacaagccaagcatcctaacatgcctcagacatggtatcactattggaatgatcagactaggaattttaaataagtatgattaatatgctaagggctctaacaggaaaaaaactggataacattcaaaagcataagggtaatataagtagagaaatatatacatatataaataattacttcaagtataaattgtcgaaatacaacaaataaaagacatgttttcatagaggctttaaaaaaaattttgttacacagataaattaaaacgaaaaacacaacacttgactttcaagggtgttgaagattggcaataatatatgcatagtgcttgacaaatagtaagcatgtggttattattatcacatttactattaatttttattcctcaacaaaatttattgtctcagaaatgcccagaagtgcagcacaagttatcaaattgtctttcatgtatgattagaagtgtccggtcttagtaatatcttggctttaacagaaactgaccatcaaatcagtttactacttccctttcagcctcctcgatggaaaactttttctctctctttctctctctcacttttaccattgcatgtactgcagggtcatgaaatgatgaaggtacatatttagtattgaggcttccaaataatttttgctgcttttttccttcaaaaactccagctccaaggatatgggtaatcgggcaatctcatgtattttagagtaggagtgctacaatctttttggaaagtaatctgttaatattgacttaaaagtaataataataaaaaaactaaagacataggtactttttgtacccggaaataatacatttggcaatatatttttattataaataaaagcatcattatataaccgtgcttttttgcaattagttggaagaaacaaaaccaaaaaggcagggacaagggctgaatgaacgaaatatagcacattcatgttatggaatattatgcagctattataaagagtatcctatgtacccatataggcatctacttatttaattacttttccagctttgttaaagaatgattgacaaataaaaattatatgtattttaggtgtacaatgtggttttgatatatgtgtacattgtgaaatgattaccacaatcaaggtaattaatgtatacatcacctcgcatagttaccttttgtgcatacgtatgacatttacttatttttaaatacgtttctttgtgtataccacccgtagatatgtcaaaaaagttatctgaactgaaaaaagcaatatggagatgtatttatgtttgcctagatgttcataaatataagtaaagaaaactggatgtcagaatgttcacattagtttctgtggtgttaacaggtaaaagaggaaaaagatagttactattgtatttatgcatctttacattgtttaattgattatactgagaacatgttgtttttaattaaaatatttttaaaatgttaaagattacatctcattccccttttacaagcttacttcttctggttaaagtcaactacttgaagtctagtcactcttcctcattaactggaagctcttatttctggctctcagttttcctttcaatacattttttttctgtgattatcttctgtaacaacaaggacatatgcagaaatacattatagacatgcgatttgagatcatgttgacattaggttgctctcttccagtcactggtaaaagacaaattaaatataacaacttatgaaagtacactgacatgttgagaaaaaaatattatagcagcaaaaacatatataacaaaatcatcatgaagtctagataacttgaagtggaagtaaggggaatgagaatctgtcactatgtctagagatacaacagggccaggaagattactactgttcaacacactttttgcaagaattcaatgataacatctcacaaattgtcctaatattttgcttcaactctaaacttcttatttcaatagaaaaagcaatacacagtagagcaatttttaagaaaatgtattgctggccaggcgcggtagctcacgcttgtaatcccagcactttgggaggccgaggcgggcagatcacgaggtcaagagatggagaccatcttggctaacatggtgaaaccccatctctactaaaaatacaaaaattagctgggcgtggtggcgtgtgcctgtagcccagctacttgggaggctgaggcaggagaatcgcttgaacccgggaggtagaggttgcagtgacccaagattgcaccattgcactccagcctgggcaacaagagcaaaactctgtctcaaaaaaaaagaaaaaagaaaaaaaaaagaaaatgtattgctgaggcaaaggatgtacagattatatgtgatggaatggttaatgctgtttgaatgtagggatttggggagggctgtctgagaaattgaaaatgtctgcaatgatactagatgcattgtttaaactcaaaatctgtcgttcaacttgttgtgcagtttagtgttttttattagtctgtgtttattcattcacatgacactgtaatttgatcttttaaaacccttctaaatatgtttatttttctcctttattcctataataacaaaggaaaataaaggcaatgatgaagtttaaactatcactataatcaatctacgaaagttacctagcccttggcttgacctgcatcagttcagacttagctggaaaactactaaacatgtacaacttaaaccacttttttccctatctagtctcagcttcagagattcagtcaacaactggatattaacatgtaaatatcttattgccatatcaaactcagaaaggaaaggacaaaacttctctagggtatgtgactttgtttctaaatctttgctcccattgtatcatccttctttgatgccttcttatgtccctactacccacccataaaagacgaactcattcactcattcttgaggaaagttgtcatagcttttcccattctccatcatctcagttttctttgacattctaataaaaatatatgatgtttaacaacattcataaaaagtttttataatataaaaaaggaaaatagtaacagttgttttggcctgtgggttagattgttaataactcccgtattgaagaaaaccatattaaaatgttaaaattgtaatgacactcactagtattttattgcctattagccagaaatttttatagagtaactgataaaacatatgtaaagcttttcacttttcttatggaactctaggcagcttttagtttgaagtattataaactgttagattttactaaaagagatccagaaagtacattacattaaattaaccatgagataagaaaatataatttttacacatatatggaacacagatttgcatatgcattattcgcaggtatgtggattgctctataaagtgtctgtttcatttagaagtgaataatgaacatctggtttcagcttggacatattagaaaaaactaggtagtcatcacttccatcctaaaaacaagaagaaagcttgacaaactgaaaatcgaaggcttttttagacacgtaggagaattcaggtcacagggcaaattgctactctggaatctggaaaaaaagacaaacacagaggagcacaacctagataaacttacttggagaagaagcctctggagccataaactagtcaaaacttaaatggaaatttcgagaaattgctagaggctaaatgtggattagcttgaaagtaagaaactacagttttaggggtgctgcagcactttcatgggctttacctctaataacctcaccactttctgaagattaagacagtaaaaatcctctgatacttttggacagggagaggcaaagtaataacattgaaatactcccagggcattctccataataaaagcctactagccaaagaaagctacttcattagagccttataactgggtaaaggcatccattagccaactccagcacccaaaagcttttctgtctcctctaagaagagaaaataaaaggataagaaccacttttgaaatttggcccctattacccaatacatcatatccaactttagggaaaaaaattataatgcatgctaaaaggaagaaaaatacaatctgaaaggacaaatcaagcatcagaaccagatgcagatatggtgtagattttgtaattatcatactgtgagtttaaaataagtctaattcacgttataggctctgatgttgaaataaacaatgaaaaaacagatgggtaatataagcaaatacagtaaaattctatgaaacaatcacaagaaaatgctagaaaactgaaacggtgtgacagaaataaagaatgtctttgatgggctcattagtataatagacatatctgaggacagaaattgtgaaattaaagacatcaatagaaacttcccaaagtgaaatatcaagagtaaaaaattgtgaaattaaagacctatcaatagaaacttcccaaactgaaatgtcaagagtaaaagaaatttgaaaaaggaacggaatatgcaagaattgagggatagttataaaagatataaaatatgtataatgagaatcctagagaagaaacaagagggaaaggaatagaagaactacttgaactaataatggttgagaattttccaaattaatggcagacaccaaatcaaattcagaaatctcagagaacaccctgaagaacaccaagaagaatagcaaaaaaaaattttcactaggctattatatcaaaaatggagataaaatcttgaaagaagtcataggaaaaaaaaacccacctttcttatagaagaacaaggataatatttacattggaattcttctcgtcagaaaccataaaagcaagaggagaaaggaacaaaatatttaaaatgttgaaagaaaaaaaaagaacactaaggtagaattctacatccagcaaaatgtgtttttcaaaagaaaagggaaatgaagacttactagacaaagaaatactaagggaattaatcactggtagacttgaactgcaaggtcctgtgaaacacaaggaatttgagggtgatgaaacttttccacaaataatgtaatagtaggtacaagatattacgcatttgcaaaacttttagaacttttcaccaagcagtgaaacttaacgtttttaattttaaaaaaaattgtgtaggagtttgggagatctcagaaaaacattcaaactgtgaaaagataaactatattacaagttactatcatagaagcatacagagtagaacagtggttaccagagactggggagaagagaagaagggcagggaggatgggaaggagaggttgatcaatgggtcaaagttataattagagagaagaaataagtttgttctactgcacagtatgacagggataacagtaaggtatcctatattacaaaatggttagaagagaggcttttgaatgttttcattacaaataaataggtacatgaggtaacggatatgccaaataccctgattttgatcattatacaacatatatatgtaggaaacaataaaattattaccccataaatatgtacaactataacgtgtcaatttaaaaacaaaaaaataaattttagtaatagttatctctgaaattatagttgttgaaatatgcaaacctttaacttttcacttcacaactctctactctgttttactttctataattagtataaattattttacattttgttgttgaggcggagtgcaatggcgtgatctcggctcactgcaacctccgcctcctgagttcaagcgattctcctgcctcagcctcctgagtagcggggattacaggcatgtgccactacatccggctaattttgtatttttagtagagatggggtttctccacgttggtcaggctggtctcgaactcctgatctcaggtgatctgcccgccgcggcctcccaaagtactgggattacaggtgcgagcgaccgcacctggcctattttacaatcttgacagatatttttaaaaggggatgatacccagtgatcaagtaagattggactgaaatacaagaatgattaagtttttggaacttatgtaagatttttggaactaatgtaagattaataggtttcaagatgtgagaaacacaagcattaaaagatatacagaagcaatttgtagatagattgtgaaaaagcattcttgcaaaattcaaaataaaattctgatttataaataatcttattaaataaggaataaaaatgtacttctataagatagaaattatccataataggacagtagaaaacaactaatgtaatggtaaatgcaaaaggggttcccagtaaagccagcaatggaacctgctttgactaccatttaaaaactttgctctatatgttcatttccaatggttaaaaccaggaaaagagacagcaagaagacactttagaaaacgagtattgctcaaatatttcatctccttggttaaatttaatcttaaatattttattccttctgatgctattgcaaataagattgctttctaaatttccttttcaggtagtttgttgttattgtatagaaacacaactgatttttttttttttttttttttttttgagacggagtcttgctctgtcgcccaggctggagtgcagtggcacaatctcggcttgctgcaagctccgcctcccaggttcacgccattctcctgcctcagcctcccgcgtagctgggactacaggcgcccgccatcacgcccagctaatttattgtatttttagtagagacggagtttcaccatgttagccaggatggtcttgatctcctgaccttgtgatccgcctgcctcggcctcccaaagtgctgggattacaggcttgacccaccgcacccggcaactgatttttttatattagttttttatcctgaaactttaataaatgtgtttattagttgtagtattttgtggaatatttatggttttttaaacatagaatcatgtcatctgcaaacagagacaattttactttttccttttggaatttggatggcttttatttctttttattgactaattgctctggctaggactttcagttctatgctgaatagaatcagaggtgtgggcatcctggtcttgtttgctgaaaactgtaaaacattgacagaaaaattagtaaaattatgaaaataaattaatgaaataatgaagagatttcccatggtcatagttggaagactcaatatttttaaaatgtccatacttcccaaggaaattcacagattcaatgcaaaactatcaaaatcccaagataaaattttaaagatgtagtaaaaaaatcttaaaatttgtagtgacattaaattaaaatttatatagacccaaaatacctcaaatagccaaagtaatcttgaagaagaagatcaaagctggaagctttgttcctggtttcaaagtatgtaacagagctatagtaatggaagtagcatgttattggcataaaaacagatacagattccaatgaaacagcatagagaacccagaaataaacctatacagatgtggtcaagtgatctttgacaggggtgccaagaatataaaatatgaaaaagatagtctcctcaacaaatgatcttgggaaaactggaaattcacatgcaaaagaatgaaattagacccttatttatacgatacacaaataaaatcaacttgaagtagattaaaaacttaaacctaaaacctaaaactataaaactcccagcagaaaacttaatataaaagtttttgagattatttttggcaatggttttctggatatgacagcaaaagtacagacaacaaaagcataaatagacaagtgggactatatcaaactaaaaagcacttgcacagcaaaggaaaatatcaagagaataaaaaggcagcctagagattggagaaaatacttgtaaaccacatatctgatatatgagaaacttatacaactgagtagaaaacaataaaaacaaaacccaattaaaaaatgggcaaaggacctgaatagacattttttctatagaagacatacaaatagtcaaaagatatatgttaagatgctcaacatcactaatcatcaggaaaatgcaaataaaaaccacaatgaaatatcccctcacatgtgttaagatggctattaaaaaataaactatttttgtaaaaaatatgataaatgttggtgaggatgtggaggtattagaaccgttgtacactgttggtggaaatgtaaagtggtgcaattgttatggaaaacagtatagagatttcccaaaaaatattaaaaacaaaagtactatatgatgcatcaatcccacctttatgtatattttcaaaaatttgaaattaggatcttaaagacatgtgtgtactctcacatccattgcaaatttattaaccatagccaagatatggaaacaaactaaatgtctatcaagggataaatggataaagaatatatggtgtgtgtgtatatatatatatgtgtgtgtatatatatatatatacattaaaatatatatgtatttggaggttgaataatattccatgatatatatggcatatttatatcatggaatattatgtatagcatatatatgccatgtataatggaatattttatatactatatatggcatatatatgtatatcatagaatattattcaattttaaatatacacacacacacaccatatcctggctatggtgaaatttattcaccatagccaagatatggaaacaacctaaatgtctatcaagggataagtggataaagaatatatggtattatacatatgtattttttgaatacatatatatttgaaggttaaataatattccgtgatatacatatatatatggaatattatttaaccttcaaaaagacgaaaattctcccatatgtgataacatgaaacctagaggacattatgctaaatgaaataaaccagacacaaaaacacaagtactgcatgatctcacttataagtggaatcttaaaaaattaaactcatagaagcaaagaatagactagtgattgccaggggttgtggggagggggaaatgaggatgtaaaagaaatagcctgtggcatggcaagtgtaatgccatattgaagtgaaaccaccatgatgacccttgtttgactctggcataccaaggtgttttgcagcaagttctttagacaatgcctgtggcatagataacatctcataaagatgcttatctaacttccttagttgtcatcagttttcgcaagaaagtctgggatgtgatcagctgcacgtgtctttaccctaaaagcttgctgtataaaagatactttctggagagtaggtgctgggattcactgtgttgcagccatccaaggcaacacttctgttcttaagtccctattaaacatttctttctgagaaactggatttgtcagcctctttcttggacctctcatctcccttggctgttgggggtagatctgcatatacctgctcaccttggaacagggaagttgctgttcagtgggtacaaagtttcaattatgccagatgaataagttctagggatctatttaatattatactgtaggagatgggtgagagtggtgggagaagctatagggaaaggagcaggccttctgaaaggtcagaaggctctgcatagcttcaagggagaataagctgaaggcagctgttctctgaaactgaggcagagggcaaggagtaggtacaaggaagtgtaggggaatttatcttaaataggcttgtttacttaccttgtctggaaaccgacctttgatcatcagcgcacaagactgctccctgaatgggggaacaataatattaattacccacagatcgtgttggctccaggcttttggcattatgtctgtactgaataaaatcaagcagctccagcttatcgagactgctctttctttggcccttagtgccgggcagtcccctagctgctcttacactgcatacctgtgtctaagtactcctttcatctgtcactcagccagcatctgcaggacagaaccagcattgtacaacattgtgcctatggttaatattgtattgtgcatttaaaacatttaagagtagatcttacaatgttttcttaccacaaaaactaacaaaacacaaatgagcacaaagaagcttttgggagtgatgaatatgtttattaccttgattgtgatgatggtttcacaggtgcatgcctatgttcaaactcacagaattgtataattaaatatgtgctgtattttgtatatcatctataccttaatgagttagttataaaaagaaaaggaaatgtctgtcatttcaagcagatattatttcaatctaggatatccaaaaggataaattgaaagtgagtagaaatcatatatctgtaagtttaaaatttttccaattataatataaatttttagaaaatagctttttcagataccaaaaatatgatgaggcaaggtctggaccataacagtaccaacaacaaaactttcttcatctatattgcttacgtttgaaatattttcttggccaggcacagtgactcacgcctgtaatcctagcactttgggaggccaaggtgggtggattacctgacgtcaggagctctagtccagcctggccaacatggtgaaaccccatctgtacttaaaaaaatataaaaattagctgggcatagttgcaggtgcctgtaatcccagctacttgggaggctgaggcaggagaatcgcttgaactgagaaggcagtgaccttgcagtgacccaagattgcaccattgcactccagcctgggcaacaagagcaaaactctgtctcaaaaaaaaaagaaatattttcttaagataaattccaagaagtgagattatttcatcaatgtatttaaatgttatggccatttataaacaatcaacaaatgttaaaaaagaattataaacaatagtagtaacaatgtgctttaagattaaattactttttcttcctttccaagtttttttgagatttttttatgcaataaataacagtaaaaaatgcattaattactgttgtagcacaatttttcattaacagtctttagtttttttttttttttgagacagagtctctatcacccaggctagagtgcaatggcgtgatctcggctcattgcaacctccgcttcccgagttcaagtgattctcctgcctcagcctcctgagtagctgggattacaggcatgtgccaccacgtgcctgtatttttagtagagatggggtttcaccatgttgtccaggttggtcttgaactcctgacctcgtaatccaccggccttggcctcccaaagtgctgggattacaggcatgagccacggcacccagtcgtctttttttccccttctttcccattcaatttatctgaacaatttttctcagtgctctgaaatgctttcttaatttaccatctggcttttgtgggataaagcagactcatttgaatgcacatatttatactacattgcctatagtagatatatgcccattctatgtgtgcatatatacaaatttatatctgtgtatatttcatttttgaagagatggaggacatgaaactctagaaaaataatttaaaataaatacactgtagacaatcttccaaaatattaaaaatatagtaactttcaaagaccactgtataaaatgaagttcaagataatacattccatttaaaacaaaattttgaagaaattattattattattattattattattattattattatttagatggtgtttcactcttgttgcctaggctgcagtgcaatggcgtggatcttggctcactgcaacctctgcctcttgggttcaagcgattctcctgcctcagcctcctgagtagctgagattacaggcataaaaccatctgctactgagagaaaatccctgaatactgaacccctcatttataaacattcaaatgaaagtttaattggtaattatagcatcaaaaacaaacttaaagcagtaagttctggtttgatctctaggacttagtaagcaattctcaagctatttatttgtaaatagtgatagcttccattagaaagtaatgcactggccgggcgtggtggctcacgcctgtaatcccagtactttaggaggctgaggcaagcagatcacgaggtcaggagttcgagaccagcctgaccaatatggtgaaccccctgtctccactaaaaatataaaaattagctgggctcggtggcgtgcgcctgtaatcccagctactcaggaggctgaagcaggagaatcccttgaacccgggaggcggaggttgcagtgagcaaagattgcgccactgcactccagcctgggccacagagggggactccatctcaccaaaaaaaaaaaaaaaaaaaaaagtggcccagcgcagtgcctcacgcctgtaatcccagcactttgggaggccaagaggggcggatcacgaagtcaagagattgagaccattctggccaacatggtgaaaccccctccctactaaaaatacaagaattagctgggcatggtggcagtgcctgtaatcccagcactcaggaggctgaggtaaacaatcacttgaacccgggaggcggaggttgcagtgagccaagatgtcgccattgcactccagcctgggtgacaagaacgaaaccccatctcaaacccccccccccaaaaaaaaagtaatacacagcacgctcgaggactcacaagatgacggcaacccgtggggagacgggctcgagaactcgcgagatgacggtggccattgaggagctgggcttgaggactcgcgagatgactgcggccaatggggagccaggcttgaggactcgcgagatgacacctgccggtgggacgcgggcttgaggactcacgaggcgatggcggctggtggggagcatggcggcccttgctaggggcgttctacagtgcgactgaggaggcccagggtgtcccgtttgtttcatcaccagcaagaggcaggcagtggtgctgtccgcggtggcattcttggagtgactggcgacagaatacgttcgtgacggaaccggggtctgaggagagctctccgcctgcagaaatgagtgaacagactgctgcattagatacctcgtcgccacgcaataaggcgcctgcccgttctgacaggactgtatccaacaatgacttggcaagtatcttccagtgtccggtctgcttagactatgcgttaccaccaattcttcagtgtgagagaggccatcttgtttgtagaagctgtcactcaaagctcacatcttgtccaacttgccgcggccccttgggattgattcgcaacttggctatggagaaagtggctaagtttgtacttttcccgtgtagatatgcctgtttgggatgtgaaatcactctgccacacacagaaaaagcagatcacgaagaagtctgtgagtttaggctttattcctgcccgtgccctggtactgtctgtaaatggcaaggcaccatggatgctataatgcctcatctgactaaaatgcatgagtacattacaacaatagagggagaggatataattttccttgctaccagcattaatcttgttggcgcttacgattgggtgatgatacagtcctgttttggcgttcgcttcatgttagtcttgcagaaacaggaagatcacaatggcggccagcagttcttcgcagtcgtacagctgctgggagcaagcaaggaagctgaaaattttgcttaccaacttgagctaaagggtaatcggcgacgactgacttgggaagcgactcctctacctattcatgaggacatagcaaaagccattaagaatagagactgcttaatctttgacgccaacactgcgctgctttttgcagaaaatgacgatttaagcatcaatgtagttattagtaagcgttgaaatggcagtggaacattttctagccagtgtttaaaactgtttaatttcacagaaaataagccacccatctgcctgccaacctgaaactcttcacaagtataagctcaacaaatagagataaaaagaaagactgttgaatacaggaaacagttgtgtgtagtaacattagtatatataaagatgagcatattttgcattaagaaagcattataaaataattttgaattttgtgttgtagattgattgtattgttgaaaaataatgttttgttttgttttgtttttgggtctgtgagtgtgtgtgtatgtgtgtgtgtgttttggtttttttttttcttttttctttttttttttttttttttttttttttgagacggagtctagctctgtcgcccaggctggagtgcagtggcgcgatctcggctcactgcaaactccgccttctggggtcacaccattctcctgcctcagcctcccgagtagctgggactacaggcacccatcacctcaccatgttagccaggatggtctggatctcctgacctagtgatccgcccacctcggcctcccaaagtgctaggattacaggcgtgagccaccgagctcggctgttttttttttttttttttcctttaactgacaagccattttgagtggtcatggaccactgcttttccgctttgtgagtcaatacgtagtgctactatgtggggttttttttgtgtgtatttgctagttttttcttctagtttttcattaaatagatttgactttctgttctgtaattcaggttgcatctcactgttttgtaccgttttaaagttagtgtcttctgatatgcataattgtttatggtaaaatttataacatgtgttccatacatgttctcttttcccccattaattggttcattggaaatttttttttttttttggacagagactctgtcgcccaggctggagtgcagtggcgagattttggctcactgcaacctccgcctcctggctgggttcaagcaattctcctgtctcagcatcccaagtagctgggactacaggcgcccgctaccacacctggctaatttttgtatttttagtaaagacggggtttcaccatattggtcaggctggtcttgaactcctgatctcaggtagtccaccctcctcggcttcctaaagtactgggattacaggtgtgagccaccatgcccagccagaaatattttaaaatcagctgttttgtgaagataggagttccagaaagtaaaggtgacatcggaaaaattaccaaaagctatttaaaacatctataagatggtcttcccatctttctctcttctacagatgagtcatatctttgagattaatttttgaaagcttagagaataaatagatgtttacaaatactgaaaatcattccttttacaagtatcttggacaaattacgtttaaaatttgttcttgtgtttattgattgtaaaggcattgtcatgcacagaacttaattaaaagcaaatcatttgtttaaaaaggcactttgcaaaaactgttttggtctttcataattctcattaaaagaatatatggcaaattaaaaaagaaagtaaagagaataaatgttgtagcttggctcagtaaacggctctagcagcaatgctggactcgtctttaagaagtgtataaaatacacattttatttatccagtctatcattgatgggcatttgaactcattccatgtctttgctattgtgaatagtgctgcaatgaacatatacatacatgtatctttataatagaatgatatatattcctttgggtatatatccagtaataggattgctgggtcaaatggtatttctgcttctagatctttgaggaatcgccacactgtcttccacaatggttgaactaatttgcattcacaccaacattgtaaaagcattcctttttctccacaacctggtcaggatctgtttcttgacttttcaataattgccattctgactggtgtgagatggtatctcattgtggttttgatttgcatttctctaatgatcagtgatgttgagcttttttttcatatgcttgttggctgcatgaatgtcttttgagaagtgtctgttcatgttgtcctttgcccactttttaatggggtttttttttcttctaaatttgtttacgtttcttacagatgctggatattagacctctgtcagatgggtagattgcaaaaatttcctctcattctgtaggttgtctgttcacgctgatgatagtttcttttgctgtgcggaagctctttagattaattagatcccatttgtcaattttggcttttgttgttaattgcttttggtgcttttatcatgaaatctttgtccatgcctatgtcctgaatggtattgcctagattttcttctagggtttttatcattttgggttttgcagttaagtctttaatccatcttgagttaatttttgtataaggtgaaaggaaggggtccagtttcagttttctgcatatgactagccagttctctcagcaccatttattgaacagggaatatgcagccataaaaaggaatgagatcatatccattgcagggacagggatggagctggaagccattatcctcagcaaactaatgcaggaacagaaaaccaaacacagcatattccataagtggaagctgaacgatgagagcacatggacacctggggggaacaacacacactggggcctgttagggaggtgggagaagggagagcatcaggaagaatagctaatggatactggacttaatacccaggtggcaggatgatctgtgcagcaaaccaccatggcacatgtttacctatgtaacaaacctgcacatcctgcatatgtgccccagaacttaaaataaaagttgatgaaaaaacagtgtataaagtacacattttaaaaagaaaagcaccaatgcagggaaaggcatgaaaagtggtaaatgagaggtacaatttgtaagtaatgcagctcgggaaaaaaacaaaaccctcatttggacaatcctaacaaagaaactgagacttggagcattcatctttaggtgagagattcataaccaaagtcttgtagctggtaagttgtatcacagtataatttgttttttttaaaaatttaagtgatacgtgattatttactttcataacttaaaaaagttacaaaccagttagagaaaagcaatatttggataaacctacacatgtcacacaagatttgtggactttataataaggaagcctaatcactaattcaaatactatgacatgcttgcaagaattaaaagtgcatatcttccattttcttttaattctagtcagttttatatctagcatataattagtcattggttcctttctccaactcacctgtttaattggtattgcatttttttttattttattatactttaagttctgggatacatgtgcagaatgtgcagttttgttacataggtatacatgtgccatgctgatttgctgcacccatcaacccatcatctacattaggtatttttcctaatgctttccctcccctaggcccccacccaccgacaggccctgctgtgtgatgttcccttccctgtgtccatgttctcattgttcaactcccatttatgagtgagaacatgcggtgtttggttttctgttcctgttattttgctgagaacaatggcttccagcttcatacatgtccctgcgaaggacatgaactcaaccttttttatggctgcacagtattccatggtgtatatgtgccacattttctttatccagtctgtcattgatgggcatttggattggttccaagtctttgttcttgtgaatagggctgcaataaacatacgtgtgcatgtgtctttatagtagaatgatttatagtcctttgggtatatacccagtaatgggattgctgggtcaaatggtatttctggttctagatccttgaggaatcaccacactgtcttccacaatggttgaactaatttacactcccaccaacagtgtaaatgcattcctatttctctatatcctctccagcatctgttgtttcctgactttttaatgatcgccattctaactggtgcaaaatggtatcttgttgtggttttgatttgcatttctctaatgaccagtgatgatgagcgtcttctcatatgcttattggccacataagtatcttcttttgagaagtgcctgttcttatcctttgcccactttttgatgagattgtttgtttgtttttttcttgtaaatttgtttaagttccttgtagattctggatattagccctttgtcagatggatagattgcaaaaattttctcccattctgtaggttgcctgttcactctgatgatagtttcttttgcggaagctctttagtttaattagatcccatttgtcaattttggcttttgttgccattgctttttgtgttttagtcatgaagtctttgcccatgcctgtgtcctcaatggtattgcctagggcttcttctagggtttttatggttttaagtcttatgcttaagtctttaatgcatcttgagttaatttttctataaggtgtaaggaaggggtccagtttcagttttctgcatatggctggccagttttcccaacaccgtttattaaatagggaatcctttccccattgcttgtttttgtcaggtttgtcaaaggtcagatggttgtagatgtgcggcattatttctgaggcatctgttctgttccattggtctatatatctgttttggtatcagtaccatgctcttttggttactgtagccttgtagtttagtttgaagtcaggtagtgtgatgcctccagctttgttctttttgcttagtattgtcttggctataagggctcttttttggttccatatgaaatttaaagtagtttattctaattctctgaagaaagtcaatggtagattgatggggatagcattgaatctataaattactttgggcagtatggccagttccatgatactggtccttcctatccataagcatggaatatttttccatttgtttgtgtcctcccttatttccttgagcagtggtttataattctccttgaagaggtccttcacatcccttgtaagttgtattcctaggtattttattctgtttgtagcaattgtgaatgggagttcattcatgatttggctctctgtctattattcgtgtataggaatgcttgtgatttttgcacattggttttttatcctgagactttgctgaagttgcttattagcttaaggatattttgggctgagacgatggggttttctaagtatagaatcatgtcatctgcaaacagagatgatttgacttcctctcttcctattcgaataccctttatttctttctcttgcctgattgccctggccagaacttccaatactgtcttgaatacgagtggtgagagagagtatccttgtcttgtgccagttttcaaagggaatgcttccagcttttgcccattcagtatgatactggctgtgggtttgtcataaacagctcttattattttgagatacgttccatcaatacctagtttattaagagtttatagcatgaagtggtgggatttgataaaatccaaaggcctttcctgcatctattgagataataatatggtttttgtaattggttctgttaatgtcatggattacatttattgatttgcatatgttgaactagccttgcatcccagggatgaagctgacttgatcgtagtggataagctttttgctgtgctgctggattcggtttgccagtattttattgaggattttcacattgatattcatcagggatattggcctgaaattttctttttttgttgtgtctctgccaggttttggtatcaggatgatgctggcctcataaaatgagttagggaggagtccctctttttctattgtttggaattgtttcagaaggaatggtaccagctcctctttgtacctctggtagaattcagctgtgaattcatctgatcctgggctttttttggttcgcaggctatgaattactgcctcaatttcagaacttgttattggtctattcaggaattcgacttcttccgagttcagccttgggagggtgtatgtgtctaggaatttgtccatttcttctatattttctaggttatttgcatagaggtgtttataatattctctgatggtagtttgtatttctgtgggatcagtggtgatatcccctatatcattttttattgtgcctatttgattattctctctttacttctttgttagtctggctagcagtctatctattttattaatcttttcaaaaaaacagctgctggattcattgatttttttgaaatgttttttgtgtccctatctccttcagttctgctctgatcttagttatttcttgtcttctgctagcttttgaatgtgtttgctcttgcttctctagttcttttaattgtgatgttaggatgtcgattttagatctttcccacttttttctgtgggcatttagtgctatcaatttccctctaaacactgctttagctgtgtcccagagattctggtatgttgtgtctttgttctcatcggtttcaaagaatttatttatttctgccttaattttgttatttacccagtagttattcaggagcaggttgttcagtttccaggtagttgtgtggtttttagtgagtttcttaatcctgagttctagttagattgcactgtggtctgagagactgttatgatttccgttcttttgcatttgctgagtagtgttttacttccaattacgtgttcaattttagaataagtgggacagggtgctgagtagaatgtatattctattgatttggggtggagagttctgtaaatgtctattaggtcctctaggtccagagctgagttcaagttctgaatatacttgttaattttctgtctcattgatctgtttaatattgacagtggggtgttaaaatctcccactgttattgtatgggagtctaagtctctttgtaggtctctaagaacttgctttacgaatctgggtgttcctgtattgggtgcatatatatttaggatagttagctcttcttgttgcattgatccctttatcattatgtaatgcccttctttgtcttttttgatctttgttggtttaaagtctgctttatcagagactaggattgcaacccctgctctttttttgctctccatttgcttggtaaatatttgtccatccctttattttgagcctatgtgtgtctttgcacgtgagatggttctcctgaatatagcacactgatgggtcttgactctatccaatttgccagtctgtgtcttttaattggggtagttagcccacttacatttaatattgttatgcataaatttgatcctgtcattatgatgctagccagttattttgcccattagttgatgcagtttcttcatacaatttggtatgtttttacagtggcttgtaccggtttttcctttccatatttagtgcttccttcaggaggtcttgtaagggaggcctggtggtggcaaaatctctcaacatttgcttgtctgtaaatgattttatttctccttcgcttatgaagcttagtttggctggatatgaaattctgggttggaaattattttctctaagagtgttgaatattggcccccactctcttctggcttgtatggtttctgcagagatccgctgttagtctgatgggcttccctttgtgggtaacccgacctttctttctggctgcccttaacatttttccttcatttcaaccttggtgaatctgacgattatgtgtcttggggttgctcttctcgaggactatctttgtggtgttctctggatttcctgaatttgaatgttggcctgtcttgctaggttgggaagttctcctggataatatcctgcagagtgttttccaacttggttccattctccccgtcactttcaggtacaccaatcaaacgtaggtttggtcttttctcattgtcccatatttcttggaggcttgtttgttccttttcattcttttttatctaatcttgtcttcacactttattccattaagttgatcttcaatctctgacatccttccacttgattgattaggctattgatacttgtgtaagcttcacaaagttcttgtgctgtgtttttcagttccatcgggtcatttatgtccttctctaaactggttattctagttagcaattcctctaaccttttttcaaggttcttagcttccttgtattgggttagaacatgctcctttagttcagaggaatttattattacccaccttctgaagcctacttctgtcaatttatcaaactcattctctgtccagttttgttcccttgctggcaaggagttgtgatcctttggaggagaagaggtattctggttttcagaattttcagcctttttgctctggtttttccttatctttgtggatttatctatctttggtctttgatgctggtgacttttggatggggtttgtatggacatcctttttgttgatgttgcccctattcctttgtgtttgttagttttccttctaacagtcaggcctctctgctgcaggtctgctggagtttgctggaggtccactccaaagcctgtttgcctgggtatcatcagtggaggctgcagaacagcaaagactgctgcctattccttcctctggaagctttatcccagaggggcgcctaccagatgccagccggagctttcctgtatgaggtgtctgtcgacccctgctaggaggtgtctcccagtcaggaggcatgagggtcagggtcccacttgaggaggcagtctgtcccttagcagagctcgagtgctgcgctgggagatccgttgctgtcttcagaaccagcaggcaggaacctttaagtccactgaagctgtgcccacagccgccccttctcccgcttgctgtgtcccagggagatgggagttttatctataagcccctgactttctttcagagatgccctgctcagagaggaggaatctagagaggcagtctggctacactggctttgccaagctgcggtgggctccacccagttcaaacttcccggtggctttgttcacactttgagggaaaaaccacctactcaagcctcagtaatggcagacgcccctccccgcaccaagcttgagcgtcccaggtcgacttcagactgctgtgctggcagcaagaatttcaagccagtggatcttaacttgctgggctctgtgggggtggaatccactgaactagaccacttgagtccctggtttcagccccctttccaggggagtgaacggttctgtctcactggcattccaggcaccactggggtatgaaaaaaaactcctgcagctagctccatgtctgcccaaatggccgcccagttttgtgcttgaaacccagggctctggtggtgtaggttcctgagggaatctcctggtctgtgggttgcaaagaccgtgggaaaagcatagtatctgggccggaatgcagcattcctcactgcacagtccctcacagcttcccttggctaggggagggagttcccccaccccttgtgcttcccaggtgatgcgacaccccaccctgctttggctcaccctccatgggctgcacccactgtctaaccagtcccaatgagatgagctgggaacctcagttggaaatgcagaaatcacctgccttctgcgttgatctcactgggagctgcagaccagagctgttcctattcggccatcttgccagccactccggtattgcatttttatcatccctaagaaatagaaattggataagcatttgtagaacacttaaaaagccctagatgagtataacaagaccatatattgtaaatctaaatgagaaattaggcatttatctttaaaaaataaatgaataaagagcttccatagttatggaagcaattatatttagcagcttatattttagtaaaacaaaaaggttctaaacaatatatgttcgaactatgccactaatttctacataatttttttccaatgaaaaacctttttcttggcaatgtcattttaattttatttctaaacaattgctcttttaattggatctttattggttattaagtattatgaaagaggcaggtagtctgcttcttgtacaattattacaaagaataacaacaaacccggaaacctgtctgcaatgaacctcaaaccaaatgttgtggtaatgattataagaagaaaacaatgttcctgaaaaattatcagtaatgttttttcacaggagtgtaaatgtgattactttaatccctgtattccactactcagaccatgggaatcttactcaaaaggaaacggaaataaataaaaacttggctagggtgcttaagtttttcagagtcatggaaaaattctggaatgatttgaaaaaggcttctgtgtaacagaataattgtaataagagaatgtaaatctcttctttaattaaaggagatttttagtctatctaaagagagtgttggggaaaaatctaataggaatagtaaatgtagctattaagattttcagtagcacgagattttattttgacaaatgaagtatttttctgctaaacactttttaaagtagtttatttttttaaaaacatacatatttttgaaaccaggaaaaaaaattccctagtaaacaaatcatttttttaagttagagattgtttttctcttcttttctcctattccttaaaatctacatataaagacacaagtttaaggctgagaaacataattttacaatagtcatttttctattaaatacaatttttaaaatatttactgaatgtttgtcctgtgctaagcatatgctaaatacttcccattcaccctcttagtttacacctgcaatgaacatatgaggtactcattagacccattttaaagctgagcaatctgaggcttagagaagctttggctaacagcccaaatcatgcagttactaagtggccaaggcgtataccttcccctggcatagaatattaaaaaggacatattaagtcatgtgcaaatatcaccaaatctgctgcagaatacataggattttaatggtaaaaatagcaaaataattcaaagggtgctcattggtcacctaaactactttatcttttagaaaaccttcaaaagccagtttccttgggaacaggaaaatctgacagtctttgctattattgcacttggtcccctcacacccaccctgcttcctccactggcttcatgcttctcctctccctatcactaaggaggagtactgttaagaaaaatctctgtgtgacttcgatttcatcaacttgtcaatttcatggaagcaggttaattctgtagagaagtttttgttgttgctgatgataagtatttggtctatacacgttatattacacaggatcaaatgaattttaataaagttttgtttctctaatatcatactactctgtaaactctgagtagtgagactaaagatgaaagcctgaaggatcctcctaagcctcctctaatactcctactcttaccattttcctactttcttccttcttttctctcttcatctccttttatctatattttaaccttatgtctaaatcactttcttacactttatctaccctccaataggggatcaaaaataatgtgaagagaaggaaattgtatggctgatagtgaacagtgatagtataatctagtgtattggtaggttacatctgcctttactgtgcataatacaacaatcatcccccaccagttttaggtttataatttctccccaaaatagggtaatcttgaaagtatgtctttggggtatttttaccacccctgaacaaaacttgtatgctacatattttatttcctaagggtcgtgtttattaagcatcctatagttaaaaccaactaataaaccaaaactaaattcatctaatttggctttctcgcaaggatagaatctcatggggtcttttcaacatccttggaagcacatgaggttcatggctatctagaatcccaggatctaagtacctaagattggcagccataattctagctttgtaagttaattttcttcttccttctttttttatttttttaaaatatgttggttgtactcgttgttctttctataccacattgttaacataaaatgagcataacagagataccatgtataacaaaagatgattattaaaatctacaggattcagaattgtgttatagaaaacagtaatgttttagttttaggaacaaatgcatgggttttttttttttttctgcagcaaaatgtcaaagcagtgttagttcaggtccctattaaaactacatgctcttcctgatccatagaagagaaaaagataaattggaattcatcaaaatgtaaaagttctcttcaaaaaaacacagttaagaccatgaaataacaagccctgagctgagagaaaatatttgcaaaacatagatcaaataaataaattttatcttaaacatataaagaaatatcaaaactcaacaataagaaaacaaaacctcagttaaagctgggaaaaatagttgagtagacattttaccaaaatatctctgtgaataacaatcacattaaaaggtattcaacatcattattcattaagaaaatgcagattacaatgtagtagtactagacgcttattaaaatggttgaaattaaaatgactaaccacactatttccaaggatgtagaggagctggattcccatacactgttggtaggaatgaaaaatagaaccgctttggaaaattgccaggcagtttccttaacagttaaacatacatataccatccataggattttacccaaaagatatgaaagcatatatctgtacagagatttgtatgttcataaccatatgtacatagcagctttatttgtaatttataaaagttggaaacaccccaatgtctgtcaacaggcagatcactaaacaaattttgttatactgataccatagaattctactcagcaataaaagaaatgaactattgacacatgtgaatgaatctcaaaataattatgtcaaataaaagaagctagaccaaagagagtacacactgtatgttttcatttatataaaattctagaaagtgtatactctagtgatagaaaacagatatttcgttgcctaaggaaatggtagattggcatgaaggaagcagaaagggaaaggtttacaaatgaacacaaggaaaatttccagagtggttgctttgatttagactgttttgatagttgcatgaggctatacaaatgttaacacgtctcacattttatactttaaatatgagcgatttaacatatgtcaattacacctcaataatcctgctacaaatcactgtatgcttcagagactgtactcaccattcccagggaagtatttctcagcaggataatgacggtagttgagaactgtcacccaacattggaagtactgcacaaacagggtgtgtaagtggagcttacaaccacttatagatttcttttgggcactggcaatgccaagtgcaagataattaatgcagaataattaatgaagcctctatatttcaataattagagaagctttacatggctatcatctgtctccattcatcaacttatcttagttttatcaatgtgctttagtcaagtatgttttactggtatcaaatgcaactgtaatcacctgcttggatgcactgcactatgaaggtggcttcctaagtctccatgtaaaaccttcgattttaaagttttagaatcgctgaaggatcttctaaccctacaaatttaaatagggtgttttattccttatatattagaaaagcatttttgaagagtatttgaatttgaaaagaaattctaaaaaatgtatgatatttgaataaaatagttttttataacaaacccttatatcttaaattcttatctaaatactatacatgagaaaagcctaccaaatcatgttttcatttgactgtaaataacccctcacaagatatacaaattatttttgatttgccaagcaagacacacacacacacaaacacacacacgtgagcacacacatgcacacaaacgaagagttttatcttctcaatatacatgcaaaatatatcctggtagttctgaattcaaatgtaaagacttttacaggtggattcattaaccattagagcctttcttcctaaagcaacctgaatttatattcagtagagcatctacagcctgacttatattcccagggagaactaagtctataatacataatcaagaattaaaagtgaatgttgtgccaattaaatatgggcctcatggaaaatactggagttgtaggagtgtctttccttcagcctgacagaatgtatgccattgtatgcttttcttcaggtttctaagtcttccttgatggttcttatatattttatgttttattatactcctgttattgcactactatgtttttaatattttagaaaccattttatttttgaaatgcactgtttcttctctttagtaatagctggatacttgctgctatatgccaagtattagtctggaggccaattctggcatgaaagtcaaaggacagatcatttcatgtaataacagaaaatgtagtatgtgtcatgattcattgatgtattaacactaaagaatttatctctagccattcatctaaattagaattgggactagaattagtacatatcttgatttgaggatcagggggctgaaagaaaaggtctagtgctcacgaatcctggagggtaacaccatgaaggcagctaaaactggtatgaaacatcagagccaccttggaaagcagagatggtaaaagcaaaaaggagagttttgaggaccatgaagggatctgagaaaacctaatctactctcttcacggtagatcaaaaccctcattttgcacaccattcctctcacctaaaagatcatacaatgctttgtagcaaccaaaacttgttttgaaagactagtagcacctgattgttttttatgcttttacaactatgcaataaacaacactggtgatgggagcaagctagcaaaatacaaattagatttcagtgaaacttttggcatcatccttccaggctttctaatgaaatgagctaggagagggtgggagacaaatgaagtccaaaatccctatatacccatatcatgttaagagagttatttttaaagggatgtataatcatctggccatcacttctaggcatttgcctgttaacataagaagagaacagtgggaagaaagagaaaatggaaaaagcagtaatctacattggataatactttaacatttcctatggtggtatggtcactaagtttctttcaacattaataagagatggtatgttggaaacaatctgtctgtccacaggcaaacatgtatgatttcatttatacttggaatgtaaagtagtcatatttatagaagcagtgagtagtaaggtggtggctaggggctgtgggagagggaacggggaagatgttggtcaaagtatagaaacttgcagttataaagtgggtaagttctagagacctaataatagcatgttgactgtaggtggagaaagatgtgatacttttccttcttgagcataaggatcagggtcaacgctcatataacaaaaggcaggttaacaataggaaagtataacaaatttatttaatcaaatttttatatgacacaggagccctcagaaattgatagtgacaggtggcagtcaaatgcctaggcagataggggcagatctcctgtgaaaccccacctccaagaggaagacagtttaaagcctgaaagctaagctacaagttaaatcctcacaggattgagaaccttcccttttggcaagccttcctgtgattgatcctcacctttcacctattttacatatacctaccctttcctaattggttttctacactgttgtgcccacctttgagtggtatcttcactttaaccttttttgcgtactcacaaaccagccagcatacactccccattctgagtctataaacaaccagggacccagccacacagggagaaaccacctgactgcgggggtgggggaacaaccccgtgcccctacatcccctctcctctgagagctgttccatcactcaataaaatcctctgctttcatcacccttcgatcctcagcatgaccttattcttcttggatgctggacaagagcttgggacccacagagcacgggtactctgaaaggctgttgcactggccttttgccctcactggtggatggcagaatccctgtatgatggggcaagaggccaactgagctgctaacatgccgccattcatcaagctgtggatggtggaactaaaagagctaattaacacagtaacaccccttctggggcttccgtatcatgtgctcccctgcctgggtgccgctgcatttccctcgatgtaacttacacacctggtctggctgtgggcccggcacagaggttgcttctgtgttggcacttggactggccagctgaacccccgcactcattgctcatgtgctccctcctgcaaggggctgagcatggctggccaagtagacaggatgcccctgctgcgtgtctggcaaaggggccaagaaaaatcatgcttcaaaatgaacatccaaagacccagggaaaacagtctgtttttatgcttaggtgcaatgaagaattaacagctgcatagaaatgtaattgtacaaaaagtatgatctagtggtaatagactgaggaaggaaacccaacaaggcctttccaaaattttcttggacaccctgtgtggcattccttccccgagggtatgaggcaggacccctctgaaattagggtcttcaaagagaaagcagaagggagatagtgacctttctaggtcttatgtcttgctctgggagagagcggttctagatcctatgacctgccttgagggtgaggaattatgtttgggagaaggagacaggggagcaggagaaagtcagagagacttgtttctgagactgtatctgaagccttccaacctccttttcttcaaattactcagcatgccaaaaccaccatactttggggtattgtgttctcagctccaactgtgactacagttaataataatatattgtatacttgaaatttgctaagagagtagatcttaagtgttctcacctcacacaaaaaagatggatatgttaactagcttgattgtggtgattatttcacaatatatgggtatataaaaacatcaaattgtataccttaagtatatccagattttatttgtcaattatacctcaataaagctgaaagagagaaagacagacagtaatggcacagagatacataacaaagactctggatactttggttcaactcccaggtataccactgattagttacatgaatgtcaacaatttacttaagttcttcatgccttagtttcttctcctctgtaaaacaggaaaaataacagcatctatatcaatcagatgtttctgagaatcagagaaaaaaatatatatatagtgtttgtagttacgattaataaaagagccatgtgttgctcagtagctattagaagacataaaaatgaaactgataatcacaagcaaaattctcattaatctcaaatactatacatagttttctcaaagatacaagtaagtggttgattttatatttgtatattctaaaccaacttccaaatagatttttttctaaggcttgctttatttacatattaaaagataaattttaattaacactgttgtttgcatgcaaagaatgttcttacatgattttttctaaatagttttctaatgtcagcagataaaatgaggtgaaaattgaagtcagtgtattaaaaaagagtgataaacattattgagcacttactaggcaagcccatttcatatatttttatttaatacctataaccaccctgaagggttaaatattatctatattttacaaataagaaacctgacatttggtaaggttaagtaaattatccaaggtcacacaaccagagaatgacataattaagtggcaagaccagctcggtcggggagaccctaacacagcagcgctagaggaattaaagacacacacacagaaatatagaggtgtgaagtgggaaatcaggggtctcacagccttcagagctgagagccccgaacagagatttatccacatatttattaagagcaaaccagtcattagcattgtttctatagatattaaattaactaaaagtatcccttacgggaaacgaagggatgggccaaattcaaggaataggttgggctagttaactgcagcaggagcatgtccttaaggcaccaatcactcatgctattgtttgtggcttaagaatgcctttaagcggttttctgccctgggcgggccaggtattccttgccctcattcccctaaacccacaaccttccagcgtgggcgttagggccattatgaacatgttacagtgctgcagagattttgtttatggccagtcttggggccagtttatggccagattttggggggcttgctcccaacaattaagagttgaagtcatgctgtccaattgcataaaatatatcattattttactttattttatttattatttctttgagacagagtcttgctctgtcacccaggctggagtgcagtggcacagccttggctcactgcaacctctgtctccatctcctgggttcaaacaattcttgggcttcagcctcccaagaagctgggactacaggcatgagccaccacacccggcccagggaaaacagtctgtttttatgcttaggtgcaatgaagaattaacagctgcatgcatagaaatgtaattgtatgaaaagcgtgatctagtggtaatagtctgaggaaggaaatccaacaaggcctttccaaaattttcttatgcatggaatgaaaatacgaatacttccaacattactagttgttatcccatcaaggggtggtagtgctatgaagccactagaagagcatgcagaagccagtaaatacatgattgatcttatatcctgtgtggcattccttccccacatatataaggcaggacccctctggagcaagggtcttcaaggagaagggagaagggagagagtgccccttctaggttttatggcttgactaacttttgttagtcaacttttgcatttttagtagagacagggtttcgccatgttggccagactggtctagaactcctggcctcaagaaattcacccacctcagcctcccaaagtgctgggattacaggtgtgagccaccacacccagccaagaagatctctcatgtatttagtgccctctacatgttctgttagtggcttcacagcactaccaccccttgatagcataacaactagtaatgttgggagtaatcatattttcattccatgcataagaaaattggggggttgaataaccagaccgaggtcccagaggcgggaggtgtctcagagtctgtcttgcacgtaatatggattataaaagcaatcatatgctgataatcgcctttgagttttaaaaagctatatttaaaaataaaatattacatatttctattatacataaattaaaattagattttgtgaaaaatgatactaagttgttacaataatattgttgaaaatcttgaaatagctgcacaccatttaagtggcaaaaatcaaaggatggcttgctcaggatataaaaagtaccttggcttatattcaagaacaaagaaaagtctcaaaaaagctctcattaaaaagaaaagtattttacacacaaaaatggtaactatgttaggtaatggatatgctgattagcttgattgtggtaattatttcactatatatatattaacacatcacattttacacactaaatatatacaattttggttaatcagacctcactaaagctggagaaaatagcatttcttgatttcttgatattttaaaaaatatttaacatttgttttgtaaaagcaataataaaattagcctattttaaaggaatcgtatttaaaaaaataaacctcattctcaaagttactattatggttatggtatattgccttaagaaaaagattaatggtaaaaatcaattaaaatatgtaatattggctttaccttgaaatgtttccaagggatattttaagaaaccattgaatatcaaattgtttgacttctgaatatgtttctttgaaacacaataacagttaaatagaaagttgaaaggtataagacatgcaattttgccattacaatgtggtggaaagcagaaatatcctgaccaaagttaaatgaaaatgcaaaattaaatggcaatacatttgcttggcatcactttttaaaaataaatggggcaagcagtgcttctccacacacataatattagaaatcaaattttggattaaattttccattttgaagatggcaattggcaacaaatatctttctgaaaagtatatcatttcagagagtggcagaatgatgactataaaaactatttttatcttgctttaatgtaggcctaacataagacctttattgtgctcacattaagcattttatttagacattaagcagaagttttctaatatcgtatatttacgaaagtggaataaaagcttgtttgccaattatttggatgaggctttcttgtgccaatgtcataatagatctttttctagtgtgctaacttctgaattgcaaatttttaggaggtgtcttagctataattcacagttgtgctgaactaaatgaatacagtcacttttcagcaagtaaagcacttacagctgctattgaacaaaaatacaaggtattgtttgattatgttaaaattgatcactgttacttattttctggagctaccagcttaaatgactatttgttactcttaagggtcatgaataataagagagaatttcagactattatgaatgtgcagggtaaagactaaatataccgatacaagtggaaaccacctttaacatgggttctcagcatttttttttaatgtggagtaaacaaagttaaaatcaccttggtaactgcatgaatctgagtccctgcagtgttctgtaatgtctaatgacttattgcaagtacatgcacatgaaaatatttttgttgtgtgacgttcagagataattttaggacatcaggccatgatcagtatattaaatacttataacttgaattttgttcttacatctaaagaaatcacaatttaataaatgatacttatggcatttccctgttgcacttcaatcaacatcgtaggcaacagaaagacagtctattacttgatgatccttcttcagtttatataatttcttgaggggtcacaaataaaatgtcactagtgaaccaagagaataattcaaaaattaaaagttcgcaatgttatctagaagtcactcataagagataattatgatgtcttatgtttaagttaaatccatggcagaagttcacagtgaggtaaattttgtttaaaataagttagtgccagccttttctggcaatatgctgaaaaggatgttcagagaatcttatcccagttaaatatatctgaaaattttacattcaacacacatgcatgcgcgcgcgcgcacacacacacacacacacacacacacacacacacacacacaaaaccactttttaaaatgtagggaactataaaagggtgaatccacaaaagtcagggagtactagagttgatattttctttggtgtatctgcaactctaccgtggcctggatggagtcttgatttttaagggctacatgtgggaatcatgagacaaaggttaaggtgaaaaccctcataacccatgtgggtctgagcccacaattcatattatacctgaggcctcaaaaaccctactgtaattatttagttgaaagtggtgctaacagctctggcagatacaaatgtaaatcttgtctggaagaaattacatatgagaatttctaataatgacaaactataaaaattacaaataaatggcctagtcagtcagcaaattaaagactattgaagagagacatagttagaaaaaaggagcatttggaaaaaaaatcagaattcaacacagaaacacaaagaaattaataaatataaaacagagataaaagacttaaggagatagactaaaatgatctaaatatatttaatctggattccaaaggaggaaatagaaaaatggaggagtgataatatcaaaaagataaaacgtgagaaatttccagaaacagggaaagacaccaattctcagattcaatagcctaattaatcccaattgtgtttgtgagtgtttgtgcttatatgtgtgtttgggagtgaaactgcaaaacaccaaaatcaaagagaaaatattttttttaaactataaagaaaatatggaaagaaagaacagttagattgaaatccaataaaagccacaatgcaaaccaaagagcagtggaatcatactgccaaagataaattatcaatttcaaattctatatccagtgagactacatttcaagaacaagggtaaaataaaaatattttcagacaaactaaaataaagacaatatgccaccaatataccttcactaaaagcacatttaaagaacatcctcaataaagaaagaaaaagtgtgaaattcaaaaaccatgttgagaaaaaaattggtgaacatgatgcttaatctagtctaaacgaacatgaaataaacaacagaaccgatatggaatttgtactatatataaagatgaaagtaaagccatggaaaataagagcgtgtaagtggcaggggactgattccctctttaccagatacctgataacaatactctatttcctgtgtttcaagatcttccttcacaactcctttgcccccacttttatgtagcattcctctgcacattgtccctcaggtgtcttaccaccctcacaaatccaaatagctgcttgttccctgtagctcccaaccgagatgtctagctcagtcttccacccagaatttcaattcaagattaacaagtgatggttggaaattttctcagccaaaatatcaaatggggaacatttcaaatcaaagacatatggccctcccagttatgtttttctttctcatttccctgcttctgtgtgcattacaacagctttcatatttatctggtttggaaacatcagtgaaagctttgactctatgaaccaaattctgtactcaagttttggtaatacgtgacactgatcgtcactttacttttcattgttgagacagaacaatgacagtaatatcctaactccactcatacttcttccccgtgccttacccaattaccacctctgctttaagccatcctatttaccaccaacaaagttataagactaaaccattgcttggatcacggcggcatgctatcagaaaagtatcaaagcctgaaaaacgtctatgaattaaagtctcaggttcttgttctggcatttacattcctttaccatttggcctcgcttacattaaagggagtgccctcagggaaaggatttcattgaagtggactgtgcagcggggccactgccctgacttgccaatatcaaactcaccacagttgtagctccagcagaaggcaatagagaagggccagctgtgggtttttaacctagtagccacgaacatccagaaggccaatgtatagaatttaaggggttgggaaaggctaaagaattggatcaaaaaataaaatttgtgttttcactaaattctaactgaaatgctttatttccttcaaatctgaatgtgggcaatgaatcccaagagtggtaagcatcaatgactatgtcaccagtaaacatcagaagtatttttatcatgtaacagtagtgtcatatgtattgagatatgcattactgtttcaatattgtagaaattataagactttttactgcatattgttttccaatgtgttaaggtgtgcatatattcctatgtcacacgtgcatttcatttttattttgacattatttcaaaattattggtttcctttgctatcttatgtatttttatttatataaaagtagtttattaatattctgataaacatatgtctataaatagatagatggatatttaggctgcgaaacaggtctgagtcagaaaatagctcaaaactgctacactgtacctagtgtgctatggaagtaggtaactgataacacaggaaagtggttctggaggtagacctacaagtttaaacacatatctgcttgttgttattaacttttttttttttttgctgggcatggtggctcaggtctgtaatcccagcactttgggaggctgatgcggcaggatcccttgagctcaggagtttgagaccagcctgggcaacatagtgagaccctgtatgtatcaaaaatacaaaaaaaaaaaaaaaaaaccttagtcgagtggggtggcatgtgcctctagtcccagctccttggagacttagactgaaggattgctagagcccacgagactgaggctacagtgggacatgattgtgccactacactccagcctaggtgaaagagtgacaccctgtctcaaaacaaaattgttctttttaaaggtatattatgcccttagagtagcagctggagaacatcaggctgattagtgtggcatcctcccatggaatttaaaattctcatgccagaggcacacaatttagacatatgggttccatctagattattaaaaagcaactagaacaaattattagaaaatgatatgcaggttataccaaattatacaaactttaattcttacatgtgcaaattaattttcttactattgcattaggagtttctgtattataaacatccatattttgtaacctctctaaattatgtttatgaatcatactatgttattgcaatcaaactaaatttaagaattgttgttactaatttacaagttaatcaattaggcctaatcatcttcatgtaaatattagtcttatgcaaaacaaacttcttcctaagcaaaataaaaatgattttccatattttactacttcatgtaaactaaagaccatagtactacatttctgcagtttgttacacactaattttgtaataatcaacagtcatattatctcttcaagttataatttttatgcagatcagagaggtcattttatggttattaaggaaagaatcttgactttcattatgtcttaaagcacgacatcattaacaaattgtttctgccatggccttaagaaaaatagacttcacacatagtatgtttccttgcttgttttgttttgcttcttttgtcagtaatataatgctatatttgtgaaatcggagtccatagtttcatgtctaggtcatcttatttaatactttttttcattttgtgaaatatgttggcaaaaaagacaattttaatctcaaaatataactgggtttttttatccttgttttaattctctttaatttaatggtatcaccttccttacgattgctcagtactattgccatttgtgcctcttttttctccttcatctcctcatacccaatcatcattaaatgtacctgtgatggatattgtcaggcaccaaccaggaactattcccccaggggctggggtcttgtgggaacatggcattcagctgtcaaccttctctcagtgtttcctcagctcaagaacactgcctctcccaagatcgtgagtcctcccaaacctaatcaacttccaatgactgtcaggggtataaaggattgactcatttgccccgactcaggataattctgaagggtcgtctagctatagcattccccatagggtcagctgaggtctctgttaggactgcatcacagctcaacatctccctttcccaattgtatttcacccttctccctgtcccatccatacacacgctagttgatactaatagcagttcctaataaatattttgcttgctaaactccatcttcgagactgctccccagggagcataaaatgtgatagaatggttctacctttttatttctcttgaaactgcctacctattttttattggtgaagtttagcctaccattaacttttttcttttttttcttttttttttttttttttgagatggtgtctctctcttgtcacccaggccggagtgcaatggcacaatctcagctcactgcaacctccacctcgcagaatcgcttgggctcaagtgattctcgtacctcagcctcccaagtagctgggattacaggcacacgccaccacacccagctaatttttgtattttcagtggagagttttgccaggttggccaggctagtcttgaactcttgacctcaggtgatctgcctgcctcagcctcccaaagtgctgggattacaggtgctaccattaactttcatttccactggccattcttaactttcattccacgccaaatgggctttcaaataaatgttcctcctacagacacatatgaattttgattggcacttcttgaaagcacacattgcaacatcaccctttttttaaaatttcccccacctatccaaataccgtgataatcactaaagcatatgctgttcacagcctgtatctcctccatagatgattagatgattcgcatgcttacaaatgttttcttgcatctctctgcctgaagctatttttttttttttttttggtcatgggagcatacttagcctgttgataccagaaatatgtggaagatataataaagtgtgtcctaagataactttccaaataaactatttgcactaaaattcttgtgtcagagtgtactttatggggaacccaaattaaggtgcttacattgataactgatgatctagaacaggggtcaacgggcctgcgtgtcatgtctggcctaccaacttttttttttttttttttttttggaaatcaagttttattgaaacagggccactcatgttcatttaggtactgtctatggctgctttcatgctatgaaagcacagttcagtagttgtaacagagaccatatggctcacaagcataaaatatttaccatctggacctttaccaaaaaattattgttacctgatctaaattattaccaaaagcgcctaaataatttcccagatttagatgtcttatctctccccacccatctgttttatatattacctccagattttttccctaaaaattgtttgatctatgcctcttgcttcctcagaaatagtcaatgactcccactacaataaaaagtaaaagaaaattctgccctgcaaaatctgcctgtatttctaaccgtatgtcactctgcattccccaccatatacacacactccaaacacacccatctattcattatttacagaaactgtcttctctgtgttttcgataaggttgttttctctgccgaaatgtcctctccaagcataataacttataaattccagctcatccttcaaggtccaaataaaaccaaatatctcttaggaatccctctcagacccctactgttggcattaatctcctcatcatgctacccagcaccgtgttcacatttttattacatcagagtgtaccctgtattgagataatttatgaatatctatttccacaaccagatacaaactcctggaaggaaggagccatatcatatccatctttgtatccagaggtaacacaaaattaacaagcatagattagagctctcacttatcggaaagactgaggtcctgaggcctcctgagatattaaccctttaggtgctgctggattgtttggaggcccatggagtccttggggaagggttgcagtggttagactggcaaaagttacactatagtaaaaacaactattacaatattttaacaaatagagcataaatgtttgaatgccagccttattaattactatgcttttcaaagttttcctaattatacgctttcagtaaataattgttgtatatataagaatataatttagaatgaacaccgttttcagcgacaccacagacacatacacataaacatacacaaatgtggaaatatagatacacatcttcgaccagaacaaatagggaattacatgagtgaaaattttatagtctagttttccttattatttctgattagttaacagattaagctgtaattgttaaaaaaaacaattacacttacagtgttttcaaacattgcacaagtcttcctatagtaatatcaataaaaatgaaattagcctttccttggctaattcaatttttccagagcataatggcaacattatttcaattctaagggaccactctggacagagctgtcatgatcatatcttgcaaatattttgcaaattaatgaggcttgcaaaacctctaatgtaaatgtaaccagcaacatttactctaatctactctcactttgcaatgcaccctgacttgcccttacttcccaaaatttattttaaaatctgccatacaaaaatggtttaaaagcacttatcttattgtaaatatgtcttgaaatgcacggtctaacaaatgttgagaaaaacaatccaaaaaagtttacacagaagaaaagcttatgaaatctaattattttattcttctgtttatttcaatgactcctggtccaggagctttttttaaggttgtcataagcattcctaatttaacaatgttctacacttcattgtgcctcttatggaataagcttgctagagctaaaatctaccaactttgtaaagcaaaaatattgaaaataacttgaagatttcagaagattttgtaactattatgacatttaaagtcaagcacaatagaagctgaggagtgagctggtgggctacttcaatcactgtaggttctgttatagtggcaatgaacaatggagttaagtagagcttcaactttatgacaagtttatgcctttctaaggttttctttctgcttgctattaacatctggattcagtttactatgcacttccttctttactaaggttctctacacctttcatgctaggtatggacctttctgtcaaagaatatttggttctcccattcagttctcattgagaacctattcagttcctcaattctctaatatcttccagctcatcacattcatcatgccatatttactgtgttcaaccttactcatcatatattccttgtcaaagatcagttggctttatttccaggttctctattctgtttcattggtctacatgcctttttgcatttcagtaccatgctgttttggtagctacagccttgtagtataatttgaagtcaggtaatgtgatgcctctagatttgttctttgtgcttagtactgctttagctctatgggacctttttttgataccatataaatttttggatcattctttctagttctgtgaagaatgatgatattttgatgagaattgccttgaatcttcagattgctctgggcagtatggtcatttttgcaatattgattctacccatctatgagcatgggatgtgtttccatttgtttgtgtcatctataatttccttcaacaatatgttgtagttttccttgtagagatctttcacctccttggctaaggatatgcctgagcattttattattttttgcagctgttgtacaagagaccgagttcttgatttgagtctcattttggtcgttgttgatgtacattgattgtgttctgatactttactgaatttcatttatcaagtctaggagtttttcggataagtctttagggttttctagttctatgatcatatcattggcaaacagcaacagtttgacttcctctttaccaatttgaatgccctttattactttctcttgtctgattgctctggctaggacttccagaactatgttgaatagaagcggtgaaagtgggcattcttgttttgtcccagttctcagggggaatgctaacatttccccattcagtatgatgctggctgtgagttcatcatagatggcttttattaattggagatgtatctcttctatgccaatttgttgagggtttttgtcataaagtgttgctggattttataaaatgcttttgctgcatctatcgagatgatcatatgtttttaattttgtttatgtggtgtaccacatttactgacttgcatatgttaaaccatccctgcacctctggtataaaacccaattgatcatgatgtattatctttttaaaagttgcatatatcttaataagttgttttatttattgtttctaatagctttgtctgttagtcttctaagcaaatatataatttatgctgcataaaatatcgttataacaattatgttaccatcctatttcagtttaaaggactcattttaatatttgtataggactcatacattccttcagaattttttgtcggagggagggtctggaaagtctttatctctcttcatttctgaaggatttgctacagtgacagattgcttttactttttcttcagcatcctgaatatatcatctcactccttttcagtctgtaagatttctactgagaagtctactgccagatgtattggatttcccatgtgttatttgtttcttcctttcattgctttcaggatcctttttttgtctttgagtcatatttttgagagtatcactataccatgccttggggtattcttatttgggttgaatctaattggtgacctttgacttccctatacctggatacttatatctttctcgaggtttaaaaagttttcggttatttctttgaataagctttctattctcctttgtctttctcagttccccctttaactccagttacccaaatatttgctcttttgttgtacaatagatcccataagctctgtttctttcttttaatttttctttctttattcttctctatgtattttcaaatattcgatctttgagtacagtgattttttcttctgtttgatcaattctactattgatgctgtctattgcatttttattacagtcactgtacttttcagctccatgatttgtttttttaaattacttgaatctctccacaattaataattgaattatttaattctatgataaatttctgaatttattaagaatgctttcttgaagttcattgagcttccttaaaacagctattttgaatttttttttatctgagatattgcatatctccatcactttagagttgctctctgccaccttattttgtttggtggtcatatttccttgtatgttcttgatgcttgtggccatgcaatgaagtctacgcattaaaggattaggtgtttagtcatcacagtctggctttgtttgtgcctatttttcttcagagggtcttccagggactcaaagcagattgatgagttccttgagcctgtgactgctatagccatctcagcattagaggatactctgagcccaggctaatcacaattctcacaagaactccatggttgacaaagattttcaacccagatggacctggggaaggtctaagaagggcactggggctgtgtgggaatgctggccagggatatgagttcaaaagaaacacagtggcccagacaagggtgcctcccaaaaggtctctgcacaggtagaattggtccccaacttcagcaagagaggctttagttgagactgggacctctcaggatctgctgtgagaaggaggcttgtggacctttctcattggctcagatgagcttgcatcacccatcaggtctttgcacaagtggggtagttcttcaactgcagcaggttgagccagagctgagacttgtgctcttcagaatctactgtaggaaagaggttggtgtgcctatcactttggctaagatgggtgcatgtctcccagcaggtccccgaacaaatgagatagttctttgactgcagcaagagaggccaatcctaagactaccctcccttgggatcttctgtagggcagaatctggagagccctatctcattggttaagaggggcatgcatctcccaacgtgtccttgagcagaagggatagtttgctgattgcagcaggaagggctagagctagtgtctctcaggatctgctgtgggttggaggttagaagagcccatcttgctgatctaggcaagaacacatctcccagcaggtctcaggacagacaagatagttccccaattgcagtgagggggccagagccgagactgggacccctcaggatctgatgtggaatggggaatggaaagccaagtcttgttgtctcagaggggcatgcatctcccaagtggaccctgcacaaatgggataggtccccaattaaagcaggagaagctggggccaagattgtgtccccaagggatctgctgtgggacagaagttggcaagattatcaaggaagctcagactccagagctgcgagatatgggaaagtctccctttgtgtccttgtgtgaaccagtcaagtctgactgggtacttcagctgagcgggactgaagctgagctatgggtcaactttcaggttcgctgctgagaccaatgtcaacagacagataagcctttccacacacaaggcatgagtgtgcacaattccatctgaacatttagaaaatggttttagttgcaggctcgagaccaaacaggtgatgtagccaagcttcttgaaggattggtacttttctgggcttgaatcctggagcaaagtcagtggatcagacacctgtatattggtctatactctcaacacagccctccaagattttggaccccatgaaggtttcacaaactcatacctgaaaattgatgctcccacagagagaattttgactgtggatgggcatagaattcttattgttgtgagaagatatgagtggattaatgtctactctgccatcttggtgacatcactctaatactttacaatgttagctattactttaagtgttttttaagtttgtgtttggctgtagtaatgtggtaatatggacttgtagtaatgtggtaatatggatactacacaagcttaatatatggaatatgaaaacaaattattactttcttagtaatttaaaaaaatgcttcttttagtcaagtagagctaaaagtggaacccagtcttttaatgcatattcctgtgtattttgtacctttttccatcccagcaacaccatcagcagaaaaatggagggaaaggtcagcagtaaaatgatgtgcatactatgaaccacaacataaagaccaaaaccatccttcaacatgcataaaaagtcataggaacaaagagtgaaaaataagtagaaaaatttagtgccaattaagatgttgaaaaacaagttcacagatataaatagtttcagtatattcagtagatagaaataattcaaaataatgtaggagtactcaatgtgttaaattaaaggaaatgattatgtaaatttaagtttccataatccccaattgagccagatacatgaacaattgtgcaatattcagatatacaaatggcacctcagacttactttataattttactgaagaatggtattttactatacttatatgcatataccagggtcttacatctgtaataacaatttctatactgaacattatgtttctggatattttaatgtacgtgttacattttgacttaatttttttcagttagactttaatttgcttgggatactgtcctatacatggctcaatactccaatttcctatatcaggtaacttataagaatagttcaggtttcctagtacagaggaagcattcagtaaattgaacagatttcctaagtttactactgcattcaattaatgaggaaaaataactttcacacatgatagtcataaaactaacacatgatatagattctcatataattacacaattttaaacaattttcaaaatgtaagactggatttccaaaaactgttaacagtttgtttaaattctgctgtctccttgtattctgaaaaattgctagaagtgtagattttaagtgttcttaccacaaaaaatgataattatatatgtaaagttatatatatattaattagcttgatttagccattccacaatgaatacattcttcaaaacatgttgtacatgataaatatataacatttgtatttgacaattaaaataagtaaattagtaaaaatgttatcaagtatattcgaatttaaaaaattctataatcttctttgttaggagccttacctcctcctttagctacctctacttacacctttgctatcttcatgctgactctacctatgctcatggataatatctcatgctctgagcttttttgactctattaaaggttaccagactttggtctcaattcctaaggctttttctagattatatattcaattatttatttcattactcaaagtagttaacccactaacctttctgaatgccagcaatgcattaatccacataaaagacaggcattttaagatctattgaagccagatggagataggcttctagaaagacacttcagcaacactgacgtaacgccatataagcagctatctacttaaaagcagctgtaaagataatggctggaaggaagaaacttagtcaatatttccactggcaatttccatttaggtactggagcatgagcattcctgaaaaacatttgttatatttctttattaaactttaagataaaaatttgcagctattattggaatattctgagtcagctcaaccattgatacttgggggaaaaccactctgtaaaactaagactaagagacagtaagtatattatttcaaatcatttaactctccaaagttagtgctttaaaatctttacattaaatcaagtacagcatagtattatttctcgtatgcttaggccatttctttttactcggatgaattaataataacagcaacaacgataacaaatttaataataatttatcatatgccggaaactggcttaaaggtgttaaacatatcatcacacagccttcattgaacaatacctgtctcaaaataaagaaattgaggtctaaagtaattaaataactcatcctatgtgaggaggctgatgagcattggtgctagggtttgaatctttgcttatttatgctatagtttactctctgagaagcaaaaggaaacttcctgctgccagtttttatgaagttttcttcttgtttgctctctcattacattataaatatgatccaaagttaaaatgagaacaattgcattactaatatttctaccttattaggtttcagacattaggttcaactatatttgaaataagttattttgttttttcataaggtcaagattaattaccagttaatttaaaaattattactttatctacttttgtcaagcaaactgttatacctattgggagatacatgtaccatttttttggacataattgcaattaaacaagttacctttaagcaacattcatgagtatattttcagtatattttcctgtattcaattttgtccaaatagagaaatataggaaacattgaacatcagtgccacactaaaattcagctttaatatgtggatttcattttgtagaatacatttttgttgttacgaaatttatcgtgctgtggtattgtcctctgttcaaaaatgaggtttttagggttgcttattgcataatgtatattaattcttcattctaaagtaaaatcacacaatgagatcaaacgttttgagttcataatatgcaatgaataattgtaaaataaatctatactttagtattaaggcaaaactaaatgtttgccacgaatgacttaatacaaggacatctatgcattgtgcatttcttagcaacaaaggctatgaatgggtaaaggtaaagtttgaatgtatccctatcataacatggggaaaactgtatgcaactaggcatgggagtggattcagtagattcccaagatagtgctgagaacagctgacgtttacagctacaaatatcgctgtgagactgctagcttaaaacaaacatcacttgggtgttggagaggagaggggtgtttataatctgtagtctatattttaaaatgtgggtttctaaaaaaggatatgtgagtgtctgaatatcttttaagataaataagaaggcaagaagtcataaggctaagcagtgagtaaaaaaaaaattgggacaatgcagggtagtcacaagatattaggaagaatcaatagaagtggacacacttggtttcaattctggcactgccaattatgtcctacttagccttaagcaagtttactaaatctccgagatccagtttctttctgtgtaaaatgacattaacaatttcttcatctggagaaacctagggattaaatgaaatttgagagagaaagggaaaaagagaaagacttaaaagacatgtcaaatagacaaaacctatcaatcttatttagatccttatccaaacaaagatgcttagacacagcaaacacacacacacacacacacacacacacacacacacacactaacagaaaatcagagaaatatgaataccacctgaatatttgatgatactaaggaataattatagaatatctttaattttgatggtatcatggccttgtcaaaataaaaggatgattctttttagagacagtaaacaatgaataaaaccatgtgatgattgggattcatatcaaaataatcctgatatttgattattttagccctgtaccattgaaggtaggtgaagggcatagagagaatgatactataattttatctctgtgagtgtatatactttatatcttcctaatgaaaaggtttaaaaatctatataatcatgggaaatatttcttaatccttgataatccttgttatagactgaattatgtcccccccaaaatatatatgttgaacttctaacctccactgcttcaaaatatgactgtatttggcaatagcgcctttaaggaggtaactaaggtaaaatgaggtcatatgagtgagccctaaaccaatataaatggtgtccttataaaaaaaaacaaaaaaaaaggagattagagcacacaaagggaagactgtcaggacacagcctgaaggtagccatcttcaagccaaggaaaggggcctgagaaaaaatcaaatctgccaacactttgagtgggtttgaatttctagcctccagaattgtgagaaaataaatttttgttgtttaagtcactcaaaagtaaagaaaactatgccaccaagtcagggatgctaacaactgtcaagcaaagacaaatgtggacttaggtaaagagaacatttattcaagaaaagtatctttctctctatgcccttcacctaccttcaaaggtacagggctaaaataatcaaatatcagcattattttgatatgaatcccaatcatcacatggttttattcatagtttactgtctctaaaacaaaagaatcatccttttattttgacaagcagtgagtaaaaacataaaaattgggacaaaaaaagtattttaaaagagtattaaaatcactccaaagtaaggaaaactacccaccaagtcagggatgctaactgtcaagcaaaaacaaatgtagacttaggtaaacagaaaacttattcaagaaaagtattaaaataaggagaatgttctgatgttaaaatctgcatgcatctaaatatcagactgaaaaatgcttttcttttataggaaggagtaagcagagatagcaggaatttaagaagggaaattgagtgaatgagtagaagcaagcagacagcaggatcagggctgtcggtttctcactgtggcgagccaattctcaggatgagcttttaacaggcagtgttctgcagtgttaacatttgctcagatttggaggcaagccagagttcagaagcctgtgtaaaggagagaaatttgactaaaggttggtcaagtgaaggcagaggataagtaatgggcaattgtgaacacctggtcacaatcttatcaggtaatactgaatttattaaaggtctaatctatatcttaataatggagattagaaatgatgcagtgaggactacatgagataacatacattaggaacttaatcctttgcctagcatttaccaggcacttaaaagatgcatttaaatggagagggaacactctttgagagcagttgattgtgatcccaaagtttcatgtgcatacaaatcacctggagatcttgtgaaaatgcagatttttactcaagagtttatgaaaggaaatagaatctggggacttcaaactcactatgcctaagggaaagttaagcttgagaagtgaatcacacaacaaactgccttccttttgttcccagatagctgtaatttcacaagcctgtgtcataggctcaaacctaagccagttcccctcaataatagaaggccacttatctccccagaaggcttccctcacaaaattcaagaggaaattacttgttggcccctaaatctttcaggaaaactgagttctgttcaatctcatcctgacaatattaattacaagctaatcttcacaggtatgggacaaggataaggccagaaatatccctctctctacccccagacaaatgaataattgactttttctctactccctcttttcacatgtaaaatgtagattcactgagcgctaatcagagcctcatggcttaaatgtaaacacttgcctcatggcctatcctcctacctcttttttcctccccttctgcttgctctttcccctttaaatattgaagttcgaaaaatgctcttaagtaaaaccacaggtcacagacccttccgtgacttctgtttctttttcctgggtgcatcctcaaccttggctaaataaacctctaattgagacctacctcagtaattttttggtgtacaaggtctaggatggaacccagacttgagaagaccaataaaactgagggctaaaaatttggggtttagttacatagtgtagaatcttttctttttttttaatctagctaatgcaggacataatggagaatctcacaactgaattggattttgataggaatacaaataactatcggaaaaccaaaggggataaatccagctttgaatttggaattgtagctagtttgacaagtctcacaatattaaaacaatattaaatgcatgattgagaaattactccacagatacctttgagcacccgatatatgtttacatggtagataagtaaatatgctaattaatgtatattttaaaatattagaaataccttatataataactgaaatgacagaaattaaaaatttaataatgaaacagttatttcctattatgaggtcaatttgtttctagttttatcaccactttcaaaaaattaaaatctgtttattatacaattcatttggtgttttttctaggataaacttccctagaatattattaagatcctctgttatcttctgttcatgcggaaaaattaaacatgaaaaagtttgaacattttaaattggttttaattaaaagccatatactcctagaaataaatagtatagtgcataagattgtcatatagtacttgtttctaaacagctatgtactctgaaaaaattttgaagcaagcaattttaatttgtttttgttgttttactagaaatacattgtagaaaccaataaaaagatgaattattttccaagataattagagggcaaatagtttaacaaaccagagaccgaacaaaacaagatacaatttttttgtttcatttaaatttcttggcatccatatatttgtttaaaattgagttgcttcctccaaatgtagtatttataaggatttgggtgtggtgagtataagattattattttcgtcttctgtgtggtgcctgaatgaaacctgaaatagagcttgccaactcaatgcaaatgaatacaaccacatgggagtcagtttaaagtagtaaactgctatttggtagaatattgtgctctaatgtaaattataaacaacctcccagccattgattggtgcatttttgttaaaatatcaggaactaaccattcaattccatttcatttcatattttcacacagatagcatattcttttggactcagaaaagcaacaggccgagtactttgaactgaagaagcagccttagaaccagtctttctgatctccttccctcccatctcttacctctcttcctctccggaagcacaggcagggcctttctctgaagtttctttatcgaactcaggtaaattcctccagaaggattgtgatatggttaggctttgtgtcaccacccaaatctcatcttgaattgtaatccgcataatccctataatgcccacatgtcaagggagagaccaggtggaggtaattaaatcatgggggcagtttcccccatgctgttcttgcgatagtgatgagttctcacaaaatcttatgggtttataaggggctcttccccctttgctgggcacttctttttcctgccagcttgtgaagaaggtgccttgctttcccttcaacttccaccatgattgtaaatttcatgaggcctccacagccatgtggaactgtgagtcagttaaacctttttcctttataaattaccctgtcttgggcagttcttcagagcagtatgaaaacagacgaatacacgctgcaattgttttgggccccctcccaataatctcatcacacagagatgattaactcacatgaaagaatatttagagtggacaccacatccagaacccagaggaactttgtcttaggctattgcttctttttccagcccatttatctctcccaaaaatcatttattctttctctaaaactgtctacatctccaaactttcctcttccctatgatgaaggtatttaaatttcaaccatatggcccttctttgtttttcatattttgtatgacttctctgcacttgcatgttaatacatttatatgccttttcttctgttaatctgtctctgtcagtttatttcagcagactgaattgttgaaccttcagaggaaaatttaaacttttccacaattatcacttcttttcttttttctttctttcttttttttttttttaagagacaggcttttactttgttgcctgtaggaggttggtcagggtagtgggtaaaagttatagggaaagatgcaaaccttcttggaaggctgagaggttttgcaaaagctttgaaagaggatttggctgaaggcccccaaattctcttatctggagcctgagagcaaagggtatataacaagggaatgtaaaggagcttatctagataaatttatttagtcctgtctccagaaaccaacttttgatcattcgcatgcaggactgctctctactcaggggtcaacaatgtttattacccacaaattgtgtttgctccaagcctttgtcattaaatctgtactaagtaaatgtgagcagggctggcttatgggggctgcactctctcggtggctgcagcactctcggcggcggtgctgagccgtgaggtcccgtagccatgctgtcaggcaagatacctgtgtcagtgtacttctttcatctgtcgctcagccagtctgtgggacagactcggcaactgcccaagctggagtgcagtggtgtgattattgctcactacaaccttgaccttctgtgctcaggtgatctttccacctcaatctccctagtaactgggactacaggcacttgccacaatacccacctaatttcatactttctgtagagatgaggcttcactatgttgcccaagctggtcttgaactccagggctcaaatggtcttctcatctcagcctcccaaagtgctgtgattacaggtatgatccactgtgcccagcctcattttttaaaaatatattcaactttcattttcagtgtatgtgtacatatatacttaatatatttgaaaattatgcctattttgcttatgtaaaaaaattaggagatcattttttcttggaataaaatctgatctagtaaggaatggtaattcaggaaatgaccactatgaagtagtgaagcccctttccataccaaatctaaagattgtgaccaggtaaataaaattctctgacccatgactgacacttaccattgtgaggtattctaataatcaattcaatgagtttctttctgcttctggttttacattttccagtaagaatgcttaaatggaattatattttttagaaaaatgacaaagatgttgtaaattctaagaaaccctccaagaaaacattttattcattgtatgtctagtcaaatgcaatccccaattggagagttgcatttaacactagaagaagatttgctgttaatgactcagaaaaaaagagaaataaacataatattgggagaaaaaaacaaatcccaactcagccagtaatttgttgggtaacctggaacaagtcaggaatgccttctagatacatatatcttgaatcataaaacatggcattgacctatacagataatcttcatattcacaatttctatttattttcctatcttgagcctacatcttgccaggttttgtaatttatttgtttgaattgactggacaatattatatgattgtattagttcattttcatgctgctgataaagacatacctgagactgggaagaaaaagaggtttaattgtacttacactttcacatggctgggaggcctcagaatcaaggcggaaggtgaaaggcacttcttacgtggtggcagcaagagaaaatgagggagatgcaagagtggaaacccctgataaaaccgtcagatctcgtgagacttacccgctgccacgagaacacgatgggagaaaccacccccatgattcaaattaactcccactgggtccctcccacaacacgtggaaattatagtagcacaattcaagatgagatttgcatggggacacagagaaaaaccattatcaatgattttgatggctaaacgggcatatttgagctaaagtaaaattacaaaatgttaaatttcatggactagagagatcattaatcattgtagattattatttgactttaccataattataatgtgaacctgatcaataagaataatcacttttctttttagttatggttttgcatggatcatttgtaataattaagtcagagagatgagctgaaagattcagtgagggtgagaagaaggctcgtaaaaagatttttatgcctacgctgaaaagttcagccatctttaacacattcttaacacagtctcaagcataagcttgagagattattccagatacaatttgggagagcaatatatactatggcatgaaatataaatggattacttaataaacatatatggtatgctgtgtgacatcttcttgttatgtatcaggaagtgttactttccacaggttcttagggtcccatgcaatagaaattgacatgaggccaagtcatgtatttgctattgtttcccatgcaagactttactagaggtttatgtttaaacacaagagaaacagcactagagggaaggttcttctgctggcttcctgacaggagtgcattgtggtgccttgagaatgacatgtataaatcatgatgtaggtgagagtcactacatgtgtgaggtggagtgcagggtgcacaggtgtaataagaaatcatgctaacacatacatcacatgatcagaaaatggcagataagcccctccctggatgggaagtttagtgttaaaatgaagcaaggagcaaagatccgtcattcttctaagtcttgtgcgcatacatgcaataaaattaacttccttgagtaagatttattataagttgaatgctgcttatcttagtttaaggtcccgtgatcagtgggtatggcgacttgagtaagattcatagtttcttcaaggtcttgtggttagtgggtaagaaagaaaaagaaacaaaatgcattagtcgggggagggggagggatgacttccatccctactctgtctcagaagctatgcctaaacttgagaagttattctgacagtgaaattaacattatcttcaccccttcattacccttttttttttcaacttttattttaggcttgggggtacatatgctggtttgttacgtgggtaaattgcatttaattgaggttttgtgtatgaatgatctcatcacacaagtattgagcattttggccgggcacgatggctcacgcctgtaatcccagcactttgggaggccgagacgggcggatcacgaggtcaggagatcgagaccatcctggctaacacggtgaaaccccgtctctactaaaaatacaaaaaaattggccgggcgtgctggcgggcgcctgtagtcccagctactcgggaggctgaggcagtagaatggcgtgaatccgggagacggagcttgcagtgagccaagatcgcgccactgcactccagcctgcgtgacagagtgagactccgtctcaaaaaaaaaaaaaaaaaacaagtattgagcatattatatgagagtttttcaacccttaccctcctcctgcctctagtagtcaccagtgtctattgttcctgtctttatgtccatgtgtactcaatgtttagcttccacttgtaagtgagaacatgtgggtatttatttttctgtttctgcgttagttcactccagctgcaaccatgttgctgcaaaagacatgatttcactcttttttatgactacatagtattctgtgatgtatatgtaccacattttctttatacaatctgcctttgatgagcatctaagttgattctatatatttgctattgtgaatagtggtgcaattaacatatgagtgcatgtgtcttttcagtagtttggagatttctcaaagaatttaaaacagaactaccattggactggcaatcccattattgggtatatacccattatcatatttctcaagagaaagcttttatttaaaaaactgctgccaatttactctgcgagtaaatgaaaatttgcttcccttcaagtgtaaatatgacctaaactgtcattattaataatattgatctttacaaacagtttcatctttacaattttctcttccaccttccttcttctttatcttctttcctccatatccaaaatcatcacctcattttttgccattgactcacatctttcttgctgtttctactgttaaaaattaaacagtggtccttgtcattccttaccagaattacagaaagaaaatcacagatagaatagagtggtgttgtgtgacattatgtaatagaatgtgcgaccttactggtctgtctttctgcctccaatttctgtctccgacccctaaactactgtctactttggcttcagaattactttctaaaacgaagatggtatcagagaatgtctacgatcaataccttccattgtgtttccgtgtttaatagtattagtaataataaaactatgttatacaacttgaaacgtattcctctccaaaatcagtctgactcatacatccatccctctgtcactttccacaaaccattctcagattcagccattcaaaagtctgtgaatttttgtgcttggctgttttccttatgtacttaaaatcatttccccagcatacctctcccttccctaacctctttgttttattggcaaatttctactcatccttcttgactaacttcctctattaatcagttatctctctctctctgcaatcatatagaaatgcatttttccctctattctagaaattgtcatggtctatctgtgttacagaaattagtggacagatttcaggacactgtgtacattagcaaagactacgctttgcaaagtgtcatataattgagggcaaggttgttccagcataagattgcatccactgaaggaaggaatacattattataatttttaccgttgtgacatatgctcagtaaggttttcttatgcacatgaagggagcacctacttcaaatttaccgtctctgtgtgagctgggccagccctatgcaatcttgcttcctcctctggaatgtgattcccttgaatgcagaaattaaactgtgttggaggactgaatagaataaaactgtaattatgttattgagaattcactttaaaggtgacaaagtttatgtattcttattgcagtaaaaatacataaagtgagatctactctcttaacacattttaaattagacagtacaatattgttaactatagacacagtgttatatagcagatctctggagctttctcaaattgcataattaaaactttatacccattgaatagcagcttcccatttccccctccttgagcccctgattgtactttctgcttctaggaatttgactagtttacatacctcatatagatggagtaatacaatatttgtctttctgtgactggcttattttcagtaacaataatatcctccaggttcaaccgtgttgtccccttgttcactgatagtctgaggaaatgcactgatttttatgtattgatttagtgttctgcaaccttattgaatttgttcattagtttaatttttgtggtatctttaaggtgttttacatataacatcatgttatctgcaaacagataattttacttcttccttttctatttggatccctaaaagggatttttctttttcttgacaaatcattctgcctaggacttcagtactgtgttgaataaaagtggcaagagtacgtaatcttaggataaaatattttagttttttaccatcaagtatgatgttagcttttagcttttcatatatggctttcattgtgttaaggtaatttccttatattcatagtttttgtatcatgaaagggtttttatatttggcacatgctttttctgcatctattgagatgatcatgtgattttttttcatccttcattctgatagtctctctccatattctacctttcgttttaaaaagtgagatggtccataatgttaacatggatgtggaaaaacatgaaattactcttcaaattacagaaaaacagtaattacttccttcgtctattacatggtatttgagatggtacccttggtgctaaaatgctggcacccttggcatgtggaatctttacaggctaactggtaatgccattgataaggaacccagaggagacctttaagaatacaaagttatcattttccaattttcttctaattatatctcttgaaaaaattgcagtgtttattgtaggataaaggtttcacagtattaggagaaagaagtgtgagtaaaactggacaaggctctgcagtgtgtaaggggctcaaattatgtgtaactttatgaacatttaccatattgatggagacttccgatttcatacaactcgcacccggtttgccagtgggcatcatgaggtcaatacatgtttccaaatgttcatgaaacagatgggttttcaacttctgtatgtgacccaggatatgaaggggtttatggggaggagcttagctatgaaaaaaaaaagagcagtaataacaaattgaattaaagtcacagggcaaatggaatgaggctatcattaaaaatgatgaaggaaaaaagataataatacccaatctcttcagttaaaaaagaactttcataaaacccaaattagttgcctaaatgtaaaattacatttacaaattcagcaaaatataaaagtttaatttttcactttcatattcaataaaattaaacaaaatattatttttaaacaccacgtattaattatgattaaatggttatacattgatggttgaatatttggaaatatacataatatatattgctagcaggatgtctgcattagcagagacaaaaatctcaagagactaagagacgatgaaagaagtaacattgcaaagaatcagtctagtgccctggattttttcatacaattatatgggagatggctagagtgactttcaatatatttcacaactggtatgacatagcttcacattaaattgttgtagacaataaatcaacaagaaggccttgcagggtcttctacttgggaatgagcatgcttgccctcccaactttagtttgacatggcaaggctgaaactccttttagtatgtagagctctagtgtgggactggacaaatttgcataagttattcagggatactaaatcacatcctggctttttaaagtcagcaattcctggactatcatctgaattgcttctgacgtaggtttgcagacagaaaaggacaacaaaggcctgtaagatgaatcgtccagaggaagaggatatctaagttgtctcaataaaagtctaagggttggtaggggaggactgattatatactacacaagtagctgcaactagaagccaatctcaacccagccctagatcaaaaggttttacttgatgctcttgcctcccctatacagatcagctcagtaacatctgctgatttcttatgtgggaactcaggaatatacataccagatgttcacatgctgggtatcacagtgaagatagagcccagggttgtgtcaatacagtgatgtgcactttacagtgtttatgtgctttgaatggggtccagtaacctctccttgcagaaggtgcatttcctcggggactgagtcatgattctgctcccccattcaatctgccaccattcacatgagagcagacacttctttagatttctgacatttgataggatgtatttttaaggcttttgtagcttttcccctattctgagaatttctatgaatcttgccatatttttaaagaactgtttatattttcaaagagcttttacataaagcatttcaattttacttaaaagttcaaatggagcagccaaaatgaaacaactagtcttttcttgatggcagtgttagtcaaatgtttcggttttatacatgtaaagctgccaaatggaggcttaattacagcattcaacaggtgattcttaatggcaaatcaggcctcacacatttaattaagaacagctgtcaactaggtggcttgacattatctattgtgcataattgcatttttcaatatacttggaaatataattaaatgcacagtttaattgatgcattcccccatataaattattgcaaactgtgtaatctattacattgaaggcattatttcacatttgacagcagtataatttcatgacttttgctctttgctaatactttttcttacaaaacaaagtatatgtaaaaaagtagtgacttaataaatatgaatgatagattaagtgctgttatattttgattaattgatataaaaactacagagtcacagaaatggaaaaccaaacatcatatgttctcactcataagtgggagctaaactatgagtatgcaaaggcataagaatgacacaatagactttggggactcagagggaaagggtgggaaggggctcagggataaaagactacaaattaggttcagtatatactgctcaggtgacagatggaccaaaatctcacaaatcaccgctaaagaacttactcatataacaaaataccacctgttccccaaaaacccatggaagtaaaaaatgttaaaaaactccacagtcaaatattaatattccaatagtccaattcaaagaatgaaattttcttccttactatggtattgagaattaagcttagtatttttttctaaggctataaattaatattacaaagggattcaaaagctttagatcaaactactgttcacattataattaccaattttcacatattcagaggaattaatttaaatcaaacatttctttaatggagaataaaaaatatttagtattaatgtaaaacagcatttttcatgagtggtaatttaagtgtaaaatcaaactccacatatataatatgatacaagatttttcatgtacaaatgaactcatagacaacaggtaagtacaatacctctttcaagttactattatttcattacacatgcatttaaaatagcgtaaatatatttgatacattttagtctgtatcctgtgcaccttgtcagataaaaaaaatcagtgcctttctgaaagagagtaactctataaaaccttccttttagagttgctctgtcctccattgctgtatttgaagaatcaaactgccttgaatcccaaagccataagcaaatgaattattttaacacgaaggaggttgaaagcagattcttccttccttgagcctttgagaagaacacagcccaggtcaatcccttgattgaagagttataagatcttaagcaggccgggtgcagttgctcacgcctgtaatcccagcactttgggaggccgaggtgggtggatcacgaggtcaggagttcaagaccagcctggccaagatgatgaaaccccatctctactaaaaatacaaaaaaattagtcgggcgtgctggcggtgcctgtaatcccagctacttcggaggctgaggcagagaattgcttgaacctgggaggcggaggttgcagtgagccgagattgcgcactgcactccagcctgggcaacagagcaagagtctgtctcaaaaaaacaaacaaacaaacaaacaaaaaaacaccttaagcagaggatccattccagttgtgtccgcactcctgacccatgaaaacagtgagataataaatgtgtattgtttgtagctgctaaatttatggtaatttgttatgcaataatagaaaactaatatgcataggctcccaacaaagccaggatgcccaccctttgatatcatggcacttctgggtgtagtcataaaatttgctcacagctagtgtaagtctttgtttatctttaaggttatgttctttgtttagcaacttgaggactgagatttttatctacatttctagattctgtcagagtgcttggcaccgaataggtgctcaatattgtttgctgtcagatattaaccgctatagtgggataaattaattttttttttttttttggaacggagtgtcactctgttgccaggctggagtgcagtggcatgatctcagctcactgcagcctctgtctcccgggttcaagtgattcttctgcctcagcctcctaagtagctgggactacaggtgagcaccactatgcccagctaatttttgcattttagtagagacagggtttcaccatgttagccaggatagtctcgatctcttgaccttgtgatctgcccacctcggcctcccaaagtgctgggattacaggcgtaagccactgcgcccggcctagattaacattcttactgagaccatcaggacagtgaagtgatagcaaggtattgaaaatgcggtctataaaaaaagaaacaggctgagcgaagtggctcatgcctgtaatcccagcacttgggaggctgaagtgggcagattacttgagcccaggagttcgagaccagcttggaccacatggcgaaaactctgtctctacaaagaataaaaaattagctggatgtggtgatgtgctacttggtggggggctgaagtgggaggatcatttgagcccaggagtttgaggctggagtaaacagtgattatgcccctgcactccaacctgggcaacagagagagaccttgtctcaaaacaaacaaacaaacaaaaaggagcaaaagaaaaataaaaagcaaaaagaaataaattggggtctgaaaaggatagttgtcaccaatatacatcttagaatttgggtctattctgttgaactgaaaaaaaacaaaacaaaaccaaaaaaaacaccaaaaaaagaaaacccagcatccatgtgctagatattacttcaacatgatgggaataattatataaacacaacagaaaattttagttttattgctttttaggcaactttttgatattccactgtaatgagaagaatggagaaaaatgaacaactcttcagaatgtatatgaggttaagtacaactacatgagactgcaaaacaaaaagcgggggatggggagccagtttatatttacagacacatcttaagtaccttaaaataacatgaaatctttttgttgtgataaaatacagacaactcaaaatgcatttttaaaccatttttaagtctacaattcagtggcattgaatacactcaaaatgttgtacaaccaccaccactatctagttttagaacagttttctcacccttaaaatgaaaccccatactcattaagcgatcactcaccattgccctatgcccccagtctttggcaaacactgatctacaggatggatcaagcttgaaaacatcttgtgaagcaaaagaagccagacacaaaaggccacatattatatgatttcattaacataaaatatccagaatgggaaaatttataggatcaaaagcaagtaagtgtttgccagggattttgggagagggattaatgaggactgactagttaatgttcacagcgtttccttctagggtgataaaacttttggaactaggtaatggtgatgactgaacattgaacagcattgtcagtgtacttaatgtctctgaattgcacactttaaaatggttaaaatgttgttttatattatatggattttatcacaataaaaagttacaatggaaatatgaataaactatgaacttaataatgtatccatattggttcattaattataacaactgtatcatcctaattaatgtcagttaattagttaatatgagaaaccgtgtgaaggtgggcatatggaaaagttctgtactcttttcaatttttctattaatataaaactgttctataaaatgaagactatttgttaaaaactccaaggaaagaaaacaaaagggtaaagaatatagaatcttttttttttaatactttaagttctggtattcatgtgcagaatgtgcaggtttgttacataggtatacacgtgccatgatggttttctgcacccatcaacccatcatccacattaggtatttctcctaatgctatccttcccctaacctccaacccccggcaggccccggtgtgtgatgttcccctgcctatgtccatgtgttctcattgtccaattcccacttatgagtgagaacatatcaaaaaaatccaggtatgaatcatgtctcaaccctcaccagcagcaatgcctatctagtataagtcatatgatatttccaatccttagttttcctaccagcaacatgttaataatcctacatcaattaaaattatttccttgaaagcaatcaaaatagttgtttttcttgaatttatgtcccttctacgaggactatataaaagctaacctttgaattataagatacatgttagagctataagattaaggacagccataaggcccaccctcgagtattgcagggcctaccctatgggtcacttagcagtgtgatgcaacctggcccagaatttttaagagacaaggccacctcagcacatttataaaccttaaagctcaaccttacaagaaaagcttaaacttcctttatggaagaaagacctggtaactcaccaagaatgaatgcaattataaagaaagagggaaagattccccaaactgagaatagtttccacacagagaccttcctggtcatctggttatcagaccacctgagtatatctggcccatgacaccaacatgtttcctctaaccgtcttgtgagagcattgtcagaataaactgattgaatactcagatggtgtctaagactcatctttaatgcaaataaggctgaaagggaaaagttactcctgcagaagctgattaactaggaccaaccacaacacctgaatgtgacaagctgcagcttaagatatttgaataattagaaaccctaagagaagtaaagaaagctttagccctactagacttcaatatgaatataaacacttcttaaatgaatgtccttatggctttgagtgaaagcagtctgaccatgttatgacataaagagtgtaaaataaatcaggatggagaattggcgtaagtgatgaaagagacttttttttgaaagggaggcggaattagtcagaaatagagaatggggtgagacaaagggaaaaacagaactttcaatcggtggtgtctcagtgtcatcaatgttgttagctttcttaatgtaactgagccaagtagggacaatcaaggctggactactcacttcttgtgacttggaaatgaacacatggtgcattgtctgaattatggctgttgtctgcgcacttctagatgggctgctaaggggggatactattggtaatagagtagaattccacacttcaaaagacctccggctgccttcaagtcacctgttcctggttactccattaaagtggcagcccatgctgaaagcacaaaccacaattctgtcctcatctttttattgccctctccacagtagcacagatgtcaaagggaagaaagtagagttccaggcttgaagttcctttcattcccaggtaaagaacacacactgagcaggactctctgatgaaagtggatttaacttctgtcaaaacatgaagcaaagcttgtttgcatatcattttataaatgctgttcaaataaagcagctgtttcagttagtgattaacagtttgagatacattaaaacgttcaatgcattagaacacgattgaaaataatacatacattatttaatgaaattacgggtgaccctagctcaagtttaatataacaaaatgtataattatgaccttctattaaaaattccttaatggagaatttcattacaaagggaacctcactacagtttaaaattaacctagttatacatagcaaaggagtcacttatgagcctctaattttttgtgaactatgtaatagttcacattacaaagtctaatgggcaattcaaactggaaataaaagaattttatatactcaaatatctctatatattatatgttatatatatttatacgatatgttatatacaagtatatattttatatatttatatatttttatatattttatatatatacttatatatagtttataagtacttatataatatatataatacttatataccatttataagtactgtataatacagtataatactatagtatagcactacagtatagtattatatataatactatactatatactatattatatatactatatagtatgtatatttttatatattgtttatattatatgtttcatatagatatatttttctttttggtggtcataaaacatgccccaaaatttttaaatattgccttaaatttggtgacatagtaggtcagtcttagtgacttgattctaatcaatagtacactggaaagtgaagtggtgtgatttttcacactagttcagatactgtaatgcaacttctgacaattctctctccttcttagctcatctgtcttccaggaagaagcctgggccacgtggagaagccatgagtaagtgtccatgccaacagccccagctgatgtcctaaacaaaaggcaacattaacagtcaggcatgtgagcgaggaagactttgaaatgactcaagccccagcctccatctgaccctgagctagaaccacccagctaagcccagtcaccccagaagtgtgagagataaccatcattattaatttgtgttgttttatgctagtatatttggggtggtttgttctgtagctctggataaccagaacattcctatatccattttttctactgatcattatatccgtcttttctagacgtatagttatttcataaagtaaagtaaatctgtgctccccttacaattctaaacttggtgatacctgtcccttaaataagtttaaacaatttggaataagccagaagagacataaaggccgtatatctaaacacattctctgtacattggagggaactagacttggcagtgacacgagacatgtgcgaagagtcatccaaagggtcatcgagggaaaagggtgaggacctacactccagtctcaaatcagccagcaatctccagggcttgccattctgtctatcctcgtaaccatgcctgtttaatatttcatttcatattatgctttgtgcataaaacaatcagacatgaaaacaagtaaaaacttttattgagtactcacagatttttaaggcatctgtggcatgggaacagccctgaccagtgtcacatccactgctactcacactgtcacaagaaaataggaaaataacatcaacacaagcaaaactcagaaacaattatctgtattagttaaaacttagagtcttaaaagttatggctaactacaataggatatgcaaagactacaaatgcattttatatatcatctggctttctatattgtttaatttttttaaaaaaaagaaaaatacaaaaaggaaactaacaggcgtccctatttccaccactctttttcaaaagtagatgatcttcgtttcggactaaatacgtattatctccaaaaatgttctagaactttctttcttaaaaaattatcttctataagctggtgttttccacatttgtttatttctcatgaagttagaaggaagcttgggcaactgcattgattacatttttgaaaattaatttgcagatgacagtctgaagcagctaactcccttgaaatattccctggttttcagaatccatcaactccaaccatatccctcttgtcttagtatttctgattgcttttctcaacaaactgttaattaatatttggtctctcaaacacaatttacctgacattttctgaaaaacaaaacaaaacaaaacaaaaaacagatttgcctacctgggcatctgcttttgcctgaaatcagatctattgactatttccaaaaaattatagtcttctttctacaacatcctctcattttgtccatttgatttttatgagcaataccgtctttttataccacactcttaagaggtcatatagtccatctcaccatttattctgtgcttctggttaacaatttagataactttttttttttacaaaagtaaagattacttgatatttcaatgtattttgatggttctatatacatcttaaattaagactattgtggaaataatagatatttcatcatttatgtaagagaccattccaaagtggatagaaggaagcagagtctcccttagtgcctccagaaagaaatgtggccctgccagcaccttgattgtagccatgtgtgacctgcataagacttgcgacccacagaaatgtaagacagtaatttttattattttaagccactaaatttgaggtaatgtgttacagcagcaacaggaatctaatacagtctccaaacctcgttttgcacaatacttgcaatcttcagtccttcagtcccttttatcatagtgtgtacagaaacagattaatctgaacttcatctctattacttttctttacctgttttgtgggagggtagctaataaaagtgaataaatttttaaaaattgttttaacagcaataatagaacaacctgattaaaaaataggcaaaagacctgaacagacacctcaccaaagaagataacaaacagtaaataaacatgtgaaaagatgctctaaatcatatgtcattagggaaatgcaaattaaagcaacaatgagataccactatacacctattagaatggccataattctgaacactgtcaaaaacaaatgctagcaaggatatggagcaacagaaatgctaacacttagataatgggaatttaaaatattgcagccactttggaagagagtttggcagcttcttagaaaactaaatatacctttaccatataattgagcaattgcactccttgatatttttctaaaggagttgaaaacttatgtttacacaaaagcttacacaggtatgtttataacagctttattcataattgtcaaatcatggaagcaactaagatgtccctcaataagtgaatggataaataaactgtggtacatccagacaatgaaatgttattcagcactaaatagaaatgagctatcgagtcataaaaaggcctagagaaacaaaccttcaatgcattattacttagtggaaaaagtcaatctgaagaggctacatactggatgattccaagtccgtgacattcttgaaaaggtagaactatgaaaatagtaaaaagattaggggttgggagtgggggatgaataggtggagcacggaaggattttaaggaggtgaaaaaactctcctatgaaactgtaaccatggatacatgtcattatacatttctcaaaacccacatgatatacaaacaagagtaaccctggaggacagagcagcatggtagaacagaagcgtccaccgtttgtcccccatctgcaagaacaccaaattttaacaactatctgcacacagaaaaggaccttcataagatccttcataagatccataagcccttcataagatccttcataagatccaaaaatctggcgagcaaacatagcacctggttttaactttacatcactagaagaggcactgaagagggtaagaaagacagtcttgaatgactgatgccactcatccccactcccctggcagcagctgcgtggcacagagagcgaatctgtatacttgaggaagggagatagcagtgactgggggactttgcattaaactcagtgatgtactgttacagtagcaagcaaaactgtgctgaactcagctggtgcctgaccatggagggagcatttggaccagaccttgccagagtgaagtgcccagattagtggtcagaacttgggtttcttggcaagcctcgccaccacgggttaaagtgctctggggtcgtaagtgaacttgaaaggcagtgtaggacacaaggactgcacttctaaggcaagtcctgatgctgtgctgggcttagagccagtaggctgaagtagtgtgtgacctggtgagacatctcatggggttgtagggggagtgcttgcaccactcctcccacaaccccaggcagcactgcatgcagcaatgaaagtgcttgaggagggagagggacaagtaaagacgttgtcttgcatcttggatagcagctcagccacagtaggataggagaaacagcagatccgtgaggccaccattccaggccctagctcccagatgacatttctagacacgccctgggtcagaaggaaacttgctgcctggaagggaagaacccaatccaggcaggattcatcatctgctaactgaagagcccttgggccctgaataactaacagtgatatacaggtagtatgccacggggcttaggggagagtctgaaatgcgctggcttcaggtaccagctttgcgacagtggagtagagtactaagcaggctcttggggtttccaagtccaggcctaggctcttggacagcatttctggacctgtcctggttcagaggggagccagcttccctgaagggagactcccagatctggcagcattcaccacaagatgactgaagaacccttgggcctgaagtgaacattggcagtggcatagcagaactccccatgggccagtggaggtagtggcctcagggagaggctcctctgccaatagaaagggaaagaaagatcagaaaggacttggtcttgcagtttgagtgccagtttaccggcagtttaatagaataccaggtagatttctaaggttttgaccctaatccctgactgccagacggcatttctgggacttgcctgaggcctgggaacacttgaaaccctgaagggaagaatacaaacctggaatgcttggccacctgctgattctattaccctatggtcttcagtgaacacagaaacctagccaggtattagtcacagcgagccttgagacagacccagtgttttgctggcttcaggcctgacccactgcagttccaatggtggtggccaccagtgtgtgcttctgtcaccccatccgcagcctatggccagccacttctctcaatactatttattaaatagaaaatcttttccccattgcttgtttttgtcagatttgccaaagatcagatggttgtaggtgtgcagtcttatttctgagttccctattctgttcccttggtctatgtgtctgtttttgtttttttgatggggttttctagatataggatcacgttatcagcaaataaagataatttgacttctgctcttcctatttgaatacattttatttctctctcttgcctgattgccttggccagaacttccaattctatgttgaataggagtggtgagagagggcatccttgtcttgtgcctgttttcaaggggaatgcttccagcttttgcccattcagtatgatattggttgtgggtttgtcatataaggcttttattattttgaagtatattcctcaatacctagtttattgagagtttttaacatgaagggatgttgaattttatcaaaggccttttccatgtctattgagataatcacatagtttttgtttttagttctttttgtaattaattacatttattgatttgtgtatgttgaaccaaccttgcatcctagggatgcagccagcttgatcatggtgaataagctttctgatgtactgctgaatttaatttgccagtattttattcagaatttttgcatcaatgtttatcagggatattggcctgaagttttcttttttctttttctttttgttttttgtatctttgccaggtttttgtatcaggatcatgctggcctcataaaatgagttacagagaagtccacccttttccattgtttggaatagtttcagcagaaatggtaccagctcctcgttctacctttggtaggattcaggcataaattcatctgctcctgggctttttttggttggtgggctatttattactacctcaatttcagaagtcactattggtctatttacagattcagtttcttcctggctcagtcttgaaagggtgtatgccttcaggaatttatccatttcttctagattttctagtttatgtacatagaggtgtttatagtattctctggtggttgtatttctgtggtgtcagtggtgatactccccttaccatttctgattgtgtctacttgtttcttctctcttttcttctttattggtctagctagcagtctatctattttgttaattttttttaaaaaaagcagctcctgactccactctagtcttggttatttcttgtcttctgctatatttggggtttgtttaatcttggttctttagttcttttagttgtagtgttaggttgtcaatttgagatctttgtggctttttgatgtgggcatttagtgccatacatttccctcttaacactgctttagctgcgtcccagagattctggtacattgtctctttgttctcattagtttcaaagaacttcttaatttctgccttaatttcattatttacccagcagtcattccggaacaagttgtttaatttccatgtagttgtgtggttttgagtgagttttttaatcttgagttctaatttgattgtgctgtgatctgagaggctgttataatttcagttcttttgcatttgtctaggagtgttttacttccaaatatgtgataaattttagagttgttataatttcagttcttttgcatttgtctaggagtgttttacttccaaatatgtgataaattttagagtaagtgtcatgtggtgatgagaagaacttaaattcttttgttttggggtggagaattctgtagatacctatcagatccactcgatccagagctgagttcaggtcctgaatatctttgtcaaatttctgttagttttttatttcttttccctacttgatggtgggttttttgaggatcagacctgtgacttattaattactatatcttttttctgtactaaaaagagtgcttgaggttctatctagtatgtatttgttgagtgagtacataactcaatattactggtaaaagcagcaaatcatagtataagaaattattttcagagggctcatttcagagcacagatgatccattgaccatttttaaattgtggctaaaatctatcttttatacagatccttgccagcaaattcctttgggattaactagagtaagaacttgttagcagttcttgcttatgctaatgttttataatttcatgaagttaaatgtgtgatgaataaagagtctattacccataccatttcaaagatttttctacatttacctgttgctttcaaagagcagtttatacacagaggcattttaaacatatataataacagtttctattatatcttaacaacccctgaaagatcatttgagtaacataaagctcatttgagaagacaaaatgtatttatttgggatacattagcagaagttactccagagaggagtatcaggtaccatgaactaggtcatgctgcagtgaaaaaacaacctccaatattagtgaattagaagaatagtttatttcttggtcatactatatggctatcatagattgagactatgcagtcagaaatccatgctgagggaggctcagtttttacacgtttctacgatcattgtatgtagcaggagaaaggaatctgaaaaattgttcagtggctcttaaatttgaaactaatgtacagcacttccccccacccatgttttttgccaaataagttatattttcacacataacttctacattgtcgagaatgtgtaatatcactatgtgccgaaaaagagaagaacacgaacatttttaaaacactaaaaacaattcagtcattatatggaactttaattttttttttacttatttcctagtgtttccctgctgattaaacatagataccagactggggattctgttaagacaatgccatgttatttgatttttagtttacctaagaaagttaaccataaaggtactttgcagtattctcattctggttatactttaaaatgtgcattcttacattttgtttttgtttggaattctgttcaaaaacaaatattaaagagagcgttataaaaatgtaatattgtagcattgctaagcattattttattaagacataaagatcaaaagatctttttctgcctacaatgtcagattaaagatatactaaacaactgtgttattagggacaaaaataatttttgtgtgtccttatggagaagattattagttgtttactccaatatcctttaccctcttctcctcactgacaaaaccttgatttcaggtagtcatgaaaggtttcctttcatgccaaagtcaacttctaaatgcttttctactgtgcatttcattttgtttttaacatggcaagcttaccataaaaaggcaaatatctttacctgtaactacagtctatagcttcaataattttggaactttagatctaatcaaacaatttccagaactatatatatatatgtatgtattcacacacatacattttgaaatgtgaaacagaattcttatattttatcccaaactgtgaaagtagactcaattttcactgttcattaaactgagtcaattttgttacttatactcacagatatacccagaacattgctttgaagtttgactctcatttaatatgtgatactgtaaattatttaaaataaaaagtaaaaatacaaaatcttttgaggtgacccaggcaaagtcaacatcacaaagaagccatttaatccagaagatacaaaggaccaaagagttcgatttgtagaattattactaaataatttggcaataatagaattttatattttcaaataagttaacataatgtatctaaaatatcctagttttatggtacctataatgcacccttcgagttcaatgcattaatctatcttttattgtttactaaagccaaataataaagcaattatttgaatgttctggttagttataatatgaacatttaatgaaacaaatgcagtgagccaaaatgttatttttcttaataacttctctcccaaaacaaccaatagagaaataaaatatcttgcagtatatacaatctttataatttgcttaaaatattggtttgagtacaatttacttggggaaattataatatacttctttttaatcatgtgctaagattaaatttaaaagtacttgaactatttttaataagctaggcacaagtacattggcacatggtttctgatgactttcacattgagaagtcccatgttatcaaaattgtcccaatttttacctgctgagcactttttacatctaaaacaattacatagacagagacaaataaacatgaaaaaaaaactaaaagcatagcaataaatgtcaatatatgcctcaatttcattaatagaaatctgcattattttcttttgacctggccttccttgtcatatcactatttttattctattttatctttgttgggaatgaagtttttggtgttgcaaaaaaagaattaacatgagaacaaatggtctctcagcaagacgagctttactttctgcagaaagggtgctactcaatagctatccagccacgagagcacacccaacaaaggagacagagttatttataacctgatgcagctaccctactgctgtgtccagttcctattggctggaataggacctctcattttacactttacccaattggctattagtttaaaacttttttaactgggtaaggggaacagaacaaagaaagaaaaggaaattgcccagggatagttaaggaagcatctccaaataaggaatggcctacactatgggctggggcttgtctagttctgtccaagcatgctggagcaagctaggacagctgattgggaatatatatatactatatataaatatatatatacactatatataaatatatatactatatataaatatatatacacactatatataaatatatatacactatatataaatatatatatacacgatatataaatatatatacactatatataaacatatatatacactatatataaatatatatacgatatataaatatatatagcattttatatatactatatataatatatatagcattatatatatactatatataatatatatagcattatatatactatatataatatatatagcattatatatactatatatactatatatagtattttatatatatactatatatactatatatagtattatatatataaactatatatagcattttacatataaactatatatagtattatatatatgctatacatagcattttatatatattatatacagtattttatatatagtttttatatataatattttatatatatagtatatatatattaatactggatagcaatcttatagtaagaaattgtgactttttataatctttgaagaataactttcccatttctcacatcttcaatagctttctatagtttaaaagaatttagaattataaagcaatctaagttttaaaatctctgcttctatactcggaattcagattctttttaaactataaaaaataacttcataaaatagatgaaagaagtttaaatattaatgctatcaggtgcatatttaccctaattccatgtacataaacctagtaacacataaacagatatatctgaataaagtttgaataatataaattcatcgttttgaataaattaaaatcaacatgtaaattgacagtaaatttactcagtgtaaattattctgaatttcctctgatatttacaagtttagaaaccacaaatttaccaaaagttcatgtgcttaactaattgactaggttcagttcattgttatggcaaaaatacaaatgttgaaaatgacactgaaataaataaagcaaaaactattcagaactctgttaaaatctagaggaccacaaaaaattcttccttttattatcattagtgaacagtaataataattagaataaattagaattgaagatgtctaagtcttctcgtcttgcaactcaaaatacatatgttacaagaggaagcataggttttcaggctcctcttctggaaagtctgattcaattggtgtggaatagggcccagatgaaggaagagaaagaccctctcatattattttatattgttttatactcagtacctgttttaagaaaaaacaacaaggaggtaaaaccaaagacaggcagcccggcgccaggcccaaaaccaggcctgggcccgcctggactaaacccagtagttaaaaatcaacttatgatttagaagccgacgttattcatagattccttacattgtatagaagaacattgtgaaactccctgccctgttctgttcctccctgaccactgatgcatgcagcccctgtcacataccgcctgcttgctcaaatcaatcatgaccctttcatgtgaaatctttagtgttgtgagcccttaaaagggatagaaattgtgcacttagggggctcggattttaaggcagtagcttgccgatgctcccagctgaataaagcccttccttctactactcggtgtctgagaggttttgtctgcggctcgtcctgctacacagagacttattttttaaataaatacctcaaaatagacatatcagaaaaatttcaggaaaaaatgaactagcctatgcaagaaattttgtgaaggcccgtaatctaaatgacacctggttccaaaagacaagctaacattatgcttaggatgccaaaggccacctctgtgttcctgacaatcatcactcctcacactgactcggccacgcttgccagagaaaagacctcagggtacatttagaagtttgctggaggtttgcccaagatgacagactagaagcatctagtgtgtgcatcgctctcatggagagaaatagaaggagtaaataaatacagtaccttcgactgaaacatccaggtacatacattgggattcatctagaaaacaactcgacccattcaatacagagaaaagcaaggcaggatgactgcccaccagggagtgacacagagccaggggagtctcccccactcagggaagcagtgagtgagtgagcaaccccagagactcaagcttctcctatggatgtttccaaacctcggctcaggagatccccttgtgaacccactccagcagggccttcagtctgacacacagagctacatgagttttggcagagcaatcgcttaggcacacgcagagccccaggagtttgagatacccaagctttctggcaaaagcagttgcaactctggcaaggtgggaggttagaccctcatacatacccctaggaaaggggctgaatccagggtgctgagcagcagtggtctgcaggccccacttccaccgcacctcacaggataagactcactggcttggaaattcagccagccacaggtaagcagatgaggactaaactctgattttcttatcttgcccaaattcttgcctaaggggtctgaggagtcatgccctacaaatcaaaaattatcatcacatgggttttatttaaccctatatattgtgacttactttccaacctgactctagcataacatcaagacacaaggaagaaaatcaaaatattttaccgcacaacaggtttctttgccgtatcttgaaatggccctgcaaagctgtcctttgtggggcaaaatttgcgtctataaagaatctctattaacatagctaggtctttttctgccaggccctcctaatcctaaagagattgactaaaagtctagcaccttttaaagatctgaataggaaacatttgtcatctattgtctctaagggcaaccactataagatttcaaaagaaccttggtctccacaatcttttatcttaatatgaacatttcctttctatgatcccaggtctttagacaaacgcaatcgtcaacaaaaaaatgtttacatttacctatagcctggaagcacactcccgcccccgcactttgagttgtcccgcctttctggaccaaaccaatgtatttcttaaatgcatttgattgatgcctcatgcctctcaaaaaatgtataaaaccaagctgtgccctggccacctagggcacatgttctcaggacctcctgagggctgtgtcatgggccatggtcagttttattgggctcagagtaaatctcttcaaatattttacagagtttgtctctttttgtcaacatctgtataatataatgcctatagttaacaatattaaattatgcacttaaaaatttgttaaaaggccgggcacggtggctcatacctgtaatcctaacactttgtgaggccaaggcgggcggatcaggaggtcgggagttcgagaccagcctggccaacatggtgaaaccccgtctctactaaagatgcaaaaaatcagctgggtgtggcggtgcacacctgtaatcccagctactggggaggcaggggcaggagaatcacttggaccgagaggcggaggttgcagtgagccgagattgtgccactgcactccagcctgagtgacggggcaagactccgtctcaaaaaaaaatatttgttaaaagggtagatctcatgttcagtgtttttactacaataaaaaagggatataaggtaacttttggagatgatgggtgctattactttgattgtggtgatggtaataggggtatatgcatatgtctcaattaatcaaattgtatatgtcaaatgtgtaatttttgtatatcaattatacctcaataaatatctttaaaaaagtcagtaacaagattaatcaaagatatttttagactcattagcacataaatgcacaagagggcacatgcacacaattaaaatatttttccatttcttgatatttgaaaactaacatcatattctcctcttttattttaacctgatattttggatgctttcttatttgaggtgtaatgtgtatcaatattatatactaaaaagttttcaccattcaaacttaatcatagtaagaggcaatttatgaattatgcaagacatatgacagacttccagatgtacctttatcactgtaaacttagggttaggcaaatacatgaggaagtgttcctctccagagagtaatttaaaattaaagctgggcactgaattctcatttaaattttatgaaattatgaggcaaaaaatctccaatgcttttttatttctataaatctaaagtgaatcaccagggaaatttattttggtgattttctattaagtctattaaatggctagaagggtaaaacattctgacacacaaatcaaacgattaagccaatataataagtatttgatcttttatatactatgtatgtgccatttagagagaaaatggcatcccagttgcttttgtttgagaagcttctgtttaattacaataaacaggttttccttaaaatagatgaaaatatacattgtaaaagtgaaacacaaactgactgatttaaagaaatacttcatgattgaaatttgtaaagcagtggttctcactttccagtgtgcataataatcacccagggtgcttatttaaaatgcagattccccaggttttacctgcaggcactgggattagataggtctgttataaatcctaggacctgcatttaaaacatacccccaggtacttttgatatgagttgtccatacattcactctgagaaatcctgtcctaggcctgttctctaactttattctgtggagaaatcccctgaggatgttaaaatgcaaattctgactcagtagttcttgaaggtacgtgaggattctaacatgttcccagatgaggtcaatgcttgtggtctgtgggccacactttgagaagcaagtttctaaaacctaaatatttgtcaaatattctaggaaacaacactctcagagctaaaattaaataacgtcaaagtcattaatctgtaatcaccaaggaaatgcttagcaacaaataaatcagctaagtggctgtggagtatgtgtatgtggggagggtgagtcaaagatttttaagtgctagaaagggggttagttagtgactatgccaattaaggattaaaaaatatcactttagagaagacttgaagagtacatagacctgtacatgttggatttaattcaagtcccactattcattggacagaaaagtgccttcagttaggtccagtgagtgtcactcaaaggtaatcatactttttcagcttccgctggctagaacagttgtgacaaagcacaacattcagttttgcatcccccagtcaaatgctgctgcagatgagaaattttttaaacactgctaatggagaatctgttcagcaaaacaaggcagatgatcatgaagtcgtaagtttgattagcaggtttcctttctaagttttcctaagtgccctcttcccaacatcgttacttctgttttcatcttatgttaagaaattcattcaacagttgatagaacccagtttcagtctcttgatctaaaaacaaaccaacctaatattgactgctttatgtgctgagtgaagaagaaaccctgtttaccattcacttccctgagttgcagccgtcagacttgaggctcccaccccatgctcagttggctgagcatataaaagccatagtttccttagggaatccatgaaatacacgtgttaagttaggtaagtatataattatatgcaataccaaatactttgacaaatgttaggatatgtaaaattttgtgaatattaatagtttgaagaaagcattccagtaactccctcaggtagtatcaatcctggaaaaactataaatgtgaaaggaaacatgtatttcaggaacttacacacagatgcaatggacctggagagaaggaaagctgtttagaactgaggttgggcagaaagtgagtgactgcaggtggcaagaaggaagccatgagaggggggcctggagaatcattttaagttctgtttttttgcttctcaccacagttgtctaaggacaatcaccatcttccccttcactgcagaaaaaagcatcagtaggctggatgtgtggatgcctgattccacaagattgggtgagaaggtgacacaaaaagggggcagatggactcctcagacagtcacccctcacccactttttccagttcccaatggctggtggattacaatattagggcctcgcgctgctgctgaatttgcctggtgagtgagcatcaaacaggagtgagcgatagcaatttatatgatgcctaaggctttgcaacctggcaagtgatctcttccctgtccttaaattccctgggactgacacggaccacattgagccttaggaatttctccagtactcaggaccagacaaagtggctgatgcttcatccccatgtgagtttactgtaactgcctgccgcctgagaggttcttcctgcccactacataaagaaagaccacgacattgtagtatagaaagagtttaatagacatgaggctagccacatcacatggaagacagagttggtactcaaatcatctcattcaaagctcctacgttaggggtttttcaaatgcagtttgggggaaggagttaggggtgaccaggtaacaggtgcttgcttctgattggttggagcagagatgaaatcatagggggtcaaggctatcctgccagctgaatcgcttcggggtggggccacaggagctgggttggcaggtccagttggagccatgggtgtcagacatgcaaaaaacctgaaaatatatctcaaaaggccaatctacaatagtggtgtcatttgcaggagtaactggggaagttgcatatcttaaaacctctggagtaatggctgacaatcgttcatggctgagccttagcagcacataagttcctcccctccctccagcctgatggcctcccactaggattacaaaagtggctgagtttgggggtaaggcctattatcatttaaactatagcctaaatgtctttgaaagtcagcttgtgccagtagcccaggaataattaagggaaaggcaagatgggtagtggggaggggtgggtagctcagatttctttcacggtcataattttctcactgatataatttctgcaaagatatttcatatgtttttatagatgatatatatcatatataatatttattatatattatatatatttctgcaaagatacgtttcatatatatatatatatatatatatatatatatatatacctaatacacctgacataaggaagagacaggagtgtgtgtatgtgtgtgtgtgaatgtgtgtgctcatgaatatttatctgtatgtgagagtgtgtgtgtggcatgcctgtgtttataatgtggtggttacactgacagaattatattctaataaaagcacagatatacaatttaaacctcaaattatccaaaaaaataaagaaaatattctagaaattttagttttagactgattacatccttgccttatttcatttctccattatgatgtaatctacttcctggtgacttaagaccatgcataggcagttgggggaagtacaaaaagttgcatgagcttcaggcttctctaacccagagccacattaatgacaggctaaaaccagccctgtcacttagccacatgtgacaaagcaatgtcctgtttcagagaatttgtgtgagaaaatcgggaagtgtacatgttgattattcagcaggaaataagatcacaccacacatctcagtgacaaatgctcacttcctattctgagcatcattgtcgtataagccactctgtccatacaagcatctcaatgccctcctcacacaactagccatcactcaaccctcctacagtcattccttctacttgccactcttgacctgcacacctaaaattctttataatccatttggaagtctggcgatataattgagactgacaaagaatccatatggatctgcagcaacctcaattcttccctcctcagaagaaagaatttgactgaggggcatagggcaaattgagagactgaggcaagttttagagcaagagtgaaagtttattaaaaagctttagagtaggaacaaaaggaagtaaagtacatttggaagagggccaagcaagtgacttgtgagatcaagtgcatagtttaacttttgccttagggttttatgtgttggcatacttctgtggtctttcatctcttttctcttgatacctccctcggggtgggctgtcctcatgtgcagtggcctgccagcacttggaggggccacatgtgcaatgtgtttactaaaattgtgcacatgctcacttgaggtgttccctttcagacgagtgttcctatatatcagttaaactctgccattttgcctcttagtgcacatgctggagcccatttgcccaactcctgagatcttaccaggaagctgctgatcaccagtttcaggtttttcctatctgttgggagactgcctttccttggcactggctgtgaccaattattagtttagagaagcagtttagcaaccacctgaccatcacctgatggttctttgacattcctggtggtcgaggggcatgccctgctcatgtctgactagctacctactgtaacataatgaatttatttaccatacatccatgctagaaaataatatttagataagataatggctacaaaaagtcaattataataatgtcacaaccattttatagagatttaaaaatctctgttccccactctttgagatataaacacttagaacactgtttggaacatcatcgcctctcaaatgccagcattagtcttatccttataatagatttgctccacagaacactcaagaaagtgatgaatgtttccatcagagaagacaaaagtattttgtctatagatcaccatcccttaatctaaacagaaacatagaaataggtcctggactgctttaacttaaatcacaagtctccgtggcagaagggtatgtaagttactacatgcatagcgaatgactctttcatgaaaagcgcaaatgtgatcctaaaaagctgatcttaaagcaacacttgatatacattctttcaacttctattataaaattagggacttgttttctcagaaagagtatcagagcaataatgtcagaggcacagaagccaaataattgtgtacatgtaaataatgtgcacatctgtgtgtctgtacatacgcatgatctcaaggaacaagagttgcctagagataaaacttggaagaagagccgtttctgtgatactccttggcttgagaagagaagaaaagaaatacaaaattgaggacttcacctttaagtaacagtcattgtagttcctcctgttgcattcttgggtttggaaatcaatagcagtgaagcttcagcaggacgaaggaagcagctggtgcatttcacagtgatatttatttgagttcttttgaataaaagatataagaggaaatattttgttttgagaaagatgatgaacaagcatctgttcagtatagactttgtgcccagtgcctacacccttcaatgtactcacttctacagtaaaattaaagactgttgcagttctcaagaagcataaaatgtagttattatcatcagttaagacatcttgatccagtctgtaaaatctgaagataagttccgaatatataatctcgcaaataaaggattttctaacagcaagccataggaaattatacatgtattgtggtgtttgaaattcataggacattctgtgctactgtttatgcaaatactttgtcatgtcactggtatttggtaatatggagaaaaaaataagaaagatttttaaaaatgtgtaaagccattacagaaaataacattcaaaactcaaaactaaacaatggtagataatggtaactgtcaattataaaaatgaataaagaaaatatgttcatcttactgaatctttaatttaggagtctaaaacacagtatatagtaaaaaggctatggaggaggacactccattcaccagtttgtgggaaattactatagcacagcatcttgacaactttgcatgattctacataggctgtatactattttagctttttgaggtgcagtaattaggaaaaaaaaccatattattcctaatctcctggattttacattctctaggacatgcccgatattgattacatcattattaaataaatttgaaaaccacaaatcatgcatgtgacatccaggaagtaatatgagaacatataatagggagtgtgatatagtctgatgggttagaggtagtgacatattaggtgggaaatgaaggatgggaatgagttagccagactgagcaggggaggaaaaaagacatccaaggcctctgctatggaggagtataatgtgtttgaagaattaatcaaaagcaaatagttaaggcttagagagcaagggcgttactgatgccagatatagccaagataaagccatgaaaggctgcgtgttgagatactcagtctatatcctaatggcaatggaaagctattgaaatattttaagcagaagagtaacaagatcaaatttccatttaaaaaaagactgtggctctaatataggggatgtattgctgagaagccttttaggagtcttttgtggcaatctagtttagagataatgatatacaaattagggtggaagagatgggaaataggaaaagatgccaaatgtaagatatatttggtaaaatcaacaggacctgataatggattagatcttcatggaagttgatgaaaaaagaagtgttcaagagtgaccatagactaaataacatgcacttaataaatgtttttatggtcccatacttaagtcctatattatgcgttgtataatgcattgtattttttgtattaggccaatggctggttttagaaccaagaagatttaggtttgtcttgcatatagtaattcctttttcatttaaaaaattcgtatagtcatattgaatcatgtaaatgacaatgactcctttctgaagatattagcaagttcagaatcaaacatgtgatccacttcaaggaagtgccctgggtctccaggtatttatatcataatgataggcttcattttaatttctttacttttcattttcttttgatggctcaatgagaataatgaggaaaaaaagagtcagaattgtttgttaaaaactctaattcactttcatgacaatcgctgtatggttgtagctaaatttaggcattaagtcagaaggagatataaatatgtttgtgcacatcctggtgtagctatttaatcttttctatataaatgctgtctcttaagatgtgaattcacagctgacagaaagagccactattaattgtgatttggacaggatttaaaaaagaaagtgatataaattggtagataattatataattttgataatgataaagctcagaattgcttttttcttattaaagaaaataaaatattttccaatctcttcttataaaaatccaagaatttaaaattatttacttagccaaggataagagacatttaaagagcaatttaataatactatttgaatccatataacagaattcagcctagaaagtgcgaataattcttttctgcgtgtatattgtcaagaattgcctcttctctgaacccttccttcgtttccccccaaatactcaaatgcttctttttccgttttcttttagttatctatacatatcttaaatatagccattgtcaaattatatccttattgtctatttgcttatctggcactctgctggactgcaaacacttgcaaatagcatttcatctttgaatcaccagcatttcagatttagagtggaggaaggaacaaatacttattgattgtgtcctatattttacagttaaagcactaaatgttttacctacataatcatatttattattgacaacactgtaggcaaatattctgatcttcattttacaaatagggaaactgagtctgggtcatagagcctctacatgtcagaactgaagcccggaatttaaatattaaatgacatgagagaaccctgctagatcacaattgcatctgaaactagatgtctcatctcttccaaatagaaacctcattaaaagtaaaacaaaatatttaaaagaaaaaggcagctatttagaaggaaccatcaatgagcatctgcacagaggctgacaagggaaataaaactgccgtgtagactcctggagaagccatcagtgtccagaaatgcccattcacttggagagaaggatggggctcagacaatatcacgctcctcaaggacattttatgcagacaactgagcatagaaacagaatgttttccaccctaaagtaaagccttccaattgacaaacctgtgcaaatacaacatcataatttacttttctattgcttctttataaaatacaaatggataagaaagaatcacaaaccgttacagtaagtactccaaaatgaaacactgagatcaagataaacaaatgtaacaattaacctcagagaaaatagatataatttagttaacagatgagaacttaaaaacataattatcattaatatcatcaagaatattaatgaagatattgtaaccccagtttaagaataggatagtatgaaataggcataatcagataacaaaaactatccgttggatatttatatatccaagagcaaaagtcatagtactagcagtaaactttccaggaggcctgggaagcaataggtctaaatgagagtagcgcaaattgatacagaagggtagtatactagaaggaaagaactccagagactaggtataattctttcaaattcactggcattctcatcttacaatggggaagtgaagacatactgtatatactggtggaataaaaatatagataaaagtacaaattttactattgcaaagtaaccaagataagataaaaagaggaatgttttggaggtgatgataacattgaggggaaataaactagattctaaggtatagataaaagtcaatatattatataaaatattgatacacatatagtgccatatatatggactatttagagatagaggatattacaggaaaaactaaaatcaaacataattaaacaaattaaagtagttgactctgggaattggatttctagcagcagaaacttttcatttattttttaagtacatgcttataatacacagaaaaaaatactatgggaataagaggataacacaaatatgagtaaaatatgagtgcaatatgaatacatgtatgtatgactacatgtgtaactgtgcatgtatgtatggtcactgaatgttcatttgtcattgcagtcaaagtttcaagtatatatgtatacattctcctataaaaagtaaaactgtgaataaacagaaataaagcactgctaagaaagtgatgatagtctgttaggttcactcaagagatgtattatcaaaaactagctctgttaaagaatatgattaagttctgtttcagttacacacacatattagttataggcctaacatatgggagacaggcttataagagtgccatatctggacttagattgcctatgtttgaatctatattccaacacttagtagctgtgggatctttgaaaagaaaattaatgttttgtggttcaattgtattttgaaaatgtagattttcatttttaatgtagattaaaaatgtaaaatgtagattttcatattaatggttaaatatgaaaatctacacaaagtgcatgctgtatacacgtggtacatagtagatgttcaataaataatagatattaatatttactatataatgtggttatcatatatatgaatatacatatgtattataagcacaaatgtgtgcataaaaaaacaataaatggtccaacatgcttagttgtatttatctgaaaggtatttgtatttctttacgtatttttctgtattttcaatttttaacagtatgccagatttacatttgtaatcagaaaaatatatggcatttgtttaattaacagaacaattacctattgggtaattaagttctgggtgatggctacactaaaagtccagacttcatcactgtataattcatccatgaaacaaaaaaccacttgtacccctaaatctactgaaataaatatttaaaaaagaaaaaaaggaaaaaaaagatcttaagctgacacagtagaggtttagtgtggttatcagaaataatttctcatattgagatcttttagctactggaatagaatatcaggtttatgaaattttgctttttggaaaccttaaagctgtacaattatataatcctatttgaaggttggagaacagacctcagattttcaaagccctaacaagttcaatggtattgggatagtatccaaattaacttgtattatcaaagtcatcttttataatggacatattgaagtatagctacttatgtgtctagaaaatgagtgggttgctttaataagaatttaattctgggatttcattcataacatggacatagttgagaagatcattacttttctcaaatttaattaatctgaatacagtcatgaccattaataatcagatttgatggtgaaataataatccttttagaaacaagtatgcactgaagtaaacaaccacaggctaatgacacaaagttcaggcaagttcactgttgcaactgggttgcagttattttatttacaatttaaacttgaccccagtccaattattttcatgttttgtgtattagaagttataaatattacagttaaaaaagacaggcaaatacataattaaataccaaataaataacaaattacttttagtcgttataatccgtctcctttcactgagaaaaaataattgaagtcaaacaactaaaatgcaagactaaagtacatcagtggttatcaaatttgttaactctttagtactgacaaggctattttaatataattcttgtattatttaatatgacgaattaccatcattaacacctattgatatatcaaatgacatttgttaatccaggaagagtcatgcattaggttatatttatattaccaagactatttcctggggttctccttcataccttattttgttatatatagttgtaattaacaaactctttaattagtttaagaatttggattttgcactaaatatatttccccctttgttttaatttcctaggaaatatttaagacacacaaatatgcatacaaaataatttaatgagcacctgtgtaaccaacatcacaactgagaaacaaaatattgtcagtattgtttagacacctcctgtacctctactcaatataataataataaaagagggtataaccctctttcctgaccacctcatcaaaataaggcctttcctggattttgtattaaacaaccttgttgcattttttacacttttactatatataaatgtgtccatatacaaaaaagtatttttcatgtttcctaattttacataagcataacttaatttttagtgatttttgagtttttggatttttccattgatattatgctttcaacaactatccatgttgattccagcagctttgattcattcattttctctaaatctaatttcccattatatattttaacatattctccatacaaatgatacttttttaacaagtgttttggtatcagagagatgctagtagcattcttatacatttctccatgtgtaaatgtgctatagttaccctaggatacatacccaaaggcagatttgatatttcacagacattcttcatattcaaataaatatgctcttgaaaaatggctctacaagatgattattttgatatactcactatcaatgatatccctaacccaatgccttattgctagactttatggccatttcagtttcttctttggtgaattcttgtttatgtctttagcctttttgttttttgttttttttgcaataggattgttggaattttagttctttaggtttctgagtattaatccactgttatttatatttattgaaaaaaatttaccagactatagctcatctttccacaatattcatagctttatttaaactttattttgagctaactatagactctcaagatttaccaaaggagtacatacagagtgaacccaggttgccccagtggtgtatatgttcctagtttgtttagtttttaaagaaataccccccgggcgaggtggctaacgcctgtaatcccagaactttaggaggccgagatgggtggatcgcctgaggtcaggagttcaagaccagcctggccaacatggcgaaaccccggtctctactaaaaatacaaaaataagcgaggtatggtggcttgtgcctgtaatagctactaggaaggctaaggctggagaatcgcttgaacccaggaggcagaggttacagtgagccgagattgcactgttacactccagcctaggcaataagagctaaactccctctcaaaacaaacaaacaaaaaacaaaaaaagaaagaaaagaaaagaaaaagtaattccttaacgttttctagagttgctgtgccattttacattccccgcactgtatgagtgatccaacctctcctcgtcattgctagtatttgttattattaccattttttatttagctgttctgacaggtgtgcattgatatctcaccttggtcttaactggtatttccctgatgtccagtgaagttgaacctcatttcatgtgctgatttgccatctgtatatcctcttcagggaagtaccctttcatatattttgcccattttctaattaaattgttttttagctattgagttttcagggttctttatatattctacatacaaattctttgtcagatatgtagtatggaaacattgtctcacagacagtggcttgtatttttatatttgcttgacaggggacttttgcagagcaaaatgtttaattttatgaactctgatgatatttttatggatcatgctattatgtaataagaacttttaatcaaatcctaggctaccaagattttttcctatatttttataaaagtttacagttttataatccacaattatgtgtatgccctattttcactttattattgtatataatgtgtgctggagtgcaatggcgcgatcttggctcaccgcaacatccacctcctgggttcaagcgattctcctgcttcagcctcccaaataactgggattacaggcataagccaccatgctcggccttgtatctctatttatttgtatcttccttgacttctgtcatcagtgttttatactttcaaaatacaagtcctacctatgctttgttagatatacacctaagtgtttcagagttttcctttaaaaaaaatgattgtaattggtacaggctgagtattacttatcgaaaattattgggaccaaaagtgtgctggatttcaaattttttcagactttggaatatttacatatacataatgagatatcctgtggatgggacccaagtctaaacacaaaattcatttatatttcctatataccttatatgcatagcctgaaggtaattttatacattttaaaaataattttgtgcacaaaacaaagttttgattgcattttgactgtaacctatcacacgaggacaggtgtagaactttccacttgtggtgttatgctagccctcaaaaagtttcaaattttggatcatttcagactttttttgttgttgttttttgagatgagaaataactatgttgcctaggctggtctcgaactcctaggttcaagcaatcctcccatctcagtctcccgagtagttaggattacaagagtgcaccaaggagcctggagatattttggattttgggattaggaattctcaaactgtatttcatttgtaattgttgtttccatgtgttcattgctagtatggaaaaaataatttttgtgcattgattttgtgttctgtgaccttacttaactcacttattggtactagaagattttgcagattatattggattgcacatggagacaatcataacatctatgaatagaatcagtttaatttctttatgatctttatgttttttattttcttttttatggaattatcatgctggctagaaattcctgtataatattaaatagcagtggttacagtggacattcttgtcatatactatgttgaatagaagtggtaaaaacaggaatccttgtcatgttccttcctctttttttcattatttcaccactgagtatgttagctgtgcgtatgtgtttttttttttttttttttttttttgaaacagagtcttgctctgttgccaggctggagtgcagtggcgcaatcttgactcactgcaacctctgcctcccaggttcaagcgattcccctgcctcagcctcccaagtacctgggactacaggtgtgcaccaccacatccagctaagtttttgtatttcagtagagacgtaagcagaagcaagagaggtaagcagaagcaagagcgctaagtccttaccagcagctaaggtaaggaaacttaatgagaaaggaggagacagtctaacctacaacagaagtagtaacacagggtctgacccttcctactgtgctgtgaaccttggaaagcttttagctggcctggcttcctgtctgttccacccacacatattatcatgccctgtgacaaaaagcacccatccttcccacatgaacaacactttgaggctcccagagagacccagggcctggagagtgcacaggtctcagaggctgcaaatgaggcttcctcttcatcctcctgttctttgataccctggaagaggcttctacccctaagatgcccagtatactctaggatcctcagattgccaactcctcttccttcacctcattgagcaaatcagataatgtctccagcagccaagaagaggggaaataaatccaagcaccttgcagtccccaccagatactgagaacttgcccatacttcctctagatgaaaaagtggaattgtcaaagtcctgctgctcaagtatgaaaatgaacaaggccataagaatggcagaaaggctgaagaatgtcatcaggaaatacaaaaaccacttctctggaatgctcaggagagcctctgagcatatggagctaccctttgacactgaaataaagaaagtggacttcatcaaccactgctatgctcttgtcaacaaactggacctcagctatggtgggatgctgagtaataagaaaggcatgcccaagactaggctcccaattcttatcttgtgtgggatcatgatgaaggacaactgtgcctttgaggaagagatctgggaagtgttgaatatgatagacacatatttttggaggaagttcttcatctttggggagtcaaggaattttatcatcaaagatttggtgaagtaaaagcagctgcagtactggcaggtgtccaatagtgatcctacatgatatgagttcctgtgggggcccaagaatccaggctgaaaccagcaagatgaaactagacttttcatgctagagttctggccaagattaatgagtcttactcttgttacttcccatccgagtacaaggaggatttgaaagatgggaaagagagaacctgagtcaacactgcaggcaagtctggctccactttcatggcttatgcgagttccagtgccatgttcagcagcttctcccagctctagcgaatactgaggtagattcttcactttggttttgaaggaggcagttagaggtctacatagtgaagagatgagtggagctggagaaaagaaaatagtgtataacatctttgtttttctgttctacatgggtaacatgaagatttatcatttgggcggagattattcaaatgttgttccttttactatagcctttagttagtcacagaatctaagtttatgaatgatattggccatatatttattgtatcaccaaaattaatctaacaggtcttctgctaaccagcacctaaattgttttccatttgtgaatatgtttataaaactaaaatcaacattttgtaaatgaattataaggctttctaaaaagacagatacagcaaaatgtaaattttgttaagatgagtaggatacaacaattttacatttttctaaatattctcatatttattttcaaaattttctttaaattgttattctcacaaaatgtatgttaataacatatacatttatattttacttcatcaattctttcaattgtagttgaacttaagagtgagaaaaaactacatcactgttattttgtattccccttttgtttaattaggttaaacagaaaattatattataatctcactcatataagctagatttatacagtcatgtcctgagtaacaggatatttttagcaggctttataattccgttatatcaacaaagcactttcccttcatttgaaaagcaagaatttctccagaatgaccaggtgccaaggaatagggccagaccaaaaaacacctcagctagtgaggatccaggggaagagtattgtccagagtccatgagaggaaccatatgcaaaaccaagtccagagaccccagtgcagaatggctgttgggattctgaatctagagttcagtatcatgtggaaaaagaaccagaaatgaagaaagtagggaacgtggaggaaggtcctggacaaattgcatgaatagttttagaaaatctctgaatcgccattgccagctaagtggtaaggtcatctcagtgggcaagtcgaccgcatgaaatgaacagaggcatgcaagacacccaccctaccttagaatcctcctacctacagtcaggcagagtacagctagctctcttgtgtcacccagtgatgtgaaaaatggattctgagagagctatatgttttgacgaccctgggagtccagcacaccctcacggatgttctagggctgggagctgtctggaaacctgctggaaatgagtttttcttttttcatggaagttggctctcctccattgagattggggccatgtgaatatttgatattgctgagtgtgtgacaaacagttaagacaggctaggagtcccagagtggtgaaagttagtatggagcttcaagtatgtattgctttattcacttggtaattaaaagggggatatgctgttactgattacctcagtaactctacagataaaaggatgggtgtcagtatgtcttctaaatcaatccagatgatgtcttctgctcagactgcttcccatggtttttgagtctttggcacaccagagagtaggtgtaccagggctttaattgctggcctacattgccactacttactgcttggagcatgaagttggcccaaggtgcagccatatgtagattggatagaaaacacacagagatggcacacattctttttaaactggctggagtaaccgggaaatatgaagtccaatgtccaatgtagaaagcatacatcatcctggtgtgtgtacccctgcctccaagattttagagcctggggatcagatgtccattataaatactcacagtgataatttcagatgggaattagcaagctgggtgagcaactggagcattttgagtttcttcaatggaggcaaaaagcctgactagaggtaaggctctacattctgaaccagagaatgttaccttctggtactttgattcattgtttcatttattcatgcattcattcattcattcattcattcatctatccagcaagcacactgtaaacagtatatgctgtaggtgagacatgtgtctagcatgcctgaaaaaatgaaatgaactacttgtctctacagaaaattttaaaaattagcttagcctggtggcgcatgcctgtagacctagctactggcaggagtgaggtgggtaaattgcttgagcctggtaggtcaaggctgcagtgagccatgatggcaccactgcactccagcctaggcaacaaagcgagacccatctcaaaaaagaaaaaaaaaaaaaaaaaaagactgtcttagtaggttttctggtgttcattaagagaacaggtaattttaaatttcagacatttgtctacaacattatttaagttcctaatttccacattcaggaggttttagaaatcattctggactcaacatgaacagttgttggttgatagtccataacttgccctgagaccttaggaaagccactttgtctcattatatctatgacacaaagattttgtgctcatctgtcgtcaaactgttccactaaattttaaattcagtttcttaaaaaaaatttaaaaatacgatcacaatgtttttgctgactctaacatttcatgtgtctactggtgacatatacctacataaatatgttttcaattataatagctagtcttgaggttttaatatatttaggaagtttgcaaggctttgtgagaatgacattttgtgacttaggcactgtcatttcacagctggttcataggagcaaactgtgccaaagagtctcagcaatgcaaattcatgattttcttaggtggaatttaataacaaaagttgctgtaattgatattttatattgtatttatttattttttcttcagagaaccttagcttatgtttgtgaataatgttgtcttaccaggagtagtggtgtgagtctagagtcccagctacttgggaggctgaggtagaaggatcacttgagctgggagttcaagtctatcctgaacaacatagtgagatctcatcgcattaaaaaataaaattgtcagccaggcgcggtggctcacacctgtaatcccaacattttgggaggccgagacaggcagatcacgaggtcaagagatcaagaccagcctggccaatatgttgaaatgtcgtctctactaaaaatacaaaaattatctgggtgtggtggcgcgtgcctgtagtcccagctactctggaggctgaggcaggagaatcccttgaacctgagaggtggaggttgcagtgagccgagatcgtgccactgcactccagcctagtgacagagagagactctgtctcaaaaaataaataaataaaataaaataagtctttataattttgtccaaattcttaagtctgaacattatttccagtaaaaggctaaataaataagggaatcttgattccagtttaaaatgtttacatttgatttttatgtcataattaaattttatgtttaaaatagctagtcttaatattaagtactttaaaaaatgacaaattatatagagaaatataaacatatgtgcattagaaaactagtaattatagttaactgtaataaccactgcttaatctaattcagactcctgctgttacgtgtttaagaagaccattttttatgcttctaaaactttattttgaagtcagaagttactgcaatgtgattacagttcaaactctagtagcatccaaagtccttggatgtctttgcagttatggaattatcttagtaagtactgttgaggaaattttctaagtcttatatctcttcttctgccaaaaatggaaagaaatgaaatcgaatacaaaagaaaacatctcaatacttgttgtcagaaaatgagaagaaagatattttccctttcctaatctgagccctttaccctttgagacaagaacttagtttttccaatttataactgaatccttatcaagtattactctaacccatatgcaggctgcacagttattttctcaaggagattacagttacaaattaaacatcaccggaacatacatttaaagaccagtatgaaaaagtatttaagataagtataaaattattttaccccaataaaaatataaataagaaagcattaaaaagtctgaagaaaaaaattaatatgaatctgatcaagtggtaaagtacctggtacacaaaattaaagtatatcagcccctaatgtgccgagggaaaaaaggcatagagatgtagataaatctggttgaaaattttatgcaaactagtagaagatatagtatcagataaaatataaccaattaaaaatattatactataaaatatttgctaagagttaacaaggagcaaatggtttgaaaaaggcattcgatgtaccctaacaagatatttctctatcaaagaaaacacttgcaaacactgacgtaattttattgaaatattatcaacaccagactcagatatttatttcttctgcaaattgacaaatacacagcaacacttttatcagatccagtgtatattaaaaccattagtgggaattaggtggttctggtcagaagcattttcaatttttctttccgttctgtgtcctcatttgaaaaacaaaaaagacactccatctagttgtgtaaatgtctaaagaaaagctgaacacattcaaatcgctagattccccataaagagttaatcctctcatgtatgaaatagatttctggtggcttaggaagattggactttacctctggtaaccatcctattctttgtttttctgaattcaatattgtaatttattttttattttaaaacttttaattgataataattttacatgaggtacaaaatgatattttgatatatgtatgcactatataattaagtgttatacactatgtaattacacactataattattatatactgtataattaattatacactatataattaagataacacctcacctcacctacttattttttgtggtgagaacatttaaaatctactttcagcaattttgaaatatacataaaataaattactattaactatgccatctaggcttttctatagatcactaaaagttatttctcctatctaactgaaactttgtatcctttgaccaatatttctcttttgcctatccccccaacctatcctctggtaaccaccattctgctctctgcttgtatgagtttgacttttttatatagcacatacaaatgagattatgcaatatttgtctttctgtgtttagcttatttcacttagcataatatcctccagtttcattcaggttgttcaaaatgccagaatttacttcgtttttaaggctctacagtatttaattgtgtgtatatactgcgttttctttatccattcatacactgatggacacttaggttgcttcacatcttggctattgtgaataatgctgaaatgaatgtgaaagtgcagatatcttttcaacatacgatttcaattcttttgtatatatactcagaagtgggattgctggatgatataattctatttttacttttttgaggaatttccacactgttttccaaaatggctgtacctaatttgcatttccaataagagtgtagcagacttccctttccttttctccacatcctcaccaacacttgctacgttttgtctttttgacaacagacattccagcaggtgtgaggtgacatctcattatggttttgatttgcatttccctgatgattagtagtgttgtgttgtgtattttttcatatatttcttggccatttttgttgtctgttcaggtattttacccatattttattatatgctttttggctattgagttgtttgaattcctcatatattttggattagctctgtatcaaatgtatgcttcacaaacattttctctccatccttgtgttgtctcttttcatggttaactctttccttggctgtgaggagctttttgattaagacaatctcattcatctatttttccatttattgtaccatcttcaatttctttcatcaaagttttagagttttcaatattcagatcttctacctccctggttaaatttaaccttaaatatttacttttgtttgatgctgttataaattgaatcattttcttaatttattttagaatagtacattgttagtgtatagaaatgctactgatttttgcatgttgattttgtatcctgaaactttaatgaatttattagttttagtagttttatttggtggaatttttagttttctatgtataagatcatgtaatcagcacacagaaacaatttcacttcttccttccttatttggatgacttttacttatttttcatgacatgttgttctggctcagacttccagtactgcgttgaatagaagtagtgagagttggtattcttttcttgttcctgatcttagaggaaaagtcttcaacttttcatcactgattatgttaactgtgagtttgttacttataacctttgtggtgttgagtttgcttttcttctatacctattttgttgagagtttaaatcacaaaagggtgttgaattttgtcgcatgctttgccctatctattcagatgatcatgtggttttgtccttcattctgataatatcatgtataacttatcgatttatatatgttgatccatttattcattctatggattaatcccatgtaatcatggagaatcattttttaatgtgctgttgaatttagttggctagtactttgttgaaaatttttacatgtatgttcactagggatattggcctgtagttttttgtattgtattgtcttcgtctttgttataagggtaatgttggttttataaaataagtttgaaagtgtttcctattctacaattttttggaagaatttgagaaagaaaagttttatttcctctctaaatgttgcatgaaattcagcaatgaagccattaggtcctaagcttctctttaatgaaaaaattttattactgatttaatctttttaccagttttcggtctttccagattttatatctttttcataattcagtcttggttgtttctaggagtttatccatttcttctaagttatccaaattgttggtgcataacggttcacagtatttttatatggacctttgtatttcttcataaatatttattaattttgtttttaatattctttctgcatgcatctatgtgcattcatacattgtaagtcaaaaaaacataattttttttgctttgaaaaaatgaaccagaagtgaacaagtgaaattttaaattaaaaatactttaccagtgacattagcaccacaaaaatgaaatagatgtaaatctaatgaaatatgcaaaagatgtatatgagggaaactgcaaaaatcttgtgaaagaaatcaaacaagaagtaaataaagtgagagatattctatgtttatgcataggacaactgtaaagcaagctaattttcaattgtgattatgattattctcatcgctttgcagtcacatctagcatattaatgccttgtatttgatttcgtttcttcaacctgacacacccaacattcaaaggtagaaaattgtgacttaaccattgttttaggaaccaaatcttgttctctttgtaaacgattctttctagcaccttcttatcgcttcactgtcttgatgtcctcatgattcctaaccactgtagaggttaacatctacacttgatcttagccaaaaggctgagaagtgatatagaagttaacatctaacaacaaacaattgttgaatgacaactatgtgtcaggtactgtgagaggctctaaaattatagataacaatctccatcctcaagttgcatagatactaatgagaaaggcagataagccaagagttacaggagttgtgaataaattctgaatgacttcctagaaatttctctgagagcagagtggaggcatacctaatctttcactggtattatctatgttagctatttataattgtgtaacatattaacataaatttagcagctcaaaacaatactcatttattatatcatagttcccatgagtcagtagtctaggcaagtcttcgatgggacatctgctgagagtctcacacattttcagtcaaggtatttcccagaatttcctagtatatatggattgtttgcacatgaaaaataatatggactattaaatatgtaaaataaagtttaattatatttaaaattaattttcataaaattaattttttataaaattacatatgaagtggttgcataaaactctaaatcttgtttctcttttcagttaaaagaatatttcttttaactgaattttccaacataaaattttgtgagaaataaaaactagaatgtgattagtggtttgatcaaatgcttctgagtccccttgttatataattcataacattgccttagaaaactgctaatgttaatttatagtagcattgtaatgaagtcaatttcattctttaaagtagactattggaatattaacattctattctgtaattcttatatcagttaagatataattgcacttaatttggcatctgaatttattaaatcataacttttgattgcacatactttgtattgcctgagaaaatattatgaaaaaagagcaatcatgaactcctattgctgtcaaattagataaactatttgcaatctaatagattacaatgaattataaatacttatgtagaaaatgtatctattaatttattaattcaattatattagtacgtatattaaaaagcaattatacacttaaatgtatatttgaccaatctagaacccagcctactttgctcctgttctaataaatgtgcaataacaattttgccattaagaaccacatgcttaaacctataaagtaatttggcctctatttgatatctttacctttgtacaacagaaacatttctactaacactgctatcaaaaaaaggtcgtttgttttattttaggtgacgtatttgaactttcaaataaaatgaaatgatttatataaattaccttcaaaaatagtaagattctacagaattttccagtaagattcttggaaattctaagttagaggaaaccctacaaaacctcccccaatattaaatgccagaaatctaaagcaatgtctgctctcctgtgaatgggagattaaatgttagaaccttgagcagaatcatgactcagtcctggaggaaatccactttctgggagaaacggttactggacccccaaacatagcacacaaggaccgcaaaacacacagcactgaattaacacagccctggccactgtctttgctgtggtgacaagcgtgtgaacatctactctgtttagtccttatttcctaagtaggaaatcaacagacattgctcagcttttgtgcctggaggaaaaggagcagcaagtatgggcatcaagtattaatataaagggaaaaggagggtatgcttgacctcggggctaggttaaggtaagattccagttgcagccacttgcaatggcatagccaatcctatctcatcaaacctttgggcctttttttttggcaacaacgactcctactccttgttacacttacctctcaggcttttgttgccctttttggtgtacaaatggtttggttagaaacaattgagatgatagtccaggcatttctgtttaaaggaagcccaggtgagagtcagcatccctcagcaatttatgcaaattagtctaattccacccttgagatctacatacaaaagggagtttcagccttgccaaatcaaatgaaaggccaacaggagaaaaggtgttcaatcccaggcagaagactctgtaaggtcttctggtgatttatgtcatgaaacaattcggtctaagggtataccatgccagttgttaaatatactgaatttcactctggccttcttttttatgttcattcatgttatagcgtgtatcaatattttattccttttaatggctgaataacattcaattttgtggatatttcacatttttgttatccattcatcagttgatggacatatgatgtataatacttttttgtgatcctaaatgtctcaaaatggagtcacttatgacaaatgactcagatcacagtaaaaatactgacctcagagaataagtatatgaatggtggactgaggtaataagataacacttgctgtggccaggcactcctgaaacctgagaagacgatggagccaaaaggcagctgagctagctatggacatttctctggcggatcataaaaaatgcaaagaaacttaccgtggccaacacctgcagaaactcttcccttttatgtctgcagcaatggctgaaagtcctgctaagagaagagcagcaaccacttccttccggctcctccaatggagttagcacaactaggctgattagaacctgacaggagaacacatgggttatttttaccttttggctattgtgaatagtgttgctataaaaattcgtgtagaagtttttctttgaatatctgttttctattcttttgagaatatacctcgcagtggaactgctaggtcctatggtaattctgtgtttaactttttgagtaatctgcaaactatgttccacaacagatacaccattttacatttctacacacaatgtataagggctacaatttttctacattcttgctaacacttgttataatttttattttgattgtagccatctcattgggtgtaaagcagtatctcattgtggttttgttttgcattttcctaatgataaattatgctgagcatcaattcatttgtgtgttggtcatttgtatattttctttggagaaaagcctattaaaatcttatgcccgttatttttttgttttgttttctgttgttattacagtattttatatattctggttattaattttttaacaaatatataatttacaaatattttctctaatactgtggcttttctgttctcttgatagtgcacgtattagtcagggttttccagagaaacagaaccaataagagatggatggatggatagatagatagatagatagataaacagatagataaagagggaatttgttatgggaattggctcacacaattatggacacaagaattcccatgatatatcatctgcaagctggagaaccaggaaagctgtcggtgtaatttagactgaatctgaaggcttgataactagggacactgctggtgtaagtcatggagtccaaaggcccatgaaccaggaactctgatgtttgagggcaaaataagatggatatcttagcctaggaaaagagagttaatcctccacttttccactgtcagaactctcaacagattggatgatatccacccacattagtgagggtatatcttcacccaggctggagtgcagtggcgcaatctcagctcactgcaacctccaccgccctgggttcaaacaattctcctgactcagcctcccaagtagctggaattacaggcacccgccaccacgcccagctaattgttgtgtttttagtagagacagggtttcaccatgtttcccaggctggtctcgaactcctgacctcaggtgatccactggcctcggcttcccaaagtgctgggattacaggcatgagccacagcagtttgctgattcaaatgtcagtcgcttctggaacaccctcacagacacactcagaaagaaacttttacctgctatctgaatatctgtttttaaagtaacggcaagaaccgcaattacttttgcaccaacctaataccttcacattttattcttgtccccatctatgtcttctctccttccgtaactttcattatgcatatgttaatgtgtttgatggtgtcccacaggtctcctgggctttgttaacttatttttttttcctctgttctcctcagactggataatctgaattgtcctattttcaaatttgtcgattatttgttctgtcttattatgccgtttttcttttctactaaactttttgtctgttattataccattcagccccagagattctagttggattatttttatatttttcatgtttttattgatattttctttctttcatacatgtgtgtcctttgttcctttagttatttgtccatggtatttttttagttcttttagcatattcaagacagttgatttaaagtctctttggaagttcggtatttggccttcctcagggactgtttctacgtttccattcatttattttgtgtatttatgattgggatatactttcttttttctttgcttgcctcatgatttattttgaaaattgaacattcggaatattgtaaaaaactgtgagttttttattagatctcagaattttgaaaaaaaatgattctgagttgcaatattagaaaacaaattattctacctcctaagggtttgttctgctggttgttgtagttacttttcattaagtgacttttatgaactgtttttataaagtgtatatattttgcatgtgtggaaattgatgtgtttgttccattagcttagtaatcagctagagatctggcaaacaatacctaaaatgccataaggcaaaaataaataaatatttaaatatcttccagtctttgcaaattgggtctgtgttgggacacccctacaaagcttagctaggttgtttataactctatcttaacatttaatttctgcttgcacagagcttagctattagctagtagtgaaagctcatggtcttcgtacttattttccgagtatgcatttttgtcctgggaatgtatatggcctcctaggttccccaacatacaccaaaacttttaaaagtacttattgcttcaagtatcttctctcccagcttctttttttaccaggcttctcattctgtcgaatgttggcatcagttttagtcctttaccccaggtggctgtagctaatacttttgcatttaacatttgcttttgacaaatgttgctcaagaagccacttcagccctggcaatgctttatgcaagtttaacaaacacaagctcttgagctaatccttcagaggtatatcagacatgtcaaaacacacaacccttttgctttgagaataatgtgtatattgctctctctagtaccagaaacttttaacaggtatgtggattcttccattcatggctactgccaagctgaggagtaggttataaaaaatgattaggttaaaacaccaaaatattctcttatcaatattcaacagcttttttttaattgagttttcctgattgctgtgagttttttattagatctcagaattttgaaaaaaaaattgattctgagtttgtgccagcctgtctattattttatggagggacaaagttttaatagtttttactgtgccatttttgatgacttacaaaagttatttttatatcagaaggaactgagtattgtgtgaaagtagttttctttttttcctcataatttcaatggtaattcacaatctatttgctctttgattttgattcaacttattacaactgtttctcttttgtttttgttggtagctactctcctctctacatgcctataccactgacttctctggttaacatagaaaaaataaaatctcatcctgtcaatgaacatttgggaagaattattaacctcatgatgaccataggaatttggggaaacgttacatgaaaactgtagtctcaaatcaaaatagtaattgttcagaaaattacacataatatgagtctcctctacattggtgtatcttctcccactttagtcaccctaattcatttccttattgttatcatatcattatcatcccacgctcaacaatcacatactccttaaacaaatgtgaggataaaatctgggaatcaaaaatctgtacacatgtggtagttatttattattaggcatcttctctgagtttcttatcaatggtactaccacttagtctgccaggttctgtatgctttggaggtacaaatattttagtaccaagcaacaccacttcaaatgccatatactaaatgaagaaatagtaatttctattggtctacacccatgctaattttatagacctgattactattgcaagaaaccttagaatatggaaaaggaatacagcaaattttaaagtttgacatttttaagctagattctcaagaattttaatttattattttgtttattactccccagggtttaatttaccaaaaaaatacagcaagtattctaggcttgaggacagtaaataccaaagaaaggatatgattcctgccctcagagtagtcacattaaagtgaaggaagcaaccttgtataggactaatctaacttacaattaaactgttttaatttggagtaggcgccctctccaggtggatggtaaaagtttactgagcacatatttcattcataaaaataaaaaaaaaaatgcatcttttgcttcagtgtatgcaaccttgtactgagcgatccttgccctcaacaaggtgctccttgcaaggcatcatctatgctagtgtacatggtgtccttaaatatgtccactaatttctataacacacacagagcatgacaatttgtataacaaaaggaggaatttatttgtttataatggtacagacaagagataactgataaacaaatatgtttgatcaaagagaatgagtagaaatttgtcagataaacaatgagatgatcaagagagatgtgttagggagaagaccacgaaaagagcaaggcaaaacaggtaagcatgaaatttgacggactcttgaccagagaactctgagaatggtttggaataagtgacaacaaattgtttgcttagataagataaagtgatattgaaaagagcagtaaagttcaaattgaataaattaggttttgttttactgaaggtattgagcatagatataatctgatttcatctttgttttatagtctctgtagccaatattgggtgtatattcatttgaagacaaaaacgggaatcagggagactggctaattggatcttgcaatctattctctgctgcctttcatttttttctatgattctggaaaggaatatgcaaatctactgtttgattactagcagtagaaacagaaaaaggactgtaagaagcaatggtaaaagaaaatgtgacaaaacttgatttgataaaagaaagaggaagaagaaaatggggtataagggagaactgtaaagatgaatctggctgtaaaaataaatattaataagggtatggatgatattcagatttgaaggcaggcaaattttcatttgcttgcagagcaaataaatggcaaattttttaatcaaatatttttttttccaagaaatatggtaataatgggcaagagaggaagggtgttcattttattctcacaataacatccagagtctaaatacagctttctggtatttgctagagaatgtcataccacgtactctgtatttttattaagcaacctgtttatatgttattccatttaaatatgtattactttctgcaagtgtttgtgaagtaatctctcaggaatgcagttaagattctgtaaaaatgacggaatttactcagtatagtcatccaaacctttttttaaaatttacttaacttttattttaaattcaggggtacatatgcaggtttattacatagataaatttgtgtcttgaggggttgttctgcagattattttgtcactcaggtattaagcatagattatttttcctggttctctccctcctcccaccctcctcccactgataggtgccagtgtctgttattctcctctatgtgttcatgtgttctcatcatttggctcctgtggtctcatcatttagctcccacttataagtgagaacatgcagtatttggttttctcttcctgtgttagtttgcttaggataatggcctacagctgcacccatgttgctgcaaaggagataatttcattctttttatggccgtatagtattctatggtatatatgtaccacaatttctttagtctaccactgacaggcattgagattgatttcatgtctttgttattgtgaatagtgctgcaatgaacatgtgcacacatgtgtctttataataaaatgatttctattcctttgggtatatacccagtaatgggaatgctgggtggaatggtatttctttttttagctacttgaggaatcagcacactgtcttccacaatggttaaactaacttagactctcaccaacagtgcataagcattttttctccacaacctcaccagcatctgtattttttgacttcttaagaatagccattctgactggtgtaagatggtatctcatgtgggctgcaatttgcatctctctaatgatcagtgatgctttcttcatatgattgttggctgcatgtatgtcttcttttgtgtaggggttcagtcaggatggtggggaaaattataaaataaaacacgaaccttcttggaaggccaaaaggtttttgcatagcttcagatagtttggctgagagcagccagtctctttgcaggaaccagagtgcttagggcccagatacaaaggaatgtagagtagtttatctaaagagcttgtttactcatgtggtcctaaagctaacctttgattactcatgggcaggatggctctctcgggggtaggtaaccaggttgattaccctctaatagtgttgacttaaagcttttgtcatttaatgtgtgctaaataaatgccaagaaggccagctagctggggccgtggctgacagcactctccttagagtctgtaagtggcctggatacttggccggtctgacaagcagaatatctgtgtcagtgtacattatgcatctgtcattgaatcaggatatgcaagacagactcctgcacttttgaaaagtgtctattcatgtactttaaccatattttaatggtgttttgtttttcttttgtaaatttaagtttcttgtagatgctggatattagacctttgtcagatgcagtttgtaataattttctcccattctgtaggttgtctgtttactctgttgatagtttcctttgttgtgcataagctctttcatttaattatataccacttgataatttttgcttttgttccaattacttttggtatcttcatcataaaatttttgtccattcctatgtccagaatggtattgcctaggttgtcttctagggtttttattatttggggtttcacatgtaagtctttaaccataatgagttaattttttatatgatgtaatgaagtggtccagtttaatttttctgcatatggctagccagttatcacagcaccatttattgaacagggaatcttttccccattgcttgttttcaggcttgtcaaagatcagatagttctaactgttcagcctcatttctggactctctatgctgttccattggtctatgtgtctgtttttgtaccagtaccatgctgttttgtttactgtagtcctgcagtataatttgaagttggatagtgtgacgtctccagctttattctttttgcttaggattaccttggctattcaaactctttttttggtaacatatgaattttaaaatattttttcctaattctttgaagaatgtcagtggtagtttagtgggaatagctttgaatctgtaaattgctttgggtagtaaggccattttaatgatactgatccttcctatccatgagcatggaatgctttttcatttgtttgtgtcatctccaatttctttgaggagtgttttgtagttctccttgtagagatcattcacctccctggctagttgtattactaagtatttgttttttttatgtgacagttgtgaatgagattgcactcctgatgtggctctcagcttgactgtttttggtgtgtaggaatgttagtgatttttgcatattgattttctatcctgagactttgctgaagttgtttatcagcttagggagcttttgggctgagactatagggttttctagatataagatcatgtcacctgcaaacagtgatagttttacttcctctctgcttattttggatccctttatttttttctcttgcctgattgccctggcaaggacttccaatactatttcgaataagaatggtgagagagggcatccttgtcttgtgctggttttcaagaggaattcttcaagcttttgcctgttcagtatgatgttaacagtaggtttgtcacatatggctcctattattcttaggtatgttccttcaatatctagtttattgagagtttttaacatgaaaggatgttaaattttattgaaagccttttctgcatctattaatataatcttgtgttttttttctttagttctgtttgtgatgagtcatacttattgatttgtgtaggttaaaccaactgtgcattaaagaaataaagcctacttgatcatggtggataagctttttgacgtgttgctgaattccatttgccaattttttttgatgatttttgcatcaatgttcataaaggatattggcctaaagttttctttttttttttttttggttgtgtctctgccaggttttggtatcaggataatgttggcctcatagaatgagttacggaggagtccctcctcctcagttttttggaatactttcaacaggaatggtagcagctcttctttgtacatctggtagaattcagccacgaatttgatcctgggcttttttttgttggtaggctatttattactgactcaatgtcagagcttcttattagtcttttcagatattaaatttcttcctggttcagtcttgggagcatgaatgtgtccaggaatttattcattcttctagattttctagtttttatgcatagaggtgtccataatattctctgatgattgtttttatttctgtggggtcagtgataatatctcccttgtcctttctgattgtgtttattgaatcttctatttgttcttctttattagtctagctagcagtttatctattttattaattttttcaaaaaaaaacaacttctggatgtgttgaccttttgaatggtttttcatgtctcaacctctttcagttcagctctgcttttggttgtttcttgtcttctgctagctttgggatttctttgctcttggttctctagtcttttagttgtgatgtttggttgttaacctgacatcttttttactttttgatgttgtcatttagtgctatatatttccctcttaacactgccttagattcatgccatagattctggtatgttgcatatttgttgtcattagtttcaaataacttgatttctgccttaatttcattatttactcaaaagtcattcaggagcaagttattcaatttccatgtaattgtatgattttgagtgaatttctttttttttttttagatgaagtctcattctgtcgccaggctggagtgcagtgacacgatctcagctcactgcaacctccacctcctgggttcaagcgattctcctgcctcagccttctgagtagctgggactacaggcgtgtaccaccatgcccaactgatttttgtgtttttagtagagacgggttttcaccatgttggccaagatggtctcgatcttttgacctcttgatccacccgcctcagcctcccaaagtgctgggattacaagcatgagccatcatgcccggctgagtgaatttcttagtcttgagtttatttcactgaactgtggtctgcgagattatttggtatgaattcagttcttgtgcattttctgaggagtgttttacttctgattatgtaaacaattttagagtaagtactgtgtggcaatgagaaaaatgtatattctgtagtttttgagtggagtattctgtgtgtatctaccaggtccacttgatccagagctgagttcaagtcctgaatgtctttgttaattttctgtctcaattatctgtctgagattgtcagtggggttgttaaagtctcccactattattgtgtgggtgtctaagtccctttgaaggtctctaagtactggccttgtgaatctgggtgctcctgtattgggtgcatatatatttaggatagttagctcttcttgtcgaattggaccctttacaattatgtaatgcccttctttgtctttttttgatctttgttggtttaaagtctgttttgtcagaaactaggattgcaactcttgcttttttttgttttccatttgcttggtaaattttcttccatccttttatttcgagcctaggtatgtctttcatgtgagatgggtcttttaaaggcagcatactactgggtcttgtttctttgtccatctgtccactctgtcttttaattggggcatttataccatttacatataacgttagtattgttatgtgtggatttgatcctgtcatcatgatgctatctggttattttgcagagttgtttatgtggttgctgcacagtgtcacttgtctgtgtacttcagtgtgtttttgtagtggctcataaccattttcctttccatatttagtgcttcttccaggaactcttgcaagatgagtccaatagtaatgaattccctcaacatttgcttgtctgaaaataatcttatttttccttcacttatgaatcttagtttgactggatagatatgaagttctgaattaatttttttctttaagaatgttgaatattggcccccaatctcttctagcttgtaggatttccactgaggagcttgctgttagtctgatgggctgtcctttgtacattacctctgctttgtctattctgctattaatacgtgtgattacattttgaagttcttgtagtgtgtttttcagctctaacaggtcagttatcttcctttctaaactgactattttggctgtcagctcctgtattgttttatcctgattcttagcttccttgcattgggttacaacatgctcctttagctcagtgaggtttgttattacccaccttctgcagcctacttctgtcatttcagccatctcagcctaagcctaattctgagcccttgctggagaagtgttgcagtaatttggagaaaaaggcacacgctggctttttgagttttcagcatttttgcattaattctttctcatccttgtgggcttatctacttttgatctttgaggttgctgatcattggatggggtttttgggttttgttgctgttgttttctgtttgtttttcttttaacagtttgggcactcttctgtagggttgctgtggtttgttaggagcctgctccagaccctagttgcctcattttttctcatacctggaggtatcaccagtgagggctgcaaaatgccaaagatgacggcctgccctttcctctggaagctctgtctcaggggggttctgacctattgccaacccaaacgtgcctgtgggaggtgactggaggccctggttaggaggtctcacccagtcaagaggaatggaatcagggactcacttaaagaagcaatctggctgctttttggtagagtagtggtgctgggttagagaccccttcagcccctgatcagcttgagctttcgaaggcctacaggctaaaccggctgagaagcctgaatggctaagctggtggcctgccctgcccctcaggcactccatcttagggagaatatgggtggccagaggccctggctgggaggacccagctgggggaacccccccccccccactagaaggagtggattggggtcctgcttaaagaagcagtctggccatgcctcgataaaacagctgtgtcatggtggggaaccgcctctgcccctgttggcttatactctacaaagcccataggctggaatggctgagtcgtttgacatacgcaagtggtggtcctcaccctgactcaggcattctgtcccagggagagatcagagctctgcccctaatacatgctgacaggcatagctggaaggtctggctgggaggtcctgtccagtgagtaggaatggatcgcggcctggcttaaagaagcagtctgctgtgatctggcaaagccgtggtgttgcactgctggggggcccttcctcatctggactgtttggactctccaaaccccgcagactggaactgctgtgtcatccaaccaagccgtgtggtggctttcctttcctctgggcactctgtcccaggtagagatcagagctctgtccctaatacatactggcaggcatggctggagggtctggctaggaggtctcacccagtgaggaggaatgaatcggggccctgcttaaagaaatagtctgtctgtaatctggcaaagctgcagttttgcgctgctgtgggggacccttccttgtcgagagcctttggacttttcaaagcctgcagtctggaatggctgagtcaaccaaacagcagagttggtgactgtccctctccccagggctccatccagtctcaggcaggctccacactcttgccaatggtgggctggaattccaagtcagtggatcttgtcttgtgacatgccatggaagtggggcccacagaatgatgctgctcagctccccagatccacccccttcctaggggtatgtgtagacctcctgccttgcctgagttgcagacacatttgttggagaccctggggttggaatatgtaaagctcctgggtttctgcgcatgcccatgcaactgctctgcaaagactccacaccactctgtgtgtcacacccaaggctttggtggcatgggctcaccaggggatctcctgatctgtgggttgcaaagatccatgggagaagtgtggtttcctggggtcacgcagtcactaaccacttttcttggctgggtgtgggggttcccttggctttgtgtcactccctgctgggctgtcaccccactctgcctttcttctttgtgtgtctagttgttttcctaatcagtcccagtgtgagaacctgtatatttcagttgaaggtgctatattcactcacccctttcattcctctccatgagtgctgtggactacagctgcttctaatgggccatcttgatgcatgtgtattttcacaaagctagaagggaggattctgaatatttccaacacaaagaagcaatgtttgaggtgatagatgtgctaattacactgatttgatcattacatattgtatacatgtatcaaaatatcacactgtactccataaatatgtacaactattatgtgtcatttaaaaagttttaaaaagttaaaattaagattccatatgaaaaaaaaacacagaaaaacccagtaaggtatctagaagaggcatgtttaaaaatactttaataaatattagactctgacccaacatgcaaagatactcccttcacaaatatctaagtatgcgttgagtaaaattaggattgacttcaatgatttctcatttccagttaaatttttgaagtgttttaatagtatttctatttcagtgagtgtcaatgctttatcacatgaatgagatgagcataccaaaattaattgtgcatccaaaagttttatgaattcataacaaagttgagaaaatattactgcagtgtcagaaaacagtgtaattaacttttacattctaagtttttacatcagatttacacattgtaaaatacatttgtaattagtgaaatattcactacgtttattttaaatactctgagcattgccttagctttaaagctagaatagaatgcttaattaacatattaataagaaaggtataaattattatataattgcttatcatttaagcttcctaatgatcaacattaaaaagtctgtatgtgtaagattccttttatatctgtttcaaagtcattttacatatctatatatgatatgtataatataaatactatatgtattacacatattaaattatatatacatatattatagattgaaatattatattatatactgtatatatgtaatattatataagatatataatatgtatgtatataatatgtattaatccagcacctaaaagccaacaacttccacaaattaataaaattgtgtccaattatctttcacgaaagtacaagagttctgtgaaaccatatcttgctcataatttggaaaatcaccaattgatattggttcagagtggacaactaaatcaggtaccacagaaaagtttgtgtgccaagcaattcagaggaaacatttcatttgcagattttctgttaatgacactgaagcttccgtgtaatcgtatttgcaatcacaaatgtgcagaaccactgctcctgatgtcattacagctacaataactatgttttttcaatacataatcatgtttcatatggaaaatggggtgatgtttggaatggttaattaccagtgctagcaaattctacaatgtaaaaggggctatacaaaaatagcaccggatcctgaagaacccctgctgttccaggccttaactctttagttaccaggtctcgaatgggtccaagatccagaggaaatttttgaggcagctctggtaccagatggggcactgagaatagtagccagctatcaactatccaagaagtatgtcaagattttattccctggaaagtatctaccactgtgtgccaggtgaacaccagccctgattttagttgaacctcatcatactaacttactgtacatatctaattgtcctcgcatttagaaggatgtttaatagatgttaatccatatattatgtgtcctctcatccacatatgtggataacatccactaaacacaaaagacttgttatataagtaatgaattttataacaattggtgtataacaaattttaaataattttatacaattttcttagtaaacagattatgtaatagcaataaaatactcattggtaaagctggttctcatagtattaccatttaacaatacagagagcactatacatgtaaattgaatttaatgactaaatacatgaatagtagatgatggatataaattcattactgttggattgggaagttatagaaaagcaatggggcaaagctagaatgatctgcttggtactgaatcagaattttagatgtcagaaataactcatgtttagctttatatatatatatacagattgacatacacagaaatatttatagctatatgtacatgcagaagttagcatacacacatatattttcttgctctgtcagttgagagggcctagaagcatcaagacttcaaatataactaccacctatttgccaataaagaagaccattcttcggtaaacagaaccaaggcttcttgtagaaatagccaattctaggcttgggacaagcaacatgcaagatgatcctgcagcaccttgtactgatagaaagtaagaaaagcctcaaaaaataactatgaggctgggtgtggtggctcatgcctgtaatcccagcactttgggaggctagagttggaggatctcttgagcccaggagttcaagaccagcctgggcaatatatcaagattccgtctctacaaaaatatttaaaaattagctgggtgtggtggtgcgtgcctgtagtctcagctactcaagaggctgaggtgggaggattgcttgagcctgggaggttgaggctgtagtgagccattgcacttcggcagcctgggtgacaacaacaacaacaaagaaataactacaaagatgacaaagatgaagatgtgtcaaaggggcacaggagccagcagaaaaagttcctatttgccaaagctggaaaaacttgaggaacaaaataaagtagtatagaattataattcaatatataaaataaatacccaagaattcatagtgatacaaataaatgatttaataaataaaataagtaaacaggggagaataggtaatgcccctttgcaggacaatttcacataatttatgttgatatgcataccctttaagcagatcatgcataacttcccacttctatggtaggcagagtgtatttactttattccaataagtatatggaaaggggatatagcataacattatagtggaaaaacctgacaatcagtacctcaggcaggtgaacaagatagcagacctcattcctgctatcaggaatatcagtttatcacatatgatatgtactgagaatggtattttatctccatgttctattgctccgaaaccatgacataaatctaaaaatgaaaaacaaatcagacaaaattaaatggagaaaaactgtacaaaatatctaaccagtacgtctcaaaactgtctaggtcataaaagccaagaaaagactgagaaactgatgcagaaaagtggagcttaagaagatatggcaacagaatgtaatgtggcatcctaaataggattctcaaagagtaaaacgccattggggtaaaacaaaaaaatccaaatggagtatagactctggctaacaataatatattaatatagttgtattagttgtgtcaaatctgctatgccaatgtaaaatgtaccaatatagaaaagtgtttatgagtgatataggaaatctctgtactattgtcatttttgtaaatgcaaagttgttataaattttttaaaggttattaagataaaatttagaaggagacaaaatattgtactagatataataaaacttgatcttaaacctagcttctctcatttaagggctgattgaaaatacagaagataaagtacctagcagtgcttctgatttttatactgcaattgggacttatataatgtagaatgtggagctcttcaaagcataaagttagataatatttgtttttgctcttcattagcttatttgcaaagagagaattattagcaggataaaccaaatataccctaatgtcaggaagatacaaatctaccctgaagattctcacaacactattttttaatagtaacgttatttcctgacaaaatgtttgccagttttcttagtccattcaggctgctgtaacaaaatgtcttagaccggtaacttataagccatggaacttgatttctcacagtttggaaggctggcaagtccaagatcaaggcaccagcaacatctggtgagcgtccattcctcatagatggtaccttctagttcacatcatggaaaggacaaggcctcctttatcagggcaataatcccattcctgagggctctgccctaatgacctaatcacctcccaaaaggccccacctgctaataccgtcacctcgccagttaggatttcaacatataaatgtgagaaggacaaaaacattcagaccatagcaccattgtttaatctaatcccacttgttggcagtttccctaattcaatttttctatgacaattgcttcctgagttttactatgcacatgaattacctgggaatttttttaaaacatggaggctgattctttaaatctggagtggggccagaaattctacgtttcaaaaaagttcaaattctacctttcaaaagtctatatcctcagactagcaacctcagcatcaaatgggaacttatataagaaatgcaaatttgcaggttccatctaagacttactaaaccaggaaccctccgtgtggggcccagaatctgttttaacaacccctccaggtgagtcagatacaagataaagtttgataaccactgtctagagcaagggttctcaactttgacttcccctgggaagcatttgaaactttcagctcctgggtcaccctccagacaaattatgtcagtattcctcgataccaagaagacatctgtagtttgtaaaacctcccatgtgtttttaatatccatccacagtttagaaccactcttctagaaaacaaaaacgctaatattttaacaaccatcctatatgtatttaaataaccctgtttcatattatctagtcaagtaatttataattttatcatttggcttaaattttatttttcaatatttcaatatctcattttaattatcttataaaagtgttcattttttttcttttgctctaaagttgtttaatctcaacctgggtactaaaacatgggaaacatataatcatgttttaatacaatgggtatgccttaaaaatttgtggaataaagaaaataatgaattgaggacttcagggttctgacattctcctcattgctatgtatgaacctttggattgtgcttgtgttttagcacagggccactcctaattcaggttaccatgatggctgcctgaaatatacaattgaaatcaattcttgcctttccaaaagtaaatagtctaggtttggaggttaatcgtaaaaaattattaatctctttttggcatttttagaattccagtgaacataatctctcagagcattgctttaatccttcgcaagatctaggtaaagtaccagtctgacagctaacttattctaagttagaagaaagcaaggagacttcattgacattattaaatttttttttccagaatgtaatgtttcctctctaaaatctgaaatggaaactatggtatacaagatgggatttcagcattctggtacctcttaaaccatgttatctctgtgcatttcccagatcagacacatcttcaaacataacaataaataccaattctgaaacacgaagtaaataatctggagagtctccaaagcactcttcaacctccatgaaaattgcattgctacctcttgccccttcttttctcctgcccaaaactctatgtccatggcgacttctcttatactctagaagaattcaacaacactcctaatagtagaaaactcatgcctctataatagctactgggattgttttgaaaaaaaaattcggagtactgattctaatgctaacgacaatgctagtgtatttacccagttattattgcttgtcagggactgttgtaagtactttgaaagaatttcttgttaagttctcacaataatcaactactcaaatattagatgctcacaatgacttatctgtttgtcacataccactcttactctctttcttctttaaactcatttattttccctttataacatcacttatctatatgtttgctgctgttttctctgtctttaccactgaaataaaagctccaagagggcaaggccttctctaccttgtttactgatctgacttcattgcttacaaaaaaagccaggcctatagcaatcgctaattaaagacagaagaaaaaagggaaataaggaaggaagaaaggtagaaaggaaggaaagaagaaaagaaggaaaggagagatagagggaaggaggaagggaaaaagaaaagaaaggaggaagggaaggagagagggagaaagcaaaggagggaaggaaataagaagagagaaagtgtgaaaacaagaaaatgagtcaaggaaggagtaagtgagggaggaagaaaagacaaaaatgcctgcttgtagaccaagaagattcactggagcaaacagccaagacatattaggaacccaggtttttggtggtatgaaatgcctgtggctgaccttacttgtcactgttacaaagtcgtggacacctgttaggctcactcagtgctcagctaaattaaaaaatatacaaaacctagaagcaccttatattttgtatgtcagagatccttctaacataactttagttttgtggatgataatatcctaagaaatactgaaatattacctctttgttcttatacaggcttttcagaattacatttgcaattcattgggtttacatttacagtggaaaattattcttctaattggggatttctgattatcttgaagctgtttaataataaatgcattaaccataggtgatgatgtgcagcaggattcagggaacattctctatagatgcaaatttcccccactaaagttagcttttcaaggccacttcagtttactggctctctgacaaccatcttaaaatatgtcaaagaactatcttccccttgaggtaaaatattttgatttacttcacttgcaaattgaattttatgaaagacgggtgtgaagacaagtacaagagaaactggaactgagtaggaagttacaagaaagcacacaaattctacagtcccttcatttttctctttgtgccataaaaattgaaaccaacataaagaaatcaaacatttgaatgaagaaagtgtgcatttcaatagtaaatatctcattcaaatatactcaagtgataacttgatacattgatactttactaaaagaatgatgattccacacccagacttgagaggactagaaaaccagtgctgcatcatgagtcaggaaaataaagatttttataagcaactggttgaaacttcagagaggacaaaattgtaggccaaaaatacagagtttcccatcagtaataaaagccagccctgcaagaattctcagagattaaagcatgtttggaatacagaaacagaaaatttcctgaacatttagtgacaaataggaaaagatgaaagtggccatgcagaaaagtgactccatggaatagtaaatctccaaaccttagatgttcagcaaagagatgaaaacttagcttgaggataccattgataaggcttcaaagcaacacacactttgtgaatgcacatagcacttctccaaacgaatagaagtgagctttgaggtccttatacgatgaagctaggaaaattgccactttagggtatcagcaagagatttctaaattaaatctgaacttgagaagaaagtattattttgcaaagaggaatgcgaggttcgaagaaaagaaaataaattaactggtgaaaatgaaaggcttttttctgttgtggatagcttagcagctcaaaatagacaatgtgaaaatgagcttgagattttgtcattaagagtaggttgccttctggaaaacttaaattgcagaaaccatgcattagatcagcaatgagaaagattttctggagtgttttcaagctactgtttctaagaagaccaaagagtttgagattttgagaagttctgacacagaatcaagaatgctggatccacttttgaaatctcattatagttattacctgggcaagtctttaaggattgcaatctctctttagaaagccaggcaggccaaacaacttgttcaagaattgagaagtctaaggcttaatttgcctgaaggaaaatccatccagctggcattgttgtgagccaatcttgtatcttagagataaagatattttgatgagctctgtcttagcttcagatgttatacatgctatgagcaaagatagtttttgtatattcagggtgacagcttatctcttacatgtaccttgaaggccagttctgttggtcttctactaattctactactagttccaacagaaaatgacaatgaaaagaataagatggccaggattctggaaggatttaaatctgtcctacataaaaacagactgaaaatcaatctgtgtattttccaccggaagcctaagacaggatgttggctattattaaagcaattcttacagctgttgctgaaaatcatgttagagtccagttggtttaaaagaagggctgtacattacagagattacttgtgatgagctcattctagctactgtttgtaagaaactgtatcatattgaatgtgttcccaaagggaaaattacagtctttgtctgttactggaatcacggtgttcccaggaacatgctctattttatccatgttctttctttgaatgagtggaagggagatttggcatcaagttcccagaaaaaataaaaaaggtcgcctactcataataacttcaacaattaggaagggctcttcagctagtctgtttgtagcagtggactgatcctttgctaagagagacatagaactaaactttctcacagaaatttcaatgaacctatggctcaggaactgtacagtagataacaatcttcaaggaaaagctgtgttggctgcctttctcgattctttctgttgagcaaccatgaagatgtctaaccctggcatataccaatgacctctcacttacatttttctcacagcagtctttcgaggccctttcttctgtggaattcaatcacgcagaatatatgttttgcttcagccacatgggattggatatggactcacagtatgaaaggttatgtgtgcaggagctaatatggcctgtaactcctgttcccaattgttatagctctctgcatgtcatagtatgaagtgagtatggcatcaatacaccacaaggatgataagactgtggaatgggttcaaaccaccagcctgaggagcataagaacactaaatctgaatgcaccttcaaccttttcaactctgagcttccatgcttaatctaagaacaagttctctggagaagttctagtatgccagacacttgaaaatgtgatttgtttttaagagtctggagcaggagagattacaacacctgtaagagattctaagagccaagaatgagcttcaaaattataccaacccaaccaatttcaaccatgtggttcaccctgcctggagatggaatgtatgatgtcgtggctctcactctaaatactttgcttacttcattagagaaaaagccaggttctgctccggtcaatctgtcctagtagggttagttcagaaataaggcatacatttcaaggctctcatcagatggatcagaggtgggagtgagcatgcctttgagaagtgtctgatcttgaccagaattttgacaaagtgcctcattcagattctaccacacactgaactctatcgaatgaacgacttcaacgccagcagcctgctgagttgcaccttccctcacaaaagccaactcttactaggttttgagaggttctccttatgcacctgaaacttactccatggcctttcacaatcacctcctatttcaatgtcaaggctaatgctgaatctctagtgttgtccaaggacatgtagaatctatttactaatatgaaaatgaagaaaatatttattacactaatgattagttttaggccatgttattccgtagaggtaggcaagatccatcttctgcatagctctgagacaacactgtttttattttcccttaaaaggtcaccacacagtgtctcttctattctgaacaaactgagatgctgagtaggactcgtgctcaactgtgcctgtgaatgattacatgcctcctttgtaggaaactcttttctatagtatgtatggtgtagaggagtagagatctgagcatgagtgtaggtgaatatcctttcatttttaactcaatgtaaattcaaatgacaagtatcatcctttattatttttatgtcttctcagaagacagactataataaaactcattacatttataattaaatttaaaatatcagtgacagttgtatgttccttgcttttcccaatttgggtttttttttaagtttattttttgatcttataagatttaaatgtagtatatggattactgatttgctttcacaatctaatcacattcttttatagactataattggataagatggtttacagttgtggcaatcctatctgaaagatgcatatgaattttacttcaaagtgagttacagaaattctatttcaattttttttttttttttacaaatttgaagagcttttgccaaaaacaaatgttacaaatataataataacacaagtttaactcttggtatttttagaaaaattaactgaagcatgcttttaatattgcgaccctcggcaatgctgacaataaagtgtagtagatttgttccaattaaaatcagtttaaatcattaaaactaaatgtaaattgatactctgttaaataaaatttaacttttttctgtttgaagcgtatttgtggttattcgatataacacagagatgtcgggtttatttttcaaagtatatttcataaattttaaggagtaatttagtttcatttttataacaatttctcaattttgttttcaggctgaaaaataatttagctattaaaatgagtagaactacagttggcctttgaacaacataggtttgaattgcatgggtccacttatatgtggatttttttcaaccaaatgcggatcaaaaatacagtatcggccaggcacggtggctcatgcctgtaatcccagcactttgggaggccaaggcaggcggatcacttgaggtcaggagttcaagaccagcctggctaatgtggtgaaaccctgtctctactaaaaatacaaaaattagccgggtgtggtggcaggcacctgtaatcccagctactcgggaggctgaggcaggagaatcacttgaacctgggaggcggaggttgcagtgagccaagattgagccattgcactccagtctgggcaacaagagtaaaactttgtctcaaaataaataaataaataaataaataaataaaaccacaatgagatatcatctcacaccagtcagagtggctatgattaagaagtcaaaaaaacagatactggtgaggttgtggagaaaaagaacgcgtttacactattggtgggagtgtaaattagttcaaccattgtggaaaacagtgtggcaattcctcagcagcctagaagcagaaataccatttcatccagcaatttcattactgggtatatacccaaaggaatataaataattctgttgtaaagatacatgcacgcgtatgttcattgcagcactattcacaatagcaaagacatggaatcaatctaactgcccatcaatgatagactggataaagaaaatgcagtacgtatacacaatggaatactatgcagccataacaaggaatgatatcatgtcctttgcagggacacggatggagctggaagccattattctcagaaaattaacaaaagaacagacaaccaaataccgcatgttctctcttataagtgggagctgaatgatgagaatacatggacacattggagagaacaacagatattggggcctctcagaggtgaggagtggaaggagggagagcatcaggaagaatagctaatgggtgctgggcttaataccttagtgatgggatcatctgtgcagcaaaccatcatggcacatgattacctatgttacaaacctgtacatcctgcacatgtacccctgaacttaaaaaaaaaaaaagataaagcaaattttaaaaaaagaaaatacacaattattgttaactggttaactgcagtcaccctatagtgatatagaacactagatcttattcctcctaactggctataattttgtatctgttaaccaacttctcgtacctgacccccaaacaatttcccagcctctagtaaccactatgctactctctacttctgtgacttttttttagctttcacatatgggcgagaacatgtggcatttatctttctgtgcctggcttatttcacttaacaatgtcctccagctaatccatgttgctttgaatgacaggattttcttctttgttatggttcgctcaatagtgtcttatcatgaacgtataactcattttcgtttccattcatgtattgattggcacttaggttaagtcccaatcttggttattatgaatagtgatacaataaaggtgggaatgcagatatctcttcaacatactgcttttcttttatttatttattctttagatttataccaagtagtggaattgtgggatcatatggtagttatatttttagttttttgaggaatctttatactgttttctatagtgactgtactaatttacattctcataaacaatgtatagaagtttcattttctccatgtccttgccagcattttgttttgttttgttttggtaatagacattctaactggggtgaggtgatacatcattgtggttttgctttgcaattccctgatgattagtgatgttgagcattgttttctatacttattggctgtttttatgcctccttttgagaaatgtctattcagatcatttgcccatttttaaattggattatttatttttggtgtttttttgctgttgttttaattccttttatattctagatattagccctttgttaaatgaatagttcacaaatattttatcctattttgcaagttttctcttcactttcttgattgtttacattgctgtgcagaggttttttagctagatataatcccatttgccaatttttgctttgcttgcctttgcttttgtgttctccataaactttttgctcacacctatgtcctgaagcatttccacaatattttcttctagtagtttcacagttttaggtcttacttttaagtatttaacccattttgtgtttatttttttatacagtgagatattggggtctaatttatgtcttctgcatatagatattcagtttttcagccctatgtattggagaaactatcatttctccaatgtgtgttttgggcacctttgtggaaaattagttggctctaaataaatgaatttaagggttctctattttattccattggtatatgtgtctgtttttagataccttattggttttaaaaaaggtaggaacctgcatcatgtagaagagaccagcaaagaatgagtcagacccagatcaagccacttggaatgccctcagtttggcaacagtttaataattgtaatgcaggtaaattaatatttgctctttatgtgcatttttaagatgtattaattaaatatatatttttaaaactatgggaaatgagttaagtacatctaaggactactagtacatagtgagaagcaactttttaggtacttaaaacacccttcaggattacatagagcaattctttaggacattttcatattttggagactacagttttagagcaagctaagagtatgatgaatatttagatttgtttccaaacatcacctggcttttacatttcaccattctgcatttcaaactcctccagacatgttacctggtattttttaactaatattattacaaataattttttcagatacttcatggtagggcatactgtgtttttctccactgaccactgaaagtagcactctgttgtctatttctttagtgataattttgagggagagagtagagatttatttttgctaaaattttcaaattctgaaatcccaacattaattttgcatttgtaaagaaatttccaaaaacttctaaatttgtactcagtggaagccataccaattttatttttctattatcagaagaatataagttgagggtatcttggtttatcttggtttataattagtttactgaattttggttttgcttgtctttaaggttttccccttgaaatgacatgggaaaaaaaagacttaaagttatttgcatattttaacaaataattataaaataaacactcttgtattcaaaattcttgtcaggaaagagaacattattagtactccagaggtctatcgtagataattttctaattaaaatatggtttaaagtctgtaggcattggttctctatagctattgttttctacaatttggggaatttgacatgaaaaaggtgaaatgttaaagttcaccagagaaacagaaccaatatgatgactgagaggtcccataatcttcagtaagcagactgaaaacctaggagagccgatgtgtagttccagcctgagtctgaaggccttagaatcaggagacctgatcgtatatgttacagtttgaaagctgggaggcttgagacccaagaagagctgatgtttcagatttattctgaagtctggaaaagaccagtgtcacagctctgacatgcaaatgtcttaccagtaagtctaaaatagttcctactttttgttcactaggtctaatcagcataatgtaaccaatgtgatggatcagtgtgatagatatcgtgtggaaaagaaagagaatcgatatccctatgaactaaattttaacatggggctgaacagtggaggtgatttgatggccttagctgaaagcaaattgcttctggtggtccttattgacaaatatggagaaaaaggaatttgacagatcaatagctatataccatataccaccagatgtgttaattcgctaaaacaacaaaaccatatctggtacatgagctgcaattggagtcatcacctgattaagctaatgattatctgctgtcactcttcaagattgttctgtttcttgcacaggccaaaaaggaagttaaatggggatgtggtgggaatcaccaccctagcctctttcaggtttttttatgaaggcactaatctctgcaatccctctaagaaagtagtattccttttacttgactattttccaaggtttagggagttctagtggcttccacttggcttttctcatcataatgaaccttattccacatgtcagggaaccaacgtaggcattttgccagctactgagtatatctatttcaattatgcttttccaaattggggaaataactacagaattggtttagggacccactgcacccactgcgagattaatgtgagctaaaactttattgattacatgacttccataagttcttactttgactggtggaccacagtgaaattttgagcttcctggaattagtgtcagctcggagccagtgtccagtaaaccctgagaggtctatttattttattttccccaatgcacagttaccctgataaaagggcttaggtccttttggggaaggctatgaaatagattaacattataaatttttagcaatgtattgaggtccttgcataaggatacctggcctccccttcatctaggtggttcttggtctgtaagccggctcacgtctgggaattgattgaagggccatgactctgtttttattactcatgttagacttttattcacttaagctagacattttcttcttataagatcaagttaggatttagtaggctttatacccattttacttctaggaacacaataattatctagccaatgccatagtccatgtgaatgagactattctgattgctgttttgaatgccaccacttgatctctgccactctgggatccaattattcctattgcatgagggtttcccagtttggtgactgcagttctcactgtaatgtctggcctacagagaaaaatgatcacacaactcttcagtaatgccaggactcctctcaagaatttatttctcacagcgttaatgaaagctgtgtcttctgtatcctctcattgtgagtgagtagaacatttcatgctccctaaacctttgaatcccttcctctacataaaacgaaagcaggtttggcatttccaacttgctcactgtgggctatttcttggtccatgtttcagccaaacaaccaaactctaactccctgagcttcaacattaaatgtagaatatctgattagtaagttcatatcaataaattaggcccgattcaactttatgtttcttccactattattttgtactttcaatatccattgccatatatgttcttcagatttatctgaatattagaatattcaagtagttattttggagtgcactgtaccttttcatgagtcatcctttgtaccttacctttgtaagtgtatgtttttggaaatcaaaattgtattacttctcccaagccaatattacttctcccaagccaaaaataaggtagaatatgatacaacataggaatattttattctgtttataaattcctattcgatataaaattaaatgtattttccattgttcatttaattacttttatgaaatatattaagttatattaattcttttaattttatattatttcactcttttgttttatttgacctttataaccttcattatagcctgaaaatttttagcattcaaactgaacagaaatgaatattaaaaatgatttaataaaatgtttcagaatttcagcagagcacttaaaattcatcatttcagtgcttcggttttacttaaagatgaatgtcattttaatgaacctaggaggacatgtccatgccctgactttcaaaataaaagttatcttccacttgcattaatttcgttcccacttgataaaactataactttaaatgccatgtggatcaccttggttattatgtattcaaaaaatacatattgggaaacatgagtgacatgtgacatataccataggtattgaccaacagaattagagttcggcatgaggaaaatgtactaagaaaggtattttacatttatagtcgatagaattcaaactaatgcttcaaaaggctgtgctttcaaagagtttcacaaatttagcgggggatatgaagaccttgaatagccacttaagctctcctcacttaagctggaatgtctaaatggtgcactgaccaacatgtaagtgctttgttataacacacaccgattttgggttagcagattgtatacctcgctttagtagatgatcatttcacctgttaagtttctctgatttggaaataaagataaaagtggattaattaggggagtgacatcagcaatacactagaataggaagtcccggacttcattcttccacagaaacactgactttacaacaacataagaatcaaaatgctttcctgataactccagaagccagttaagaggttttagtaacccaggtgagcacacaactaaaaacagctgcatttaaacaggtaagaagagctggttcactttaccaatatccaccccacccccaagccaacacaatttgacatgattgagaggatatataaatacagctcgtggcttctttcttggggagaaggggtgagaagactggaatgtgcaccagcattcaggtttttcagagggctgttctaggaactattttatgtcacctaagggtgctcacagaaccaatgtagttcaaatgcatgggagtcgctgaaagcaaaggagagtgaagatggcttgctgtggtaccagaggctgtgcagtgctacagacagaggcgagaaaagctcagaacaatggggagagagcatccagtttacagcttctcccacaggaagaagggagaagagcagagcatgcgtctggtgttccagctctttggaggattcctgaggtactgatttctgctttgctttacctacggtgctgacagagaggcagcctagtttggatgcctgattattactcaaatcagtctcccggagtattcggggattggagtttttaaagataatttggcgggtaggggctcagtaaaattccctcccaaggttagttcagcctatgcccgggaatgaacaaggacagcttaaagattagaagcaagatggagttggttaggtctgattgctttcataatttcctgtgttataattttgtgaagggagtttcagttacactgagagaggaaaaaaagaaacccaaaacaatcaaccaagaatacaatgtctgacaaaattattctttaacagttaaaatgatgctatcctgataaaaactgaagaggtccttcctttctggaactgcctcatgaaaaatgctagagagaatcctataagaaccctagacagcaacatgaaagtatctgaagacataaaattcatttataagcgtgtcgacagaaagagtcaaactctgtaaaatatttgaagatatttattctgagtcaaatatgagtgactaataacctgtgatactgccctcaggagatcctgagaacatgtgcccaagatgattgggctagaatttggtttgatacattttaaggagatttaaggcatcaatcaatacatgtattatgtacattggtttggtccagaaaggcaggacaactggaattgggggcttccaagtcataggcagagtcaaagattttctgattgccaattggttgaaagagttattatcaatagaaaggaatgtctgggttacaataaggcattgtggagaatactaggtagcaggcttcaaagagaatagacagtaaattagtaaatacttcttatcagacataaagagtcgttctatcagtaactccaaaagggaagtgggtaaaatgaggcatgtcaagctcctccttcctatcatggcctgaactagttcttttcagttttactttggaatgcccttggccaagaggaggtatccattcagatggtttggggaccttagaattttatttttggtttacaacggtaaatgtgtagacaaataaagaatactgtaacgctgtaatagaggtgcttaaagctctcttaattctggtatagaattaaaagcataaaaattgttataattatcaaactacattaactgatacacaacatgtaaagatataatttgtaaaatcaataacataaagtggggctggggagacataaaataataaaatttttgcatgcagttgatgttaggtttttatcagcttaaaatatattgttataacagtaagatagtttaggtaagcacaatggtcaccacaaaaactatacctgtagaagatacacaaaagaaatgagaaaagaatccaggcatgtcaatacagaaaaacaaacaaacaaacacacacacacacaaagaaaggcagcaacagaacaagaaggacatgttagctacaagacaaatagtcaacaattacaaaaatattaatagtaagacttccctatcagtactttttaaatataaatcaattaaaccctgtaatcaaaagacatagaaaggttgaatgtatcttttaaaagatgcaactatatccttacaaagacttaccttagatgtaaagacacaaataggctgaaagcgagattatggaaaaagattatccatgcaaattgtaactaaatgagaactggagtggccttacttacatcagataaaacagactttaaatcaaaagtgacgaagaagggcattatataatggttaatggtcaattcaccaggaagacataacatttgtaaaatatattcactttacatcaaagctcccagatatatgaagcaaaaattgacagaattgaaggcagaaattggcagtaacacaataatattaggagatttcaaaaacctcattttcaacaatgaatagaacaaccagacagaagataaataaggaaagagaggacttgaacaacagtatagaacacaattgaagctaggagacatatacagaacaatccatccatttcgttccaggcacacatggaagattgtctagaataaatcacactttaggccaaagaagaaatcttaatacatttaagaagtttaaaattatactgaatatcttttctgaccacaattgaatataactagaactcaatacatgtagaaaaactgaaaaattcacaagtatgtggaaattaaacaacatacacttgaaaaaccagtgggtcaaggaagaaatcacaaagagaattagaaatatctcgacccaaatgaaaaaaaaacacaacataccaaaacttatgggatacagcaaaagaagtactcagaggaaggtttatagtgataaatgcctacattataaaaaaaagaaaggtctcaaatcaacaatatacctttacaaatcgaagaactagaaaaagaaaaatgacataaactcaaagatagcagaaggaagaaagtaataagtattagaacaaaaataaataaaatacaagaatagaaaattaataggaaaaaaacaataaaaccaagagttgcttttttgtaaagataaagaagtggacaaaactttagctagagtaactaagaaaaaagagagaaaactcaaataattaaaatcagaaatgaaagaagagacaacagaactaatgcaacagaaataaaaacaattataaaatactattaacaattatgcaaataaattggatgattataagaaatgaacaaatgtctgggaacatacaaattaccatgaatgaactataaagcatagaaaatatgaatagatctgtaactattaaggaggttgaatcaggaatcaaaaatctcccaactaggaaaagcccagggatagttggccatagtggagaattccaccaaatagttaaaaaatatttaatgacaattcttctaaaactcttcaaaaaattgaaaaggaaacacttcttaacacattttatgaggccagagttaccctagtaccaaagccagatatacaggaaaaataaactacaggacaacatttctgattaacacaaaagcaaaaatcctcaatgaaatactagcaaactaacctccacaacatacttaaaagattgtacatgatgaccaagtgggatttatccctggaatgcaagaatgttttaacatatgaaaatcaacaattataatacttcatgttaatagaatgaaggacaagaattagatgttcatctcaattagtgcagaaaaagaatttgacaacattcaccaccctttcttaaaaaagtactcaacaaattgagaatagaaggaaactacctcaacataataatgatcatatataaaaagcccacaactagcatcacactcaacaatgaaaaaagcaaaagttttactgcaagattaggcaatgattatcactctcatcatttctactcaacatagtactggaagtcctaacaggagaaattaggctagaaaacaaacaaaagtcaaccaaatttgaaagaaggaagtacagttatttttgtttgaaaatgacatgaccttatatgtacaaaaccgtaaagatttcacacacgaatatataaggaaacttgttagaactaataaacaaattcagtaaagtttcaggataaaacctcaacactcaaatttattagttgggaactttttggaggaaaaatgtgagaacttaatgtattcatgtaatttggaagattaaatcagtgtgattggaatattcgtcaccataaatacttgtcttttatttatgctagaaacgtttgaattattatattcaagctactttgaaataaacaatggattattggaaactatagtcaccctactgatctataaaacactaggtttatttcttccatcaaattctctatctgtatccatatataaacctctctttgtctcccccctcctcagcacccttcttggcctttggcaaccactaacctattttccatcttcatgagacccacttctttagctcccacgtatgagtgagaacatgtgatatttgtctttctgtgtttggcttattacacttaacataattgtctccaattccatccaggttgttgcaaatgacatgatttcattattttttatggaggaatagtatttcattgtgtacgtataccacattttcttttttattcaactattgatggacacttaggttgattctatgttttggctattgtgaatgctgctgcaataaacatgagagtacaggtatatcttcaatatgttgattttctttcttttggatatatactcagtagtagaatttctggaacatattgtaattctaattttagttttatgaggaacctctatacagttttccataatgactgtactaatctacattcccaccaacagtctatgagtgttccccttcctccacatccttgctagcatcttttattccccgtattttggataaaagccattttaactggagtgggatgatatctcattgtggtttcgatttgcatttctctgatgattagtgatgttaagcatttttttatataactgttgaccatttgtatttcttcttttgagaattgcttatattttttgtcaattttttaattggtttattaaggtttctttttgctattgagttgtttgagctccttatatattctgattaataatcccttgtcagatggatagtttgcaaatgttgtctcccattctgtgggttgtatcttcacttttttcattatttcctttgcttcacagaagctttatagcttgatacagtctcatttgtgtatttttgctttggttgcacatgcttttgaggtcttatattaaaaagtctttgcccagaccaatatcctggagcatctgcaatgttctcttttaatagtttcataatttcagatcttagatttaagcctttaatcaattttggtttgctttttgtacatgtgaagaaatggggacctattttttttcttttgcatatggatatcccattttctcagcaccatttattgaagagattgtcctttccccgttatatgttcttggtgcctttgttgagaaagagttggttgtaaatatatgattttatatgtgggttcctcattctgttctattggtctatgtgtctatttttatgccagtaccatacttacatcattgctatagctttgaattatatttgaagtcaggtagtgtgatgcctccagctttgctctttttgctcataattgctttggctattcagggtcttttgtggttccaatatgagttataggattgtttttctctatttgtgtcaagaatgtcgttggtattttgatagggtttgcattgaatttctaaatgtctttgggttgtattgttattttaataatattatttcttccaatccattggcatggaatactctttttgatgtttcttttctgtgtatttataaataacctttgagctaattttttcctctgcttgatttatgctgctgttgagagcctgtaataaattttttagttcagcaaatatatttctctgttccaagatttcttttttaaacattttttattttaaatttttgtaagtacctagtaggtgtacatatctgtggtgttccaagatttctgttgaattttattattgctatttctacctctttgttaaatttctctgataaatttctggattgctcttttgtgttatcttggagatcactgagttttcttaaaactgctattttgaattcttggtcagagagttcacatatcacagtcttgttagggtcagtcagtggtttcttgcttttttcagttggggagaccatggttccttgatgtcattgtttcctgtggatgtacaactatgtctttgcattgaaggattagttatttattccagtcttccctgtctggtttgtttcgtttttaactgcatatgtttgcttagagattcttcaccattttcctgttgattttctttctcttttttaccaccaggtttctggctcctttttgccactagatagtgctttaagcccagttttgcctcagttgtagcacataagcacagtgtttcctattctgaacaggagaggttccaaaggggttaacccagtagtatgagaagtctgttgatatggtttgaatatttgtccccactccaagctcgtggtgaattttaatccccagtgctggaggtgcagcctggtgggaggtgtttggatcaagggggcagatccctcatggcttggtactgttttcatgatggtgagtacttgtgtgagctggtcatttaaaagattgtggcacctcccccactactctctctcttgctcctgctttcaccatgtgacgtgcctggtccttctttgccttctgctatcattgtcagcttcctgtggcctctccagaaactgaacagatgccagcaccatgcttcctataaagcctgcagaaccatgagccaattaaacctcttttttccctaaattatccagtctcaggtatttctttatggcaatgcaaaatggcctaacacagctggctaagagtttattccccaaggacctgtgtaataaatatcctacagtgtggtgctactgaacagtcactctgatttggcatctcctacggctgaattacagagcagagtttccagtgctgaggatggtaccttctccctttatctctggctgtcctcggagatatttatctctttaggcactcctaatgcttcctgtggattgagtcatgagcaagtctcttatccgggaacccaaaataatggagaacctagttgtgtacctcaatttgactttttcctgtgtagaaactgtgagtcaggggaaattttttgcacacttggtgctggtgagattggcaggaggagcattgcaggtatggaagtttgattcttttactgtctacttggagtttttcacatctctgtggccctgggaattgtcttattcccatatttgactactatgatattgctgatgataatctcagtgttgcatgtctgttcttggttttctgtgaggtgaggaggtagtaaagacaacttacttctacaccaccattttcctcaattgggtttctatatagtaaaaatgaaaaatcttttaaaaaatgagaaaatattcctatttacatagcatcaaaaataataaaatactttagaataaacttaacggaggtggtaaaagatgtgtacagtgaaaactacaaaacactgaagaaagatattagagaagacacaaataaatggaatgacatcctgtgttcatgggttggattaatattgttaaaatatccatataacctgaagtattttacagattaaatccaattcctattaaaatttcattgatttttttgaagaaataaagtctaaaatttatatggaatctcaaaggatcctgaatagtcaagctgatcttgagaaagaataaagctgaaggcctcacgcttcctaatttcaaagcatattacaaaatctacggtaatcaaaacaatatggtactgatataaagacagacttattgactactgaaacagaatagaatgttcagaaataaaccttcatgaacttggccagttgatttttgacaacagtgccaaaactacacaatggcataaagatagtctcttcaacaaatgattctgggaaaacttaatatccacacacaaaaggatgaagaggcacctttgtgttacaccatatacaaaaatcaactcagaaaggattaatgacataaatgttagacctgaaatggtaaaactcctagaagaaaacattaaggaaaggcttcctgaaattggaatgggcaatgatttgttggatatgacacccaaaacacatgcaacaaaatcaaaaatagacaaatgggactacatcaaacttaaaaacttctgcccagcacaggaaataattaacatactaaacaggcagcctacaaaatgggataatatatttacaaaccacttaccagataagaagttaatataaagaatgtataaagaatgcctacaactcaataatattaaaaagcatgactaaaaaatggtcaaaggttctctgcacattgcaccatactgggagtccaggtgccaaggaagggagaaggaaaaagaaagggccatgtgcaaataccatggctgccatcttgtttgagcccccacttcacaccctctgttctctataatgcatgcttcttccctctctaccctgcctgggccctctgcattgccctgcttagcaggagtgcagggagagttcctgctcttccctggactcctgtatggaggcatttttcaaaatggaggcattgccaaaatgattttgtggcactagcagcagtaatgcccagtaaagcctacagtccttttgggcttcacatcctggaagaaatccagaatttaacagtgaaagatttactagtgcaggaacttccacggctggtattaagaagattatgaaactgaatgatgtaaagatgatcagtagagaagctcctgtgctctttgccaaggcagcccagatttttatcacagagttgactctttgagcctagattcacacataggctaaaaagcactggactctatagggaaatgatgtcaccatgggaattacaaaattagatcagttaaactttctcattgatattgttttgacagatgaactgaaccctccaaagcgtcaggaggaggtgtgccagtctataactcctgccaagcccatctagtactacttcatgctggcttagcagccctccacggtccaagtctagggacagcagcaaggccaggagaccaccagctctatgaccaccatccagcttgggtagatcatcatgcagcctcagcagggccaaatcatgcccctgacagtgcaggttggagaaggttggcaggtgcagattgtccaggcccaaccacagggtcaagcctaacagtcctagagtgacactggacagactatggaagttatgcaacagattattactaaaacaggagagatccagcagatcccagtgcagctgaagttgggccagctagaatatattctcttagtccagcctgtatcaggtactcaagtcgtgcaggaacagatatagatgcttgccaccaatgcccaacagattacatagacagaggtccagtaaggacagcggcagttcaaccaggtcacagatggacacaagctctaccagatccagcaagtcaccattcctgtggactaggacctcacccagcccatgttcaaccagtcagtcaaccagctctcctacaggcagaacccccaggtgacccatgactgagagtctgagctggcaaggccaaggacacccaacacaatttttgccatacagccttatggttatgggttatgggcatagcctccctccccagaggacccggctgacttcagcacctcctgcaggccaggacactggggcacttagacctcacgcctggggcctgagattcttcaacagaaaaatataattctttttgttttcttttttccatttattttcctccaaggaatcaatatttcaatatgtcgagctgtgtgtccaatgctatgaaatgaaaatattaaatgacatatttacgacattttgttgaagagcgtggtttaagaaatatttccccgtttgtttttcctttttttttttggttctcactgccacttctttttaggtgcaaatctcccaggagtgtcctgtatctcctgactcttggaacaactgctgcccccaagatttaccaccttttctaccctcagattgagttacgtgaatgtatatagcttcattttcagcagcgatcctttcccctgacctctgtgtttttgtatcccgaggccgtggaaacattccttgcatttaagagacaaattcattccccacggagagtgggtgagttcattcctacacccttctttcccagggacccaagaagactagaactttgggcatttgctgcccaccaccctttattttaaaatgcattaaaaattgtgcaagtttcctttgctgcatggacttcaaactacataaaatgcaataaatctcgttttagattaaaatagtgggcaaaggactggaacagacacttttccaaagaagttatacaaataggcaaaaatcacatgaaaaagtgtgcaacatcattagtgatcaagaaaatgcaaaccactgtctcaatgagatatcgtgtcatacctgttaggatggccactatcaaaaaaaacagaaaataacaagttttggtgaggatgtggagtaattgaaatcgttacacattgttgttgggattgtaaaattgtgcagccactgtggaaaacagtattatgtttcctcataagtttgaaaataggagcactactactatatgatccaggaatcttacttctgggtatttatccaaaagaattaaaaattgaatcttgaagagatatttgcacatccatcttcactgcagcaatattcacaatagccaagatgtggaagcaacccaaatgatcatggatggaggaatagataaacaaaatgtggtacatatacaatcaaatattattcagtattaaaagagaaggaaatcccagcactttgggaagccgaggtgggtagatcacctgaggtcaggggttcaagaccagcctggccaacatggtgaaaccccatctctactaaaaaatacaaaagttggctgggtgtagtgacaagtgcctgtattcccagctactcaggaggctgaggcagggagaattgcttgaatctgggaagtggaggttgcagtgagccaagatcacgccactgtattccagcctgggcaacagagcgagactccatctcaaaaaaataaataaataaataaaaagagagagagagagagagaaagaaatcctggcacaacaacatggatcaaccttgaggacatcatgctaagtgaaataagttaatcacaaacacatatataagataactaaattaaacaaacttacagaaacagaaaattgaattatggttgtcagggtagaggaaggggaaacgggcagttttatcaatgggtaatagactttcagccatgcaagatgaaaaagttctagatagatatctgctgtacaacatcgtgcccatagttaaaaatactgtacttgtcaacttaaaaattgtttagagggtatatttattgtgtctgttttaccacaataaagaaaatgggttgattaatgtggaggacatgaaactgcacctctcaaatactccttcaaaataggacttgctgcccagctatgtggagttctgttagctgactatcttcttttgtcagctcctacagaatttgtctcagctgcagagtgtctcctggttaaaccccacctggcaacccatgtcccctgactgatggggcttagagacccagacattttatcctgattgcagagactctgaaagacaataccgggctcctacttgatttggccaatgactcgtggaacctgcatagctgttcttcctttgtccaaatatgcttcctcccattttcttaagcagaaatcgatctctgtctgcttcccacaaaaccaattgctgaaaattcttgactgaatgtcacacttttggcgaccctgctgatagttacaatacagtcttttctggtagtcgaaatatatcttcgatgaggatctcaaattctttccatctgtccatccatacatctgtcatcctacatatgcagtcaaaacttccaagtgtcttttatgtgctatgtgctggcttctgtctttaaaaagcttttactcaaacagaataaataaaacatttatgtgcaagatgactatgaaaggagtagggcagaaatagaaagtaaataaactctgccagactgacacaatatagaagcacagaattacagtggtggtagtgagagtgaaaagggatggataggaaaaaagagtgatttttggtgaaaaaaacataacaggaggtggtgactgatggcaatgtgagacatctaaaatcctttgaaaggaaaaaaaactaaaaagcatcgtataggtgcatataggctttcacagatcaattgctgtagcttgctctaaacatcttaaaagtttatccattgaatagaacaaactttaaaccttgttaatgaaagtcatgttctagttataactagcacgtggttttaaaaatcctaggtctttcttgctggtttggttactgtgatcagtgaagtagttcttttattttatttgttaattaaataacctatatcccactgatatcccacatataacatttctagtgattagtaactacaaacttgattagccaatttattgaaatcactatgcacattgattctgttttaaatttttttgatgtctctctttcctcctacatttactctatagttctcttgataactgttaacttcaacagttaaaattcaaggtttaatatgggtttatttttaagggtttatttttccaatttctaagtccagcagcaaatcttagctccatgatcttaataatatttcctctgtaacagtgagagtcagtctccaactgaattttgtagcaatcaaggtttgtaaatatctaaatctaaccttttgcagtgtcttgctagacataatgctttcctgttattatactctagcctgtattcaagctgaagagcagtggttttatacttttcgaatactgaaaatgttttaacctaaagctactagatcctctgcatgacagtacttacattttactctgtcattgttgtttttgaaacaacaatttactctaaattcaacaacactttgaaggaaatttttattgtactaaatattagggcatgaactgaaatccataagatcatgtttaaaaacatcttatgcaaatcatttgttagacggttgtgcatgaggacaagtggagtgtgtcaactgctttttatgattttgctgcccctcaggtgtccccagtccagaaattggaaaccattttcaaagatgatggagattcattaataattttagcactgcaagactattaatgataataagcagagatgttttggatagatttcacagaacccttattggaaaagaacaaagcaattaaaggtaaataaagtttgtctgtttccctatcattggatttacatccaatgggaacattctgaaaaaaaatcatttatttttggagaattagtgtggtaaggcagccttagactatacttggtacattgcagttcccagataattttattttttactttccttctgtgacactcctgtgtggtcacgtgtccctgggtaatcacaccttctgcaatcatattccctctgaaagcgatgccagatcattgcctggcttcctaagcttttgtggtcatttcattatggcctagttggtctaataactatactcttgcttaggcattaataccgaactttcaagctacaaatttataaacaacaatattcttctttagcattgttctaatcaatgagaatacgcatttcatagtgtggtttcaagcatttgactgatgattggggaaaaatattttaatagaggattctataagatggagttctatcatgatacagagtttatgatctttttaaatgacttataaagccaactttgaccttagtctttgtaaaacccccttcgtttagaatagtttgattccagatattccaggcataactgtgacttcttttggcttagttcacttcaaaaaccataaaatcttctaagatataaaatgaaaataacctacaaatattatctagtctattatttagatagatcatggctgtcttaaggtgcattaagaaatttgaatgaattgcttaataaaactgtgcctgctgtgttcatatgagtttatgtcatcatggtgaaagttttagctttttgttaccagcaggttgcagatgttgattcacataatatatttaaggcttttgtccctgctcaagattccttgggattcaccattaaatatgtaaggatgaaaacaggagaaaagctattatttcatatagttttacaaattatttttagattcagccgccttaagtattttaaggcttatcacattaccagaacaatctaccatacatcacatttctactctttggatattaagacagtgcaatttagtactttgttaaagtaatcttgtgtatctttctgaatacttaaagtataaattttgcctttgtatatttttgtaatcatagttatttacatatatatttgtaaagacaaaatttataaatttagagtatatatacgtgcatatatgtatatacacacatacacacatatgagctcttgctgaaacaaatatatttagggactggtaatttctcctttttatcacaattcatttttgtttgtttctttgatttttgagatggagtttcgttcttgttgcccaggctggagtgcaatggcactatctcggctcactgcaacctccgcgtcccaggttcaagtgattcttctgcctcagcctcccgagtagctgggattacaggcgtgcaccaccatgcccagctaatttttgcattagtagagacggggtttcaccatgttggccaggctggtcttgaactcctgacctcaggtggtccacccgccttggcctcccaaagtgctgggattacaggagtaagccaccacgcccaggctcacaatttatttttgggaaccacattgtgttagtccgttttcacactgctataaagaaatacctaagactgggtaatttataaaggaaagaggtttaattgacccacagttctgcatggctggagatgcctcaggaaacttacaatcatgaggaaggtgaaggggaagcatgcttgggccttctcacatggcgacaggagagagaagaagggaaggacaaagcgggaagagccccttataaaaccatcaggtctcatgagaactcactctctgtcatgagaccagtatgggtgaaaccacccccatgatccaatcacctcccaccagtctttcccttgacatgtggggattaaaatttgagatgagatttgggtgggaacacaaagtcaaaccatatcacacattttgaactgtgttaacaacagattatagtatattcctttagggacattctcttggaaagaaaatatatattgatacatattaatcaaatgtaatgacttaaaatactgaaagtgggtcctaagagagattttcagatttttcaaattttttatagaaattccattctgtttattttaccaaattactgggtatccagcaattgagatgattcatgtgaaaacaacatataaatttaagatactgctaaataaacatgtatctgtatatttgatgaatatctgtggatctcttatgtgatctaaagaagactctgcatttagtctgctatgctgcaaatcagtggaagacattcatatttgcaacatactggaatggatttaagaaaattgagattatataagaaaatctattttagagcactaaattaattaatgtataattgctagaactgttaaatttataaataacagagactttatggcctgcagatagcatatattctttgttattgcaatgcctagaaaagttagctgtaactctgctcctttttctcctgtctacaaaaagattattgaaagacatataagtaaaagtaacattattgtcaggaatattttgagtccaatttgaattttgaaaatgaataaatcaaaactctggaactgtattcctaattaacaaaatgacttgtgatagagtcatttttatgtcttatgacaccatggataaactaccattataaatatacattacagcactagaattaaaatgcactattccatcaattgtcctaacataaatatactatctatagtaaatattacatatttgaataaacattaacacttttctacataagaaaatttacaggtaaatatttttactaacagttattaaattgagaaatattttaaatattcagatgtgactagtgtaagcttctttacaaagcttactgaagaaacttcgttttctagaataactttccctgaagcaagcataatcattcaaaattatttcactgatattatgtttttacttaaataataggtggatggtaacaaacacttcttttggatggtgatagtgctggtagaggagtacacagcggaaaacattttcaaagaggtgatgtaacatcttttcatttttctgtttctaagtgtatttagtacaataaaaagcattgtggcacttcaatccaaagcagtgttagcactgaactctttgttaaccatgtacagccactcccagttttgcagacataatttcaggtttagttgcctcatggagaaagtttagatacacaattctattaagactagagatacctgctcttagaaaccgtaacctagcactctgccttctcctcttgttttaaccctgttgctatgaattaaagcacattcaatcaaattccttttcgaacactagatctgttaaaaatatgtttaggaaccttatgaaccttagttaagaccagaaagaaagaaataatattacaatcttactgtacgtgatatattgtctatagaccttcacagcacttcagatgctattggaaagcaataaaataatgtaattaaaaagctctttatcacaaatatttaatatgaagcttcaaaatttcaactctgagataatttggaataaacaaggttaaaagtagcttatttcactaatgaggagcaaagacttcaagatgtgagattagagtgtcattattctccagctaattactgggcagatgaatagtgagactctatacaccttctgtaatgtgttacaggtacttatcaggcattcaactcaaaattttgatacttaacaccatcatttgcatcttattggttattctctactgtgaatttaaaaattcttcggtgatgtacatttgtgtttgaggcttttaaaagataattttgtttgctttccctttttattcatgacagtgaccccttttctataatccaacagtgagaaggagtagaaaatagaattaaaacagtaatgcgcgcctgggactgggaaaagaaatatggtgcttgtgtgttcatgcaagtctctgtgtgtgtgcattacactgagggagacaaatgtattagactgaatcacataaaactgccgtttgtgtagttggtgatgttatgtagttcagcccaatattttgaggttcttttgatgcccacagtctttgtactaatctaattagtgccactgaagcttcaggcatattccatcattatacttataacatgcagaaacgtctatttttataagagaaaattaaagcaagcacaaaacaacatcatgaggacttcaaaataccagtgagagtttcatcactatcaggaaatttttgagtctactttgatctcttaaaaataaatacatattccaaaaactctgatacttcattctagttaaaaaaatattaactgttatgccatcacaagagattgagatatgcttgagtatggcaacatcaaaaaatatttatctaggatcaacttgataaactctgaaagaaaatatctctatatggtagttttagttaaaagttatacagacattagaatggcatgttaaataagtaaaatttgcataaataacaaagaaataatcattttcataataggagtttaaaattatttcctaatttatatagctcttaaatttgattcagaaactatgttttaatgaagcaatctgaaacagatctgaattatcactccttaattacttctttaattatttatataataataagaacaaaataatctaaggcatgagagttctaaagacaatgtcccataatcctagctttctatgtttaagattgaaagcacccatgctatgaaaatataggcattacaaatatacatttttagaattgtgatattagaactattatcccagctgtgaatcaatggcatttattgtgtactgatttatatcagagactaagagattcctgtcatagaacccttagcagaagtaagccaaatgatattgtttgatgaacaaattctaaaaaatatggactaataaataattaataaaaatatttgaaaattaagttatacaaaaggatacatcatagtaaaagtgttaagaataattgattttcattgaattagaccaattatcttcatatttcttagtttcatgtagttataaaagactgctatttttagacaacctcttgaatgaatatagagtaattgatttcctatagttctaaaccagaggaatgatgcatagcctgaagtttgtagaaaatagtgataatttctgagtgtgatacttgaaaacagatatacctatcctgtaaatttgtatttatagaaaataaaacaaatttatgcatgtacttcctcatgatgctataagaggtatctggtttatttttcatctgctaataatgctgtcctatgctgtgcttttcaattttgggacctggctcagtagtttttagctctaaaaaccgacaatttagctgcatgatggagtccttccagaagactttacatgccctgtgaaccccagatacctgagacaggtctcaatcaatttagaaaggttttttttttttttttttttttttttttgccaaggtttagggtgcacccatgacacagcctcaggaggtcctgatgacatgtgcccaaggtgtttggggtacaacttgcttttatacattttagggagacataatatatcagtcaatacatgtaatggcttacaatggctccatctgaaagggcaggacaactcgaaaggggagtggactttccaggacataggtagatttaaaaattttctgattggtaattagttgaaagagttattattaacagaaaagaatgtctgggtaagataaggaattgtggagaccaaggatttatcatgcagataaagcctccaagtaacaagcttctgcgagaatagattgtaaaggtttcttatcatacttaaggtctctgttgatggtaatactggaggggtacaatgaggcatgtccaacaccctcttccatcatagcctgaactagattttcaggttgactccccaaatgcccttgtctgagaggagggatccattcagatggttgaggggggacttagaatttcatttctggtttgcattctcccgcttctggccaagatttgccaaatgcaagatttgccaaatgccacgaaatttttactctgtcctatagcattgctggaatgacatggttgcctgccccaggtccatcctgtcccttggtaagactccctgtgcccaaggaacttagagtattaataaaaagacttagagccagttgaatgctttaggccagataggaatggatgtggacatgcattctttaccccttgaattttttttaagtaaaaagtcaacaaacaaaaaaccaaagacgaggttacaaaactgacttatctttaacgtctatgctttgagctacggtgatattggtttaattacagacttatggcaatgaagtatacaaaacttaaggtttgttctgaaatttttaattttatttgtttataaaatgtatttatttataaatttatttatcaattttaattatacttatatgtatatatttgcatgactcataacagggagtattatacccaggaggctttgtcatggggtgtctttatcctctaagtagttatttttttaattctacaggaagcaggaaattatggttgggatggatgaaaaggtgccacataaaagcgcagaaggcaaaatctcttgttttataatctgtttaggtatctgtatacccactcttgatttggagggtgtgatcttgacctaattctatgactcaaaaccagcccttacaatctcatgcacctaccttttccatgacagtccctggacctagagggagggttcttgtatagtcttagcaggaggacatttgcagtgaaaaaaacagatcaggcccagtggaatgccaaatgagggaaatttgcatctctggacttcagagtaccattattttgttttccttgaaagtaaaacaaggagagataaataacattaatattttgacaatcaaaagagtatttgtgtgtcaaaacagaaaaagaaaactattccattaggcaccaattacaaataggaagaataatctagtactctctagagtagtagagagtactactcctgggccacagaccggtacatgtttgtgtcctgttaggaactgggctgcacagcaggaggtgagtggcaggcgagaagcattaccaactgagctccacctcttgtcacatcagtggtgacattagattctcataggagcgtgcaaaccccattgtgaactgcacatggagggatctaaattacgcgctcctcatgagaatctaactaatgcctgatgatctgaggtagaacagtttcatctcaaaaccatgcccccgatccatggaaaaattgtcttccatgaaactggtccctggtaccaaaaaggctggggaccactgctctggaggattatcgtagccttaagttggctttgctggaactttaccttaaaatatgttatcatggtcaaagccttgataaaaataaccagtgtctccaaatgtcctgttttaaaagactcttactaaacgtatgcaaataactatattgtcttaagatcagaatactcgtgaacagtttctgaattttggagagctcagaaagaaaattaaatttgctcacaaaagcatattatacttcacccaattgctctatactataaataaaagaaaaagatttgcttgattctttaatcagagcagtggctttcaaacagggtattgtttgttcaccttggaactgctgtccacaagccagacagctcttgttatctgagagttgtctatcaggcactgtaaaatctagcagctcctcacatagttggaatcagtcctagggggaaaaaacaggctccctgcttatgagtattctcccccttgcattccctgggtagcaagatcctatatccaaaggatttgggtcccagcaaggggttgggccaagggactcaggccctttggttaatgtttatctcatttgcctcaacactgtcccaggcaatgtcagctttctcatgataacctttgcctatttgtttatttatttatttttaaattttcaatctggggcaaatagtgaatgaccatccaaaaatttcaatcacctttctggggcaaatccattgactccctttttccttttccttttctaattactctaatattttatgaagcatctataagacccataagggacagcaaatttgatagggcttctcaaacagtcacatgagtctgcaagagcaatgtttcccagagtgcccacgtaaacggaaccccgttaacccttaacccccaaatttagcatgacctgggaaatagacatgttaggtggaagaacattccagtcatcataaaaccagtctcaacgtggcttgcatatgaagcatatcagctgcttcatctggggtgctccatttggcattttatagagagagctggacagtccccttctcagggtaaacagaccttacagtggtatttatctggtccactaggttgtttgcgggaataacctcttgcgcatttggatcacatataccatcagtgattatttaacaatgagctgtgggtcctacatcaacccaaacaagctcattctacagcatttataattaaggagtttgtccttacagtaactatttttaaaattccttatactaaagatgtctcaagaagctgatgatacaaatctacaaaatggaacaattcctttacattataccctctggttttaatagttacttggctttgcccttcccccacattgactatcttcttggtaaccacaggtctcagaggtaacttttgttgccctggcttaatgtttcttttaatccatttagttttatctgtgtaatttttcctttattttaaagcaactcttaattaactagaaaaaaattacattttcttttacaaaaaacacatgcttgtgttttatgaacttcaacaaaaacaccttttacactcctactattttaactcttagtaactcaaattcccagttggggggcagggggaacaaaaacccagtttacttaatttaacctgacatgactttaagattttaaactgctggagataattttgagattaaattcaccaaactaatcttaccaaagattaccaaggtcatgtgaattaaaaggcatctgagctagcttccaccagtctgataagcactcactttttttttttttgagatggagttttactctagttgcccaggctggagggcaatgatgcaatctctgctcactgcaacctccttctccagggttcaagcgattctcctgcctcaacctcctgagtagctgggattacaggcacccaccactgtgcctggctaatttttgtatttttagtagagatgaggtttcaccatgctggccaggctagtcttgaacccctgacctcaggtgatccacccacctcaacctcccaaagtgctgggattacaggggtgagccaccacgcccggccagcactcactcattgaagtcaattgattagtgctcttttaggtaatttggtagtgaaatattacttccacatgacacatataaacatatagataaaacaggaatgcagaataaaaaaggcaggtccaaaagatatttcatttgtctgtttacaaattctctgtcttagactattaatttttaaaagttacaggagacaacaaaagttaaaggaaggagttaccatctcaggcctactcagaagagagaaggagctaaagtaacagtgtacagcttctgagatatcaatctgaataatttcataaagaaatagattgtggaatttaaaaattaaaaacttcttggattaagagtaacaatacttttaataaaatcatgttttaaccagttctttggttttctatgagtgtatttttaatatcaaagttgaatttttagaaaaactatttattatgattttctctatagccagttaataacataacattttaacaaatttatcttttactaaccttattatgagttagaccattgaggacatgcttggactttctggtttgtcataaatatttttatgtttcgaacaacccagtcattttattttagaattaaaaaccaacatataagatccttccttatatgaaattacttttcttttaagctttcttaccaaaaaatacttctttattttgataagtttctttacattttcatattttctgattccttttaccttgttttatatataacctttaaataagctttgaattacacaacaattatttaccttttaataaaaacacattttctagaaaaaatgtttttctaaaacataatttttttaaattggaaaatacccagacatttaatgaaatatctattatttaatttattataactttagattctaaattgtgacaactttctatacaagtgtttatttcaatacatttacctaattattttattttaatagtttacctagattatttataaaaactatgatagtcatcatttaaagttatttccctgttaaccattttaatagcctgtgaatttcagggctgtacctaaataagaaacttgtgattaaatatatgattattctacctataattcaagatttagctgttttcattaaaccaacaatattaacatcttatttatcaagaattacaaaagcaaagattattctgttttgggctgggcttatggttttataacccttatgccaaattttgacaccttatagtatttggcaaggataagtgtgaaatctcttgaacaataaatgcaaacaaaaatgtatgctgataattcttaaggcattgctgatattactttaccaataatattaaagcaagcttattttttaaagattttgcttaagtcatgtgaaatagaaaagcatttagtcttattatttaatttataaatattctttaactttaacctaatttggtaacttgtggccaaaaacacataacaaaatgtgtgtttgtacacataaacacacacttacacactcatacaaagatcctataacttgtatatcagaactctggccatgagatattaatacaaactcactggtttgcaaaaacaataacaagaagaaatggttttaaggcaagagaatagggaataagggtaaccaagggttaaggcataagcaaaagaacagcaggtacggccagttcacataagcagaagaacagcaggtgcagacagttctaggcaagattaggcagtatacaggccacatcctcacgcctgtgataacaacacagaagcttccacttcagcccctgactgctcataggccagtccttcatagggtgtaaccaattggagacccttaaaggtgtgttaccacattgtttcagctttataaaaaccctaatgggggcgttcttgaaaggcctgctctagcctactcccactctctggaatgtactttggcttcaataaatctgtgcttttgttgctttgtctttcattgctttgttcttttgttgcttgtttgtgtttggttcaattctttgttcaacacaccaagaaactggaaaactcacagtcaagacattccatctggtaacagttggatgcaaatggtacattttatctcagtagaaaagtaacagcagacttaaagcaggcagaaaagaaaacagagagagagaactcagaaacttcagagttgcaggtcgacctttgggctctgaattttcattgatgtaatttgcccatcattttaaaatgtgcacaagaccagacctaatgtgtaaccagctggagtattaaaaactctggcatatccttccatttacacagtagtgtgcaagtagaggcaccataaaaccaactgggggttcattctccttgtctttcgtcattcttggaatatttgtttcccacatttttttcttaaaaggaggaactgagctgtggcctagggtttagtgtagtggatcaaaatgtactgattatgggccagactccacaatgtgtcaccaccgagttgtttctgccttcttacgtgcctcagtttctctccctggaagtccagcatctctgagaaggctcaaaaactgcagtgaccagctcttatattcatttcctggatgagcctttttaaactaattttgttgggagttccctgtagggccgctgcatatcatgggaggggtcaatcccccagacactcccacgtggcccccagtcacccaggggcaccttttggctgggaggatcaaaatgtcctttctcttcagacctgacgaaactcagtctctcatttatctatgaaaatgacagaggtcgggcatggcggctcacgcctgtaatcccagcactttgggaggccgaggcggggggatcacgaggtcaggagatcaagaccacggtgaaaccccgtctctactaaaaatacaaaaacatagctgggtgtggtggtgggtgcctgtagtcccagctactcaggaggctgaggcaggagaatggtatgaccccaggaggcggagcttgcagtgagccgagatcgcgccactgcactccagcctgggcgacagagcgagactccgtctcaaaaaaaaaaaaaagaaaaaagaaaaagaaaatgacagtacagttgctcatacatatgtgcagacaagccaattgagattaattttgggaggaaaggcaatggagaaagctgtttagaatgcatctctgaactagaattaggatcctaaacaacaacttcctaaaggaaaaaaaaaaatgtaaggtcacttcctgtagactgtcctcagctacacctaactttgtagctctcatccatcatttcacatgccaaggtcaaatcctctcacactacaaggtaatctctgttgcccccgcccaaagccaaagaggacaggtaatgcaatacaggaaaacagagctttagttctaaaaataatctgcctatgactctttaaactccacaaagaaaacagaacactccaaaaaggggtgaatggcaccaatgtttttagttatttgaggggtttgagtcattgtacgccttcgctagattttttattggtaccaaagatggcaaagggaaaaggaggaatagggtgaaaggaaagtaaaccaaaaaaaattatttatttatttatttttaagacaggaagcaaacacagaaaccaagcacatggttttttcttttgtttattgttttgtgttatttttcttttgtttttttttttgtttttgttgttgtttttgcagctgagagaaactttagccaattcagagggcttgttcctcataatttgaaattctcatttggatttgaccaagttgggtagagttggtcaactatgatgggagaaagactgaaacaaaccaaaaattaaaaacaacaacaacaacaatatgaccacggagcactataatggtaaggagaaatgaagaccagctggttgtcaattttaaccttcagtcattaaggagaactttcaagagagaaaaaaaaaattcagctacttacctaggaatggaaccccagctgaagacagctccccacaattctagaagcaagaacacactcaaactctccttcccttttggaagcaagctaaaactccagaatgaaactactgccttccattgtcatgcaagcaggaaaacttgcctttctttttggaagcaagtaaaactccagaaaaggagttgtagagcaaaataacttagatctcaaccaaattttgggatatcagggattctctggagggaggggagctcccaggcctcagcaaattgtcctattggttgaaccataaatatagttcaagctggtaccaggcactggtacatttgtcaaaagtcaggggcacctccactcagaatcccatagtggttgccaatatgtaaaccccaaatatccgagacaggtctcaatcaacttagaaagtttattttgccaaggttaagggcacgcccatgacacagcctcagaaggtcctgacaacatgtacccaaggtggtcagggtacagcttgcttttatacattttagggagacatgatacataaatcaatatatgttagatttacattggtttgatctggaagggcaggacaggacaactcaaagcatgggctaccaggtcataggtaggtttagaatttttctgattgtcaattagttgtaagagttattatcaatagaaagaaatgtctgtgtttcaataagggattttggagacctaggttttatcatacagatgaagcctccaggtaccaggcttcagagagaacagattataaatgtttcttatcagatttaaggtctgtgttgatgttaatactgggaggaggacaatgaggcatgtccaaccccctcttccatcatggcctgaaatagattttcaggttaactctcaaatgccctggactgagaggagggatccattcagataattggggaaccttggaatttcattttcgtttacaactcaaacacagactgtacactatcttcagggccattgggagaaacattgataaggaaaaggctgttcacagtctcaaagtttcatccataggtcatttattagttgccaacgggtatatttaacataaagacatctggtggacaccactgtaaccaaataacaaactcagcattattattatttttttttgagatggaatctcactctattgcccaggctggagtgcaatggcacagtcttggctcactgcaacctctgtttcctgggttcaagcgattctcctgcctcagcctcctgagtagctgagattacaggtgcacaccaccatgcctggctaaattttgtatttttagtagagacggggtttcaccatgttggctaggctggtctcaaactcctgaccttgtgatctgcctgccttggcctcccaaagtgctgggattacaggtgtgaaccacggcaccctgccaaaactcagcattattaataactgggcattctgacctgctgtgcttcctgatgggaaaaaagctagaactacactgtagcacatattaatttttcattccagaaatgttcaaaccttatccactcatgagaggacaaccagggaatttagaaaacttggcctcaattctttaaaaaaggtcaatgttataaaggatcagagaaggctggaagactgtcctagattgaagtgaacaaaactcaatgggtgatcccaatttggaaacatattaccaggatgtggttttaaatatagctcaaaactgggactcttgaacatgagctatacattaaataatgttgctttatcataattaaactgtattagttataatgatagaatagaattgaaagcatgttctttttttagaagacaaatgctgaatatttaggggtaaatgtgtgaatgtgtgtgtgtgtgtgtgtgtgtgtgcacatcttaggtcggtgcaaatgtaattgcagtttttgtcatggcaaaaaccgcaatggcatttccaccaacctaatatatgtagattaagaaataaatttcaaataaaatagagaaaggcagaaaacagatgttacaaaatgttaattgttgaactagtggagaatgtgtgtgtgtgtattgtactaatatttcagctgttcggtatgtttggaatattttaaagtgtagagttgggatgggggaagaaaccattaataaggattgttgggtttgcataacagaaaaagaaaaataaataaatattagactctagagatgtcttgctatagatttaccatatgctccataaagcatttggtcaagtcaattttaaaagtgttggttagtctttcctctggggaacatttaattcaagtgtgcttcttcctaaaaacaaagagaatatttatagcttccaaaatatgtactatttaaatactgtctaccatgaacatattcaattgtaaattttaggacagctagaaatgattaaaatgtgtgttagtgaattacataattgaaaaaagaagttagttcaaaagatcataagtgcttccattcatcattgattatatggctttggccagacgttccaaacttgagtatacgaacagcaagacagatatggaaacataccattttcatgcagtggctaagtacatagctttatttcaggcaaggggaacttgtacatgaccccattattttctaattgtgtgactttaaacaactactggctttttcagggccctgatatcagaaacaaagtccaagaaaaatattacctactctctaagactattcagaggctatatggaaatgatataatgaatgctaggtaataacacagtacctggcacaaatagtacaaggcctttagcatcacttttatcacacaatcctctcgtttttatcagaaatgtccttcccaacttatgcccagggagaccatcctaaatcatgccagattgtaatttaaataacagaatggaattgaaatccacaatgttggagtgccttttcatttcactgtgacttttttattattattctttaaatgtttgtaaaattttttgagtacatagtaggtaaatatatttatggggtacatgagatgttttgatgcaggcatgcaatgtgaaataaacacatcatggagaatggggtatccatcccctcaaacatttatcctgtgagttacaaacaatccagttacattctttatgttattttaaaatgtagaattaagttattactgaccatagtcaccccgattgtgctgtcaaatagtaggtcttattcattctttcttatttttttggacccattaaccatctccacctgccccccaaacaactacacttcccagcctctggtaactttaatattgaatacttttatttatttatttacttttttattttttgagatggagtttcactcttgttgcccagcctggagtgtaatggttgtgatctcagctcactgcaacgtccacctcccgagttcaggcaattctcctgccttggcctcctgagtagctgggattacaggtgtgcaccaccacgcccggctaatttttgcatttttagtagagactgagtttcaccatgttggtcaggctgatcttgaactcctgacctcaggtgatccacccgccctgagtaaatgctctaccactaactgtccctgtatgtgtggaaaggcatagcgaatctataactattgcaattgttttctgacaaggtacaaaatattgccctttaaaaaatatttttattaaaataatagttcttaaatattttatttaaatttaagcttaatttaataatatgtattataatttataatatattttattatatatccttataatgtataaaataaatagaaatttatttagaaacaaggtctcattcttttgcccaggctggagtgcaatgcagtgatacaaacatggctcactgcagcctcagactcctgggcttacataacctcccaactcagcctcctgagtagctgggaccacaggtgtgcaccaccacacctggctaatattttttgttattgtttgtagaaacagagtcttgctatgttccccaggctgatcttgaatgcctgggctcaagcaatatttccaccttggcctcccaaagtgctgagattacaggcatgagccaccatacctggcaaaatttaaaatttaaatttatttaaaatcataaaatattgagacatagagaattaatattaactgctgtgctgttcacttttctgttttaatgcatttttaatcataataattgtactaagtgcccatatagccatcctgtataacttgtaaaatttttgcttcatggaagaatatgggcagaagccaattttgtgtaagttggttattcttttatcagaggaaaattggaaatgaactgttaccttcattaaaaactggttgtgtgaaaataatattagtatagctgtattcctatttgatatagggaataaattattattttcaactttatttttctttagtccaccatcattttatgaccacttgagagtgcttcttccattcgctttgtagttgtcatgtgcagctgcttgtggattgtcactaagctgacctacaaatgagaattcgtaggtatgtgattaagaaaatgctcccagaagaaaaaaagtgggaagcagagtaagcagggcagagaatcagttactccaaataaaagataatatttcagtcaaagtcagtgtcagtctgatcccatagggttctgtagaactgaaattgcaccagagttttttttctgtttgaggcaagagacctggggtcttaaactctcacaccaaacagatattggctatgagtttgccacagggaacatgaacacccaggtatacctcaggctttgaacagtaataatccaatggaaattttctgaagaaggttagaagtgcacagttaggactaagcatgtagaaggtgagggacaggagcacatcacaggtaaactggacccaaggggacatttgatagagtggtctttttctttttttttttctccttctggaatcactgttaaaataattttttgattctatgatagcaatgatgatggtgttatgaatcaagtattatacatgatctaggtaattattaattaaaagcagatgatcagttaatagaattttgattgatcactatgcttagtataaacatacaataagcaaaagtaataattcatgatatcaagaaattttaagcttcattgggaaagagaacaacacataaaataattacatatatgtgttagttctctattgctgccataaaaattagcataaactcaaaggtttaaaacaacgctgattttttatctcacagttctgtaggtcaaaagtccaatgtggcatgtttgggttcactgcccaggtcccaatgtagcaggatgagctgcagataagaacccctcagacacccagttgtggaaggaaagggctttctttattcagctgggagcatcggcggactcacctccaaaaaccgagctccccgagtgagcaattcctgtcccttttaagggctcacaactttaaggggtctgcgtgagaggactgtgatcgattgagcaagcagtgcatatgtgactgggggctgcatgccctggtaatcagaacagaacagaacaggacagggattttcacagtgcttttccatacaatgtctggaatctatagataacataacccgttaggtcaggggtcattctttaactaccaggcctggaatgcagcaccgggctatctgactactgatttcacttctgtcttttctttaactcctactttttctttgaggcagaaattggtcataagacaatctgaggggtggtctcctcccttaccaaaatcaaggtgccagccaggctacaacacccatctgaggcttggatccttttccaaacacaatggttgttggcagaacttgtttccttatggttataagactgagacaccattttctttctagtcatcaggcagaagtgactcttaacaattaaagacttcatactcgcaggccatcttacaacatggcactttattccttcttccttgaagtcagcaggagtgcatctttctatcacttctgtacatgcagacaaactctactagtttctaacctagttaaaaatcaactaagttaaccataagatgtaattgataatttagtttgtaaatataaataacaaatataatacattccctgagtaatgtttaacttcttacctgaatgagtaaggactacccagataatgttcatattttaaggcaaactgaccggggctttaattacatttgcaaaatgtattcctagaaggacattgatcagtgtttgatgaacaattatgaggctgaaagctttgggggccatatttaggattttgctcatcatagcatgtaaaaacaaatcaacactgaacaaagaaatgagatgtatgtctttaggatgaagaatattaaatgattgatttaaacaaaattaacttagaaaaaacaatatcatcctgaggccacagtaaagaatgcagagcatgattagaaacaggtaaatcaggtttagtggcaagacaggttgagagggaaaggaagaagcttggctagcaaaggtggccttgttatatagatgaagccttcttcagcgagaatggatggtaaatgtttcttttcagacattgaaaggtgtcagactctcggtcttttctggatggtggcaggaaggcatagaaaagggaaggggcatggctgcattaatggcgattcttcacagatgaaaattttcactacttaagacagctttgtaaggccacttctgtcagaatggccaagctgcagccatttcaaaatatgtcaaagaaatatattctggggtaaaatattataattttgttacaggtagttagacaggcatgagcagggcaggagagaacgctcccctgactcaccaggaatgtcaggcaatcattgggtgatggttcaacaatgatcacatttcctctctgaaaatgataattcagcagccagcaccagggagagacaatcacgtgatggttcacagctgttacattaaagtgttaattgaatgcaggcaccagggagaaaaaagggcaccaatatgatctcaggtattgggcaagtaagcctgggcatgcgcattaagagacaaaatggccgagtatgaccttcagggtgcactcctcaggaaaagggaagaaagcctcaaatgggcatgtgtacaccctaaacacactgcatgtgctcacctcccaagcataagaagggcactgcacatgtgggcagcccaccctaagcaaagaatcatgggaaagggacacaagactccagaggggggccagcatataaagtcctaggatcaaggttaaatggggcacatgaccttcaagtcacctgcttggatctctttcaagtgtactttccttctctaaagcttttttttctttcttttaaataaatctgctcctgctctgaaacttgccttagtctctttttctaccttatgacccttcgttgaattttttcttctgaggagacaagaattgaggttgctgcagacttgtatggttttgccactggtaactcggatactttccacccctaacaattactttcacttacctaccataaaatgtgccaactagtggctggcatagttcaaaactgaaagataaactatgcacctgtgaggaaaagaaggaaaaatgggcatgaaatgaatggactccttcagtactatgaaaagaatttgaaatttttcatcacggcactattaacatctgtatgaaaggaaaataaatctcgggactctcaaatcactaagccaagggaaaagtcaaactgacaactacgtcacacaaacctgcctcccattttattcctaaataagatagctatgaagatatttattcctaaataagatagctacaaagatatttattcctaaataagatagctacaaagatacttattcctaaataagatagctacgaagataaaaagctacctacttccctcacaatttgcctgccaggaaattccttgtggacaaaggacagacagaactcaaagtcatccctctgaggctcacctgagagaaatgcacatctgattacttcctccgccctactatttgggtaaaaatgctgattgactgagtcagactaaattgtgtattcagtggaatacacaatttagtggctgatcaggactcaaaagaatgcaaccttttgtctcttatctacttattacctggaagcccccacctcaagttgtcccaccttaccaggctgaaccaatgtacatcttacacaaatttactgatgtctccctaaaatgtatagaagcaagctgcaccccgaccaccttgggcacatgtcattaggacctcctgagactgtcacaggtacatttttaatcttggcaaaataaactttctaaattgactgagacctgtctcagatatttggggttcacatctgaaacatttgaaagttgaatgatgcttcattccgcaaagaagaacttattagctatcatttaaataagtgtgaggactaaaatagaatctgaatccaaattaaggacaagcaaatggcagagaaaacaaccatcaattaattagaagagggtaatgagataattaagacctcagtgaggtcactttttaacaaaatgatattatttaataaaacataatctaaagttctcatacattatagctttctaaagattctaaagtaaaggtaaaggaaaagtgagtaaatttaatttgacactaaaggcaaaaaaaaaatagatgtcatacatgaaaaagagaataggcacattgtgatgtaatggcatccagacgctatgatagtaaaggtcaggaataataaatttttaatttctgggctaattctttaataaataacatcaactagcactcaacaccctgcaaacaatttaaacattgagcttgagtgtaaatgattggttttcgatgattagagtgtcctcatattcatcccaatgatcattaaaatatgtatatatttttaaaaagtacttgaggtttacttgttagcagtggcgaatctctatgggtctgcaacaacctcaattcttgcctcctcagaagaaaggattcaaccgaggagcataagacagagggagagatcaaggcaagttttagaacaggagtgaaaatttattaagaagttttagagcaggaacaaaaggaagtaaagtacacttggaagagagccacacaggtgacttgagaaatttaggagcatggagttttatacgttggcatgcttccagggtcttgtgttgctccttccctgattctttccttggggtgggctgttcacacgtacagtggcctgccagcacttgggaggtgtcgcacacacagtatgtttactgaagttgggcacatgttcacttgaagtgtttttcccttaccagttcctagaggaaggccatataccagttgaactctggcattttacctcttagtgcacatgcttaagcccactgtcccagctcctgagatcttatcaggaagctgctggtcaccagtttcaggtgttttctatctattgggagcctgccagtctctggtgtgggctgcaaccaattattatttcagagagacagtttaacaaccacctgaccatctcctgatggtcacctgatattcctgatgggtaagagggggccctctcctcccctgcttatgtctgcataattacctactgtaacagactgtgatggatgatttagaatatacaaatcatcagggtctttggaaactagaagtatgcaaagaaaaatcaactaggttaaccataagatgtaactgataatttattttgtaaatataaataccaaatataatacataccctgagtaatacaaaatcacacatacacatgttctatttgaatggcatttatcaaatatttctcatattcttaatatttgttatgttcaaagattcccattgctacaagtctccattgcatttccccagttcatttctttctcagctctggatacttttccctctatgtccatgaaatttaaagggagtccatctttaggttcacttaaggcattaattctcacaaaatagttctgcaaggaatatttaatctttgtttcaataaattgcatttcatgaacctggaccttcaggattgcctacagacactatcaaaataataattttgttaaattaacaaatgccaatatttgtgtgatgtatacatgtgtgtatctgtgtatatatattatagttatgtacctacataactagtacaagtgccaatttgaacctctactctgacatttagtaacaagaggtgtgggatattgggcaattttttaaatgtttctgtgcttgatttttttttaaatgaggatgcaaataagattataatgagaattaaatatgaaaatgtacataaagtacatgttccttacatttggcatatagtagatgttacataagtatcaatatgtaaatataatgtgtttaccatgtgtatatgcatatacatatatgtaacaaacacaaacatgcacttataaaagaaatggaaagaaataaatgaatatattaactctactgtgtttatctgatgagagtttgtatttttcatcatatttggatacaaatttcaaattttcaattatgtgctgatctctcaggtacagtcagaaaaaaatgataaatatttgttcgttcacttggaaaactggttttaatctgacacattagagttcaagtgattatcagaaataatttcttcataatgagagctttaaatactagaataggctactagttgtgtgaaagtgttttttggacaccttaatacttttcacttttttaaggttaatttaagagagaagaatagacctcagatttttcaagccctgacagcaagcccgatggttctatgattatatggaagtcaaatcctattatcaaaggtgtgcttcataatcaaaatataagaagcatgaccactagtgtacctggaaaactggtgggcttttccttaagggatttttttttctgtgatttcgttgataatatggatgtagatgagcattttttttcttatatttaacttaaattggctatacttccaaacgtgactattcatatttgatcaaatacatatatgaatttacatataaatatatatacacaaccacagtctaaagacaaaaatcatccatgttgactccaagagctccaactgattctttttttcatatttaatattacattatataattgtagcacattctccacattaaggacactttttttgtatcacaaagtgctgctagaagcattctaatacatttttcacgtgcctaaatgcaataattagaatacataccccaaagtgaagttaatattccatagaaaatttgtatattcaaatgagcatgttaatgataaatggctctggaaaatgtttgtatcaatttactcaccaccaacaatactccttatcaacatctcttattagtagactctagccatttaggtctctttcttgccaaataactgctcatttttagtccaccttttgctataaaattgtcttttttctgaattgatttttagttttgtatatattctaaatatcaatgcattgttacatatattcatttaaaatatttttccacaatgacatctttcatgttattcagctttataaaatctttcattaaaaaattatactcacaaaatgttgctgaagagtattgtgttgccattaccaagcttttcctaaaacccagcttcctccagtgatgtgcacgtcatctagtttccccaatagtaacaccttatgttactatagtacattatccaaaccaggaaattgacattgacacaataaaataactacactagaaactgtacatgtgcttcatcagtttttgcataccttcttgttttgggtatgtctttttgtataattctacaaattttgtatagattcacatatatatgtgtctacagattatatctgtatggattcatagaactcctaccacattcaaaatacagaacttgtcaattgctaaaaggaagcttacttgtactatcaatttatagtaacatacactccttcctatttcacaaatccctggcaaaaaccgatctgtccttcatctaaaattatgtcttatcaaacatgttatatatatattgaatcatatagtgtgtaacctttaatcatttatgttgaaataaataaatatttcctagaacttgcaaagataagtataaataaatatttcctagaacttgcaaagtgaagtggttttgtttttagaattctgcctaccaagttagtgtttgtatactacatcatattccatatttttatttttaaattgctgtcattattttttgcctatgtcattattttatccagcacatagttacatcatattaattttatccatctgtcaatctttttcaattagtgcacttagaacattcatatttcacataattattcataccttaagattatgtctgacactttatttgctgttctgtttattcccactgcttttctttctgtttcccttttcctcactttctgcagactactagacctttaaattttatctataacttttagtatatctcttcttttacttttgaaatttatttaaaattatgctttatgtttgaggactgagagaaccatcacaccatattcatgggagtacaacagaatacttcccctacttaggtcctaggaagccgaatgcagagtaaggcagaggtgttcttcaaaatttcctatgaaggaacagaagtgagggtcttggactgagaggtgtggcctcaagtgaccagaaaaaggaatcgtggatcctctcaggggccaaactaaggatcctgagtgagaactgatgcaaccacccaacccagaacagaaggtgacctctaggccttgacctacctgctgtggctgtaagtgttgggagatcacagaaaaaactgtagccagatgaaacagccttcagttcctcctaggaaagtgaagggcttcttcagggaggtgcaggtcttttttttttttttttcttgagtcggagtttcgctcttgttgcccaggctggagtgcaatggcgccatctcagctcaccacaacctctgcatcccaggttcaagtgattctcctgcctcagcctcccaagtagctgggattacaggcatgtgccaccataactggctaattttttttttttttttttttttttttttagtagagactgggtttctccatgttggtcaggctggtcttgaactcccgacctcaggtgatccacccacctcggcctcccaaagtgctgggattacaggcgtgagccactgtgcccggccagcaaggcgtaggtcttaatgtgaagaaataagcctgaagtcaaaagggagagaaacaccaatccctgacagaattgaaagcaaagacttggagtgaggaccgaggcactacccacttttgaatagaggtagcaacaaagagtctggccctgcccttatggccagtccttgaataccctaggctggcccgtcgggctgaagctcctcttcactttttaatattaggtctaagggaggtgagatccgtgatctgaaggtgcagccactggttacccagaccctacatggagtcaaggtggggaccttcagtgagaactgaagaccccagtagctcaagacagaaagggtgccacagatctgtcagcactgggtaccacatggcaaggatggtgtctgaagcaccgcttccttttctctgagaaaagccttggtttgaggtgtcaactttagagcagcagaagggaggagacccaagccttgccaatcattgatatgataattctgaatgtgaaatgacaagacaacctaacccagaatagaagggtcaccccagtatacctcagacaggactggcagacctacggctcactataacttctttctagggtgtatagtttcctaggactaccgtgacaaaatagcacacatttgatggctaaaaacaacagaaatttattcaagttctggaggctagacgaccaaaatcaaggtgtcagcagtgttggttccttctggagactctaagagagaatctattccatttttcttttctagcttctgacttatatcacaagttcttaactactatggatttttagtaattcgaaacatctgatagagtaaagcacattttgttcttttttttttaaggggatatgggacagttttgaccatttgcaaattaatttaaattttataatcagcttgtcaagcctgacaatgtaacatatacacagatacacaaaaacctttagggttttatttatgggagaaaaattacaatcatctatagtttgaatttgaaaagaattaacatgtttataatgttgaatcttctagctaccaacatataatattcctctatttagttaggccttgattgacttatacatagtagctgtgtaatttttccattgagttgttacagtttttatattccattgagttgtatttacttttaggtaccaggtattttgttatggtagtttacaaatgatatttaatttcattttcatactgtttgttaccacagaaccaaagtgtatgtttgtacgttaatcttattgtcagaaactttataaacaattttattgattagtttatcattagattttcctcataaattcgaatcctctgttaataataccagctttgtttcttattttccaagaataagccctttgatttcatctgtttcccattactttcctaatgtagtatcttcattaaaatattgactagaaatgatgattgcaggcatcctgttttcttcccaattttattttcttatttttatttatttatttatttttgagacggagtttttctcttgttacccagcctggagtgcaatggcagcaatgtcgggttactgcaatctccccctcccgggttcaggtgattttcctgcctcggcctccagagtagctggaattacaggtgcccaccaccacgccgggtaatatttgtatttttaatagagacagggttttgccatgttggccaggctaatctcaaactcctgactttgggtgatccgcatgcctcagcctcccaaagtgctgagattataggcatgagccactgcacctggccttcctcccaattttaaaataaaactctcagtgtctctatattgagtatatttactatagatgttttgtaaatatcctttacctaatttgataacatatcatttatcataaacactaatttttataaaccagtttaaaaactttgatataatttaaatttttttttgttaatgtggtattctcttctgttatgtaagtatgaaagctttcagagtaaaaaatttaaaagtatgtttctaacccgccaggaattgattttcgtgttaaatgtgaaggagagtttcagtcatattttgtttttaatatggatatcaaattgttccattgtcatttcttagtaaaaacactgttctttcccccatttatttgtagtggcatatttttaacaaatcaggagaccttgtataacaggtatgttttgacactctctattcagtttctttggtctacgcgactatgcctgcatctttactaaaaactgttatttactatatgttttaataatccttaatatcatatcttctttttctttctcaagtgtatactgtctgttcttagccatttgcaagtctatttatattttagaatcagcttgtgaagtttgacacacatatgcacatatacacagtcattcacgaacaacaactacgtgactttattgcaagaaaaggattatactcatcagtagaaaaaatttggggagaattaacatgtttacaatattgagtcttctatctaagatggtattatatttctccaattagatctttagaaatttctctaaataatagctgtataactcttccacagaatttttttttttttatttttttgagatggaggttcactcttgttgcccagactggagtgcaatggcgtgatattcgctcaaaagaacctccacctctcaggttcaagcaattctcctgcctcagcctcccgagtagctgggattacaggcatgcgccaccatgcccacctaattttgtatttttttttagtagagatggggtttctccatgatggtcaggctggtctcgaactcctgacctcagatgatcttcccaccttggcctcccaaagtgctgggattacaggcatgaaccactgcgcccggcctccatagaatttttatactttacaaattatatttacttttaggaactgggtattttgttattgtaacttacaagttatattttatttaatttaatcttcatgctatcaattggtacagaaaaaagagtatttttgcatattaatattatacccaggaacctttaaaaatacttttattgctttaatagtttttctttagtagattttcctcatatacattctattcatgtttaatgacagaaacactgttccttattttccaatcccaatctctttgattgcctctgtttcccattactttattatcttcattacaataaagaatagaaatggtgataacaggaatctttgcctacttctcaattttaatgtaaaagtttttaatatttttacatgaagtatgatttttactgtagggctcttttgtagatgtccttgatctagtttaagaaaatatattttttataatgaatgagtgatgactatttttatgaacgattttttctctaaatttgcatataatttttgtcatttaatctgttaagtggtatgccaatactgaacctatttgtctcagatccattctttacccttgctctgctctttctctactatacagagcctctcaatccctaggctcccccacatctgaatgccaactgggttctgcaacaggaggcaacagtaggagattagagtacacagaaatcggaggggtcagcaattttctccttcttgctctagttacatgaaatatatatataatatcattttataaatattaattacaaaaagcagaaattattatattcaatgatattatacaaaatataggtgcagaagagattcaaatataaaataactgtataccattatctcagaataaccaactggtggataaggaaaggtttgtacctatagtagaatttcagttagtaagctaggaatgaataatagaatgagataattatccttgtatagcccctaatattatagataatggataaaagtcatgatcttcagcactgccaatgtcaccaaaaagggagacctgtacacaggcattgggtatacccaatgaaagtacaaagaataatctttggagtggttttgccaaagaacaaattcttaatctgaacaagctgctaccattaactactgatgacatgggaaatgtcaagtatattgggttcattgtactatcatttctactattgcatatgtttaagaatttgtatcataaaccattttactataaatattatgtccttcaagttgaaaacccaagtgaaatgaactaatttttagcaaaatctaaaggaataaataggttcataaaacatacagaaatatagtcaaacaacacaaactgaaactgtagtcaaagatcaagccatcctcaaacagtttgaaaaccagttaggtttgaaggccagttgcactatctattcagaggaaaaaaattagtgtacgggtcacgtctgtaatcccagcactttatgaggccgaggcggccagatcactaggtcaggagttcaagaccagcctgaccaacatggtgaaaccccgtctctactaaaaatacaaaagttagacgggcatggtagcgcacgcctgtaatcccagctactcgggaggctgaggcaggagaatcacttgaacccgggaggcagaggttgcagtgagccaagatcatgccactgcactcctgccacggttacagagcgagactccatctcaaaaaaaaaaaaatagtatcttatggaaactcatccaaaagatccaaaaagatttgaaattattcaaaatatttttacaagtgaacattttttgatagaaaaaccagataaaggtggtccaagtaaaggggacttgaaccaaggctattcacaattagacaatatcctaactaaattaacagcatattcaatatcggagtgaacagggcgcttcacgctttccaccccgccccgccccgccccttttgttggtcctgcgaggcctccgtctggggtaactggatgtgacgccccggatttcctcttctgagtccgaggactgtgacgaccttatctgaggaaggtgcaccctagtcatcagaggaacgagtcgctgcaggcactgtcaggtgtcgaggtaaaactctgagactgagggaaatagagcgccctgcagataagagccccaggccctgcagtcaactctgggaggccgtgggctggactttcaggctgaacccaccccacatttctccctcgggaatctgattaaggtgaagtccttatttgggcaagggtaagagtccttagatttgccgagagttaaaaaagaaaaaagcccttgagtgagtgctgagtcgatcaccagagatcactcacaatagaacattggcggacacactgagtgagggccggcctgtttgtcagccctgcaaggcttgggggcaagggcagccggaagtgttgcttactgacttccgcctgcggagtctgaaggaggtgaagctttagtctgatataggcagtgtcgtgtcggcagaggaaggcatctcaggccctgcaggagtccaggtgaggaccctgagtttcttttgttttgttttttttgagacggagtctctctctgttgcccaggctggagtgcagtggtgtgatctcggctcactgcaagctccgcctcccgggttcacgcagttctcctgcctcagcttcctgagtagctgggactacaggtgcccgccaccatgcgcggctaattttttttttttttttttgtatttttagtagagacggggtttcaccgttttagccaggatggtctcgatctcctgacctcgtgatccacctgcctcggccttccaaagtgctgggattacaggcatgagccactgcgcccggcctctgaatgagttttaaggttctgcaggctccacaaaagaggttgtgccacagtgcctaggccatgttgtcatttttgggtgtccgttcgtgaggcgtttgctcatttcctttgtgggtatctcatagagatgaagtcttggttggaagggggcagcatcagttagccgactggagggaacacattaccaactagtttccaatatggggaccccgtgtgagaattatgggattagccaactgatgacagagaaggatccaaggagcttttcccctccctgggagactcaccctaggggtgtcaaactgaagatactgctaattttctcctggggtcttagggaagtgaaggttttgtctgagtatattacatcaggccagcagaaggagttccaggccttggcaggtttcattgagttctgtcagaagggaaaatacactgcataaaactgtagacccacaagtcacagggaatgtttgggagacccaaacagagatagccagatgagacatccacacactcctctatggtgttcagtgagaaggaggtcttattgtgagggaaaacttaagtcagaaggataagtcccagaccatgaaaaagatctgggccacatattctggaacagggtgttaccatggggctgttctctgtccctttggtcagccctcggagacccctgatatgggggcccaccagtcagacaacttcatgtcatcctttttggttttgggcaagtgtaggccttggtttgagggagctaagtaaggccatcagagggaagattcccgggtgcttaaatgattcaaagtaaggatgtggacttaggactgagagaagaacccaccccagaacataggtggccccacagtctccacccatggtgtcagtcataggaggctggatatctagatgaagtgtcccctcacatccttggtagtcactgaggggtgaatctttagcataaggagggaacatcaggccagcagagaggaggagtctctcgcagtgcctggagccaaattgtagacattgagtatagatgaaggggacacccattccagtacatttgggatctccatgagctccactctgcctctgagttcagcccttggaagtccaaggcaggagtgggaagaatttccatactgtcttcatcttcaggggtctcaggaagtgagtgtcatggtctgaatagcagcctcaagtcaatataggggtaggtgcataaggggtaccgagaggttaggtgaagacacagacttaagactgagagatgtctaatctcttcctttacagttgccacagggagatgagatttttcttttttcggcaggagtggcattagctatcagaagatggggactgaagcccaaccagtagtcaaagtaaggaccctgagtgaggtctcagggaaccacccatcccagataatgaggacagaacgtagccctgcttagccctgctgtcggttgtgggaggctctgggcagggctgtcaggatgagatatctacttatttcctgttcagtgaactcaggataacaaaggttttggtctaaggaagtgatatcaggtcccagatgcttccattagtcaagggaaggacattaagtgaggccgatgggaacactcaccccagaaaagagtaatcgccacagagccctgtcctgcttatttcatacactggggtcttatggaggtggtagtcttgaaatgaaggcaaaggttcagataagcattggattgggtgtccaggaagtgcaaggagttaacatagagacacagagtaaggaccaataggaatccactccaggatatatgtcgccaaagagccctgataactttttcagccagggagcactgggcagggatcatgtgacaagcacccactcctcctttttgagggtttctgtcatgtgaggttcttgattagtgtacctacatcatatcagatcagtagacaagggaggccggggcctgtgaaaagtcacagtaaggaccccaagtaaggtccacagaggaaaaaggacacaggacacaaggacaaagaaagcttcacagtgtacagcctttgttattaacactgtgaatccccagtaattgcagataggtagtgtcctttatcacttccttctcaggtgactcaggaggatgaggtattcttgaaggtggagagtggcattagtatactggtaagtcaccatcactagccaagtcaaggagcccgaatgaaaactaagggccacccaccccagaagagcagggattctgaagactcaagtactgcactgttgtcagccctgagtgggtatgggtaaagctgttaggtggaggtgacacctcactacctcctccagggtcttgaggaggtggaaccttttgtctgaggggacaacattaggttaacagaaggaaggatcccaggaccagcctggattcaaagtaaggcacctgagtaataactgaggggactacccataccattacagtgcctctcacagaatctaggtcctgctatcagccctggtaaactccaggttgggtaactggaggaggtacctgacacttccttttgactttggtcttgggggcacagccccacattaccacaggggaagtggcacaggccctatcaggtgccaagttactggcacttctggccatcaactgatgacattaccctcctcagaacaaaaggagctgtactgagcccaactacaagtgtctactgtgaacctgaaaaattctcacgttgggttggctggctgcaccctgagaattctcacttcatccttcaggttcttggtagacccagaaaacacaatatcagatctgtgaggctctataacactgctgtcaggagaagtctataggcagtggcttccatcagagctaccgcagttgagtttaccagctgaggacatttacaccctttctctctcccttaggcagtgattcttcattgcctgccctcctgtccacactcctgcctactgccacccacaagggtcatcatgtctcaggatcaggagagtccacgatgcacacatgatcagcaccttcagaccttcagtgagacccagagcctggaggttgcacaggtctccaaggctctggagaagaccctcctctcctcctcccatcctctagtgcctggcaaactgaaggaagctcctgctgctaaggcagagagtcctcttgaggttcctcagagtttctgctcctcttccattgccgtcacaaccacctcatcaagtgaatctgatgaggcttccagcaatcaagaagaggaagatagtccaagctcctcagaggatacatcagaccccaggaatgtgcccgcagatgctctcgaccagaaagtggcttttttggtgaatttcatgctgcacaagtgtcagatgaaaaagccaataacaaaggcagatatgttgaagattatcatcaaagatgatgagagccacttctctgagatcctcctgagagcttctgagcacctagagatgatatttggccttgatgtggtggaggtggaccccaccacccattgctatggcctcttcatcaaactgggcctcacctatgatgggatgctgagtggtgaaaagggtgtgcccaagactggcctcctgataattgtcctgggtgtgatcttcatgaagggcaaccgtgccactgaagaggaagtctgggaagtgctgaatttgacgggagtatattctgggaagaagcacttcatctttggagagcccagaatgctcatcaccaaagattttgtgaaggagaagtacctggagtaccagcaggtggccaacagtgatcctgcacgatatgaattcctgtggggcccaagagccaaagctgaaaccagcaagatgaaagtcctggagtttgtggccaaagttcatgggtcttacccacattctttcccatctcagtatgcggaagctctgaaagaggaagaagagagagctagagccagaatttgagtcagggctgactccatttccacagccactgtgagttccagtgctatgtctggtagcttctcccatacctagtgaagacaaggatagatgttttatgtaacatttgcagaaggcagttagtgttcaaggatgcaggtccagggtggggctggaggaaaaatagtatatatcatctatatccctattttgtatgtgtaacttgacagtttattcttttattttttaatggctatattattcagatgatgtttcttttaatagaagtttaggtagtttccagatctcttaagttttgaataatattggtcatccatttaatgtttttcatgaggtttagtggcatatgttttgctgattttgtaaaacagattgggaaaccatctatattgtgttctgatataggatgacatgacattactaagaactctgcttttaaatatccgtttaatgttttgcatgcagtttagtagcaaaggttttgttaattttgtaaaacagattagaaaaccatccatctatattgtgttctagtatagcatgacatgacattgctaagaactttgctttaaaatatttggaataaaaaatagataaaagatgatcaatgtatttcttactgaataccttttagttttttgttttgtaaaattaaatgatatatgcattaatttgcttaacttagaaatatccgagaaatagatctccataaattgcacaggatcctcactatctcttttattccccaaaccttagttaagcatttgctctttagtaataatcagaataatactggaatgctaggatgaacaaagcctaggacctctccttataattctaacttataggaacagaaatcttacaatgatggttgtgggatattttctgatatctaaaggacaaataaaaggagttaataggtaagttggggggaatccatatgagactgtcaaatatagattccctgaggcaaagaaatttggggctttgagagattaaaattctttcaatgagtataatttttaatttaattcgggtgtggtgaaagatgaggctgagagagtggtgatcagggatcagacctcaagatggcttgtctcagagttgagacccaaaagcctggtgtagaaaactcctcatcacagttaccttgggatcatggtttaaccagagacaaatcacccagggaaggaatggaaactgttctgctcttatccgtatgtcactgaacatagttcataattaagtcttgttacatgcattgtctcaaggagtttctgagagataccagtgacactttcttgagatgaaatacacaaaagccactgggttggtagtcattaccctgggtaagaagaaccaagtaccactccacttaagggatatttagaataggttatcttcaatatattttaattacttactctaaagaatgtttatatttttggtgggggtgaaataaatgaaaacacgggtagtttggatggaggcgaggtgttggtccttgttaactgttctaggagttgcatcagctaaagaagaaactctcgccctcatgattgaaggacataacttccgaatggaaaaaaatggctgagatttacttttcaaacagcatttggttgatgtgatatttcattttctatagcacttcttgttctcctctgagacatactagcttggaaaacatcactagtggcaggtagggtcagtgatgaaaataatcacggtaataactgcctttcattaaagacccaagatatgccaagcattgcgcctgatgcttttcatacattgcattctttccaacagttttttatcacatgcattaacaaactcacccctaggatgaagaatctaagattcataaagcttgggcatgtgcttgagttcacaggtctcatatatgacagacctgagattaaacctgtggtctgaattcttctagagcctactctgttccacttctccatcctaatggccagtcttcttttttcttgattcagttgtcttttcactactacacagtgcatcttgggataaaaaggtccttccatctgaagtaccaaaagcaggtgtaaagaagaaaggtgaaagtgataaccaaataaaatttgaggattgtctgtgggcttcatttacatgggatcctgatgcccttagccccaggattcctttaaagttacctttgcccaggggctggcattatccagctctagctctttcctgcattaccacacccttcccctgggttttctctgatgtgcactcttgtccaaatggaaccctgacctgctgactagctgctcactgtgtcctctgaaggctgcaccctgctcccagtggaacaaaccgtccagaatcacctcccttcccccgacttagggtatccaaactcccaggtaggcccattcctcactttaaaacccctctgatagcaatatcttgttcaatgcaaaaggtcattttgacagtgaaatttagacctgttcatcaccactaaacatctccaacacattgtcaaaatgatttgcaaatgagctagtgaattataatctgatttggcaaagcatctactagttttggggctatatccccaagaaacaggattttgaaaaccaccctgatatttgcagtagaattttaatgggatttcttgtttgacacagtctactggccacataaaccagtgagtgagcttaccttagtgcttaaaagccaaagcttctcctgtaagtagcacatgagaaaagatcatcaaagtaactatgcaaacatctgtagtatatcaagtcctgaaaattctggagtccttctagacagtagaatataatttcttggtagacatgataccattggataatattaattgattaatttgactgggcgctgtggcttatgcctgtaatcccagcactttgggaggccgaggcgggtggatcacgagctcaggagttcaagaccagcctggccaagatggcgaaaccccgtctctacaaagaatacaaaaattagccggatgtgatggcaggcgcctgtaatcccagctactcgggaggctgaggcagagaattgcttgaatccgggaggtggaggttgcagtgagccaagatcgcaccactgcactccaaaaaagcgagactccgtctcaaaaaaaaagaaaaaaatatttaattgattaatttttaaaaatctaggttttcactgtacataactgcacctgtgctgatgttcaggcatttttagtcaggtgatagatagcagagaatcctaggtcaaggttttgtcagtgcacctgtgggaaaccaaaataggccaccccaatatatatttctttgacatatttggagatggctagtcagaggagctgtatagctctgaaaatagctctgaaaggctgtcctttcttagggaagatttacacctgtagaaaaaaatctacattagtaaggcgaacgggatgcttggcagaggctttctctgaggcccccttatctgcctaagaagtttgtaaaaaagattcactcacagaaaaaggaggctaaaggtctgataacttttaaatctcttacagagaaacttttgccacaggatacatctattctttcttaggactagtacctaggacactatctgcctaacaagaaagcctttgcttgccatgcttctcttcaaccttacataatttcaaggagcttcaagcccctacccctttctgtatggtataaaaacttcagttacctggcccttctttgaatttcatattttgtgtaacagcagtgctcttgcaccttaatacatttttatgagtttttcctgttaatctgttcattgtcagtttatttcagcagaattaaagactcaaaccttcagaggaggaagaataaatttccttcacccttacctaaagtaatgagaaaattctcagtatactttgattatagtggtcactgaaaataacagcgcagaatggtgcttttgagtgaaatatggtaagcccatactgtagatatttacagggtccttttgacaaataattgtgatgcttgtttgttacatagtaggagaatcacttgaaccttctaggcggaggttgcagtgagccaagatcatgccgcttgttaaaggatactaaatatggtctgaaaaggactccatacttctatatttgagtccttgtggatgaagtgtaacctagcttaatagacaaaactgaaaacctaacttagtagtatgcccctgtaacaaaagctgagtgttggctaatcccagcagccatacttcaaccactcatagactgcagaatgttcaaactgcattcaaataagccaaatgccgagttgtaaccaatctcactgtttctgtaccttacttctgattcctatacgtcactttacctttttgtctataaatttgttctgaccatgaggcatccctggagtctctgtgaatctgctgtgattctgcgggctgcccaattcgtgaatcattcattactcagttaaactcctttacatttaattcgactgaagtttttcttttatcacactgcactccagcctgggcaacagagcaacactctgtctcaaaaaacaaaacaattctaacaatacagataagtcacaatttctacctgtatgatattccctcataattcagatccatcctcagagataatcacaataaatagggtatatcattttaaagctaatgctagggtttctcatacatagaggtgctataaaaatatattgtgattattaatcataatggctagtgaggtgcatattattttgccatattattttgctacttcataacatgaatgcaggatctttctatgataacacatttagatgtacttcacctgtggaactacccagtagcatgtatgtgccatgattaatttagccatctccttccagtgtgcacataattagtttactcatttattgctataacttacagaactgaaatattctgaacataaaatattaagctaaagcctattctgatagcaaagtggaaattaggttaaagtgggtagtgtgtggagattttaaatttgtataaatattacaaaaatttcatcccccaaatgtttacccattcatattctcacaaagcaatgcatgtaaatattataaatatacatattttattttataaaccaaaatgcttaattttagtgcttctcaaattagattcaattagaatgaccaggtgatagggaatggggccagatgagacactcacacttagtattggatgaggatccagggggaaatcaattttcagggttcatgaaagagaccacatgaaccacatgaaccacatgaacatcaacaaaaccaagtctagagagcccagagcaggatggtagtcacaattctgaatgcagatgatgtggtttggctgtgtccccacccaaatctcaccctaaattgtaataatccccaagtgtcaagggcggggccaggtggagataattgaatcatgggggcagtttcccccatactgttcttgtggtagtgactaagtctcacaagatctgatggttttataaatgggaattcccctgcacaagctctgccgtctgccatgtaagacgtgcctttgcttctcctttgccttccaccatgatcatgatgcctccccagccatgtggaactgtgagtccattaaacctctttcctttataaattacccagtcttgggtatgtctttattagcagcatgaaaacggactaatacagcagagtttagtgtaggatggagaaaggactagaagagaaggtgggggatctgggtggagggtccagggcaactcaaatgactaggtttggggaatctgaatcaccagtaatagctagatgtggtatggttatgagagtggacaggtctactggatgacaaaaaacagaggcattgcagacacccatcatcctttagaatgtctctgtctactgtcaggcaaagtatagttgtctcttctgcaatatccagtaatgttattggtcatttctaggaaagctacatgtcttgacttctctgtttgaacacttgccagtttttcaggacttggacctgtcttgattcatgctgaaaatggatatttcatcctttgtacagtagaccctctccactgtgatcagagatatgaaaatggtagtgagtaatgaaagacatttgagacacatcaaaaataccaatgagcagtggaaggcagtatccaactgcaaggaggaaattagaaaggatttaccctagtagtaatgttttcagtttctttgtagatactgggcttggtatggacatgtctcttaaaacaatccagacagagttagaccctgtgaagactgtactcttcctttctgaactgactaggggaaaatgagatgtgaggggcccaatgaaggaatcatcacacatattactcagacaaaactagggtccacctgctgggtctcacagtccagcaaaatgcagacagactgggaaataagagagtttacttctgtaaccagccccagggagaaggttagggaaattcaccagaccaactcaaagttacaagtttttcttcaggatttatatacatttaagctatatgcctacatgcgggtgtgcatctacaagcaagagtgttttactgaatctatagctaatctttaacgagggtctggggtctggtaagtttctctagggccttgggaaaatttcttaatcttaagtggaccctggtaccaggtgtatgtgtaagaatgcttttatcattggatcagacgttagggtctgaaaaatcccagacagggtcttaatgggtttgttttcacattccagcccttgtactcaggcaccagtttctccagttctttaatgtttaacttatacattcatcagagttatagtaaagggttagtggaaactggcttctctagttgctaatggaaacctggccggccaaaatatcaccttattacaggcatctctaactccaagacactgcttgggcctggggaggagagatccataattatattttcaaggaaagtttcccaagggaattctcaaattaggtcagcagttacaacttaacacattgagtttctttcttggattcagaagaacttgccaagtggtaagctccaaattttgagtctttaaatgtgagcctgtggtactttaattcactcattctttcattgattcatctagcaaacaatgtcaaacatatgctgagggtgcatcatggaccataaatgggaatgtgttgaaagatgaaaatcactattttcaaaattcgatgagaactccggtaattaccaaggaaacttactgtgtttttgctgaagtctgactttgacttctctgaagatttgggcatcacaggctgctcaaatacttacaggtatcatttataaaaggagtaagctttttaaaattagttaatttatttatatctgatgttcattaagatgccagataattttaattatcatttatctacaacatatttgttgccactttccaattttaggaaagaaattttggaaatcatagtagagtccacatgaactgttattgtttgatactcttggagctctcataaccagccctgagatcttaaggaagccactaagtcttattacatttatgacaaaatgaccttgaatatatctattccaccaaactttagtatttcatgaagcagtagtgacaggtggttagaaaaaaaagcgaactattctatagaagcatcccagcattaaagaaatacataattcagtaaaagaataatgacaagtagacaaaccacagtgttattaggtaaaagatggcaaggtattcaaacaaaagttcgagggaggaagtgacatttgaaataggccttgaagtatgctaaaattttgaaaaggttgtttttggggcaagagaaaagttatattccatcagaaaaagaaagtggtgtaaggcaaggagataggtaagctaagtgtttttcgggaaaaaagaagtatgatttgagtcatccataagaaaagagaaagcaagtaatgagtgataagatttaggagtgctggggccacattatgaagggcttgaatgccaggatgaggggtcttatttataaacaaagaataacatgacaagcataccaattcaggcagatcagacagtagtatttgggggaagtacttttcccaagaaagctgtattaaaaagcagaaaaagtaattatactgataaacaagataaattagagattgggactgaaatgcgtttgagctgaaatacaaaaaggcagagaaataatagtagagataataaatggtcacaatatgtactggagccaaaaaaagggctagtatcagaaaaggggggtgttctttctatcagtttatacagtgcctaaggtcttctagaaaggaaagagctatatgctcactttggcatcacataaactagaattgaaataaacagactagaggtagtgggggaaaattattacctgcaaagtattaacattgctgtgaggcaggaatacagagatgtatacattgccaccaattcagccaccaactctgtcattttcaaagtacaaggagttctctgcactccatgaaatgaagatctactatgtcttaatgacacataatccacttgccaaaaagagtccgggtctgaccttgaaaacccaaatagtgtgagagccaagcagaccaaaagaagtgtcatgtggaaataatacacttgactgtgatatttggcatcaattaatggaaaataatgttctctctgataatctgcggatctacacttcctcatatactcttcttctgcagaagaagagaagggtatattcattcttgttttattaataggaagtaaagcttaccaaaggaagaaggaggttgttagcaagaaaataggaaagtgacctgttctaatagagaggaaagcagactgggtatgatttgaagaaaatggggacacacctaatgccaaagtatcttctcagtattctgttatctcacatttattcaatagagacaatattagacaacagacatagagagattatttcagaaaaaatcaaatttttttttttttgagataaagtttctctctgttacccaggctggaatgcagtgacgtaatcatggctcagctcactgcagcttcaacctcctgggctcaggtgattctcccatctcagcttccccagtagttggaactatagacacatgccaccacacctggctaatgtttttgtttgtttggttggttggtcggtttctttctttctttcttttttttttttttttgagacaggattttgctatgttccccaaactggtcttgaattcctggactcaagcaatgcactgcctcagcctccaaaagtgctgggattacaggtatgagccaccacacccagccaacagcaaaatttacacttatattttaaattttgtttgattctcagatttacttttaaaccattaagagaaggagaagttaatttcaaagtgagaaatgtggccctgctgggccttgtgtgatgaaccagcctgcaagtgtgaaccaaagaaatcaatcttaggtgatgggaaatgtgtttattggagcaagaggtaacattgttactgaaacaccggggtttggtctaggacccatcatttgccacacagaatgccaatcgctgagacaatgagtatttaccaaggacgaaggctttaattggtattgcagcggaggagaaccagagatctatctgaaataatctccctgaaccaattaaaattgggttgttatatagagagggaggtgggaaaattagggaaaggtaaggaagcaatcatgatggataagaggtctggtgtctcattgtctggatgtggtgatctgattaatttcagctccttgcctgagggacgattttgtgaggaaggaacttaggtaagacaaatgtaagtttcaagttttaagaccaagagggtcaacttctatgtttatttgaaaaaaaaaacagtaaatatcagttctatgggacaattgggtcagtttcaccccccttttctatttttcaatttctcaatcatgggaaatctggtagtcagtctttctgggtgctttatgctggggaggggcatcgtgggataataatgaagaataaaacattacccctgtaactggaagtactcacaagtatttggtcagcatttcacttattggatagccatgatctgggtacatttatctttattttggaacagcttaccatattcactgagatgattaataacacagataactcaaattttaaaaataccaaagctagggtctttggctggtctttgaataagtccatctgagggttctcaagaccatgtctgtttcccctggaaggatcccagagggactggttttacctgaatataatacataaagccagttgcccatggcttgcatatgaagtatatcaactgcttcatctggggtgctccacttgacattgataagtgaagttggtcagttccttttctcagggtaaaaagatcttacagcgacttgtgtccagtccatgaggctggctattttctcatgaataaccttctgtgtgtctgagtcttatatacccatctgtgattgttcaatagagaattatgtgtcctgcctcaaccaacacatgctcttccattctccagcatttaaaaccaaagacattgcttccaaattagttactctcatagtccattttagaaaaggtttctcaggaagctgattataccagtctacaaaatggaacaattctttcacattatatcatctggtttcaatagttattgaaatgtttggctctgcacttttgccacattgactaccttgttggaaaccatagatttcaagaggcattttctggttccctggtgtaattttcccttttgtgggtaggcttgaggctagtaatcagagctcagacagacccatatctgagcttggtccaggctcaaggcttaattcagtattctctttactttcattttatccattatagataacaataaccaagagattgaatttcactttttcctcattagtttgcatttcctcatgcatctatgaaccatctctcaaagaactggatccatctttaaattttattgataacttaaacctttaataactgaatgcagaacaactgaggctccataccatggatgatcagggtgccacccaagaatcgaaggttaatctaatagcaagtgtactatggttttcttcttaaacatattttttctttctgtagtaccccatttataccaaagacaaatcatagtaggactaatttatttgaaaaataagttttagtcttattatacttggcctgatcatttgcataaagcacagcaataattaatgtccatgtagtctcttttaaattgtttttgctggaactttttatttttatttaaaatttatttcaaataaatttatttcagattaaatttttaaaggcctctcaagtccagccaaggattttctgtgcctgcagatatcattatgaatttagttaattcctctcttctcgagaggaatttactaaattcccaaatattattcccaaaataactcaagattcttgggcctgtcagaaagtgacattatttacttaccacaggtcagaaaccctactaaggagcttgtgtagtctttccaagggacttttatcagctctataagtcgacctcaatttctcaaaaaattctgctcatttttgaaaatatcattccagtcaaacccttggtaaaataaccagtgcctccaattgtgtcctttcatttaaaaaaaaaaaagcagattcttattgaatgtatgcaaataactattttgctgtgaattaaccatattcacaaatagtttcagaattctggggaaatcaggcagagagaaagagaaatatacttaaaattctgttttcaaatatatattctactcaattgttaaaggttatgaataactcaaaaaatcttttctttactctgaaaacaaaatgaattggcaatgtctcaaaccaaaaaagccacaaaaaatatttcagtcctctattagttcagtgcctgcatttaattcttgttctgcttcatattaggttagcaatctttatgaacacatcagcattttaattagagttttggaagttttctctctagtccaatggtacaatctccaatattaccagaaaactgtactcaagagttattttcatgaattcccctaaagaagtaggttttggactgtagctaactgaaagctgaatttttttttctttttctcttttctttttttttttttttttgagaaaggatcttactttgtcacacaggctggagtgcagtggtgtgatcacggctcagtgtagcctcaacctcctgggctcaagtgatcctctcacctcagcctcctgagcagctgtgatgattggcacacaccaccatgctcagctaattttttgtagagatggggtttcatcacgttcccctggctgatcttgaattcctgaactcgagcaatctgcccaccttaacctcccaaagtgctgggattacaggtgtgagctaccttgcctggccagtaagctgcttttttgagaagaatcaaagtaaaacaataattgtagaagacaaaagtcttaggacagccatagttaaagacacaattgacaagaaattttggttatttctgtgacatacaacaatttaacataatcatcataattaatattagcaacatatcagaatttgatatgttgttaagacaactaatacacatcagaattttaggaagctcatacagttttgtaacacatattaataacacatttatataaatataacccaaagtaagttaaatattattttacattggacaatacttcctgtataagtttaacataccaaaaaaagcctaatatgtctctctttggtttctattatctaaaaaatcttggaccctattatctaaaaaattagattagtttgaagtcaaaaagactgaatttagaacattaaatttttgcttttagaaagtttgtcaaatatcaaaggtacaaaacatttgatatcacaaaatagcatcacaggtcactcatttagccaaaatgatacttcaaagattaaaaaaaaaaaagaaacctttattatttaatagagatgagactcagtttctaaaacaataaaacctaagaaagcatgaagccaactaaatctgtctctctcttcccttttacctgcagtttactcaaaaggtaaacaaaaatcttttattatctcttattaatattacatgaaaattttgttcaaaagagaacaaatctcacctgtgtgtgatgtatcattaatgttaaagctaatttttacaaaacctgttgaataaatctatctaatttttatcagtttaaccacaaggtaatatttccataaaccttttgggacctgttacaattttctattgaagagtaggtcaatactctaagaaaagcctgttattccaacacagggccccagatgctagtcttgcatcaatgtgcctttgatattaatatttaatttatggaaaaactcaactaattttgtccctcaaaatcagcccttacaatcttgtgtgcccacttccgcagtaatccctgggcctagcaggtttgaatagctttaatatctggccttgtgtcttattaaagcagttcattttgattgttgccttctcctggatctgaagacaaggctttgactgttgtcagtgttcaagatttagcaggagttggtgcctttttcagatccaggagtcaaaaccctgtagcttaacagaataaaaaatttaaaagcaatacggaaaattacatggatataaaagccttaattcttttaaatttcagttttcctatgcaattaaaaacctaatagcaatgatataggaactttctcaataaaatgtaagacctgttacttaggccagttaccaaaaggcaaaggaagaacttctgcagcatgattgcttctccttatgggaagttcatttaagtaacctgaaagtcaaacctgatgaactatttagacatatcaagaaaaaccaagagtacaaaatgaagttatactggaggaaaatgttgcttttctagactttcaggataaatagtttagcatcaagccacaatagcagttagaaccagagggaggaaaaattgcaggagctgacaaaagaagttgaaagagagagttattatctcaggccttttcaaggggaaaaaaaaattgaatgcagcaagacacgacaaagttgcacttctgagatatgaattctgagaagttttaaaaagaaacagattatacaatcaaaatccaaacctcatgtacaagatcgtttcacatacaaaattattctattttccttataatataagcagacagggaaggtttctccaggtataggaatttaattaacctgatcaatcagcctgttttatggcttcctgcccttaagcctattcttccccaaaccctgggtagaatagggtcaactccttggtttaagtcagctcctgagatacccctgagaacttgtagatgaactcaagtgaacttgcctcattactatgctaaagtcttcatcttgggaggagctataactttatgactgtaacatgcaacctatgtgctgacatgatgattcacagcatctgcaccactggggctcctcttttacatgcattgacatacgctttcacctctcaatcaccccatgagatcctcctgtcactttcctggcgggcactgttaatgaagaatatttccagtatcctctttacttgaaccaagtaataaaactcttactgatcaaaatctgcattcctgtagacagtcccttgttactcaccaggtgaatgaagcccagtatttttcaggtaacaataaccttccttatgaaaaatacatctttatattcataagttttttacatctgtctctaagttttttacatctctcactcctacttactgttttctttcttccttatttcataaataacctttctaagtccataatttgaatcaacctttagataacttctgaattagacaaaattattctttttctcaataagaacatattttctatggcaaattatatatataggattatatattaactaaaattataattcttagttaccttaaattttagtgaaaaacataagaagcaagaaatcctatactatctattagatgttatcattttgtagatgagaagattccacaactttaaaaagaaatgcctctccatattataaccgtttcttaattggatgtgacacagacatttaacgagcatgcaaaatactcaaaatactttccagattttaagttacacgaaatatttacctacaggatttacctcatttatgtttaattcagtttttatagtttatttagattacttattagcaaagataagttattaataacttataattaataagtaattaataacacaaagctagttattattttcttgttaattatttttgtaacctgtacatattaggtgttcatctaggaaccttaaagttaagcatatgagtatcttcaccaataactcagtagattcagctgttttcattaaactaacaacattacacttgtcttatttatccaaaaaaccacacaaagatcattttcttcttggcttggtttacagtcttataatcttttgtgccaaactctgacacattaaaatatctggcagagacaaatataaaatccagacaaaatgtatgctgacaattctgaaggcatttctacttttattttatcagtaatcctaaagccagcttgtttattaaatatttacttaaatgatatgaacttgaaaaatgggctctcattggctgaagggcatgccagtataaaactatccttctgaaataagtggacaagactggtgccaggaggaaaaggagtcttccaacagatagaaaacaccaggagccagtaaactgcgtttgctgataaggtttcatgcatatgcaaaagggggtaagatggtgaaatttggctggtatatgaccttcctatgcggatgttggaccagtaaaggaaaattgccccaagtgatcatatgcacgaattcagtaaacacatgcccatgcagtccctcccaagtgctgacaggccactgcacacgcggtaatcaagcaacagcctgcccaagggaggaattaggggaggacaataggaagcccaggagatgagccaatgtataaagtcccaagccaaggactgagcaaagcacttgaatctctcaagtcatccactttggtttcttccaagtgtactctgtttgctttctttgataaacttttgcctctgatttaaacctacttctgcctctctgctgaattctttcctttgaggaggcaaggactgaaactgctgcggacctctgtggacttaccaccagtaacagcactgcagttcaaagacccgtggaaagttcaaacctcctcagactccaaagaacactggggccaaatagcattacataagaatagcattttcctttgttcctttgtctcataactatatgcagaacaattttgaagaatgcacccaagagggtggcattctaggattaaattctgatttcccacgactatagtgacacacacacataaagaaacaataatcagggtggggcacagtgatgcatgcctgtaatcccagcactttgggaggctgaggcaggtggatcacgaggtcaggagatcgagaccagcctggccaacatggtgaaaccccgtctctactaaaaatacaaaaattagccaagcatggtggcatgcgcctataatcccagctactcaggaggctgaggcaggagaatcgcttgaacctgggaggctgaggttgcagtgagccaagattgcaccactgcactccagcctgggtgtcagagcaagactccgtctcaaaaaaaggaaataataatataacaaaaaaaaagaaacctaattgcagtagtgactaacaagctccaggaatgtacaaactgaagcagtcagggtacttacttcttgcagttggttgggtttgttcaacctgcaaatggaaattacttcaaaattctccaaactgagaggagcagatactgctatctaggcccacaaaaaacactcacctattcctacgtagatgtcaaatttcaaaggctgctcttcctagacactcagaaatgcagttgaggttggcaatggcagagccagagagagactgaaatcccctctagccaaaaaagggctggcagctgcttaggaggatttccgaaactctcctggccctgcagcagcggagccactagcgatgcgatcccagtcagggaaccaatatctcttagggaaatgccaggggtccagtctaggtcctgttgctcacagcacagaatgccaatcactgagatgagtattgccagggaagaaggctttaattggtgctgcagccaaggagaatgggagatcagtctcaaatctgtccccctggaccaattaaaagtgggggcttatatagcagagatgacagggaaaacaggaattaggggagtactgaagcagtcaagatggataaggggtctggtttgggggtttggtttttaggtttgggggtacatgtgaaggtttgttctataggtaaactcgtgtcacaggggtttattgtacagattatttcatcatccaggtattaaggctagtacccaatcgttactttttctgctcctcttcctcctctcaccctccattctcaagtagaacccactgtctgttgttcccttctttaggttcatgagttctcatcagatgtggtgatctgataagtttcatttatttgcctgagggtcggtttcctgaggaagaaactcacatgagacaaatgtatgtttcaagttttaagatcggttatgttaacttccgtgataattcaaaaaaaacggtaaatatcagttctgtgggacaactgggctggttttagcattaaaggagaacaaactgatgacgataaaagtcttgaatttcatttggtgaacacaactaaactaatataggtaatgtaaataatttatttcaaaaacacgtatttgaaaaatatataacagaatggcaatgaaataatttaaattttaaaaattcattatctcaaaggaaaatataattgatatctcagaaaatgcagtaagaaaccagatgaagctcttcaagtgataaagcatttataacttcatgatgcatttaaaagaaagaaaaagtgaattatactttagttactcataagtgtaaaaagacaaatgtcaaaatatgtcaagttcctttaaaacaataatttaatgtgaaatgtctttcaaaaatatagtcatttctctccatatgtaaatctaaccacaaagaattgtaactgtataggtatattttttccctgaaggtagtgtttgctactggactagcaaaagacaaaagataaaatttaaaaactagagaaaaaacttacattaaaaaaatagtggagtagaaaattaataaagtagattgaagtcctgttactcagtgagatgaccttcactaaatcaactggattggattgccctgctttcctcatcaataacaggaagagcttcctgatagacatttcatgttatggcttcttgatgtcaacagctttcaaactagcccctagttataactagcaatatctattgatgtattgtaatcttaaagaaaatgtcattgtttgccttccaaacttccttcttcttcactaaggttcctgctttttgtggtctccattccctttaccaaacactggtttgaccacaagtatggaacgtgataggtcaatgggatctatgaagagccatggggctattgggaaaggtttgccacctgaaaaaaaagataagcacaagaagaaaaaccattcatcctgctccatgaatggcagtatgcttttctccctcccctaacatgttttgctgctgaaacctgatttactatcataacctcccaaaaggcccatgctctgagcccccattctttgtgtagcctcaagatggtataaaagtgtcaaccatctggttgaattcttatgctttgtatgactcccagggacattgtaaaagaaaataaacctcagaaccccaaaattactaagccaaagggaaaagtcaagttgaggactgcttcaggcaaaactgcctcccattttatttctgaatatgatagctaagaagataaaaaaaagtgtaaaccaaaaataaaatttgaaggccccctggatccatctgaatggactctctcctcagtcagagcaccctaaaatttaacctgtaagactagttcaggccatgacaggaagtgggggttggacatgcctcattatatccctccagcattaacatcaacacagaccttaagtctgataagaaacatttacaccttaggtctgataagaaacatttacacctcaagtctgataagaaacatttacaatctattctttctaaagcctgctacttggaggcttcatcagcatgataaaacctaggtctccacaaccccttaccataaggcagacattctttttgtagataataactctttcagccaattgccaataagaatatgcttaaatctgtgaatgagctggaattcaccacttcgatttgtcccattcccctagatcaaaccaatgtaaatgttacatgtattaattggtgtattatgtctctctaaaatgtataaaagcaagctgtaccctgatcaccttaggcatgtgttgtcaggacctcctgaggctgtgtcatgggctcgtccttaaccttgacaaaataaactttttttttttttttttttgagacggagtttcactcttgttgcccaggctggagtgcaatggcgccatctcggctcaccacaacctctgccttccaggttcaagcagttctcctgcctcagcctcccaagtagctgggattacaggcatatgccaccatgcctggctaattttgtgtttttggtagagacggggtttctccatgttggtcaggctggtcttgaactcctgacctcaggtgatccacccgccttggcctcccaaagtgcagcaaaataaactttctaaattgattgagacttgtctcagatactttctggtttacaaatgctacatacctccttcacaatttgcccacaaggaaattccttgtgggtctcaagacctttactttaaaacagttctgttggatttcatcctggcaatgtaaattgatagcttaccttcacaagtgtggaacaaaggacagaactcaaagtcatccctctcctcacctaagacaaatgcatatctggttgtttcctctgccctattgtttatgtaaaaatgcagatttgctgagccagaggaaggtgtaagtgactattcctctaaccccctctcacatgtaaattgtgtattcagtgaaaggctgatcaaagacccaaaacaatgcaaccatttgtctcttatctacggatgacctggaagcccctgctttgagttgtcctgcttttctggaccaaaccaatgtacatcttaaacatgttgattgatgtctcatgtttccctaaaatgtataaaagcaagctgtaccctcaccactctggatgcatgtcgtcaggacctcctaaggctgtgtctgtcatggacacatccttaacctcggcaaaataaactttctccttttaaaaaacttttattttaggattgggggtacatgtgaaggtttgttctgtaggtaaactcatgtcacaggggtttgttgcacagattatttcatcatccaggtattaaggctagtacccaatagttactttttctgctcctcttcctcctctcaccctccattctcaagtagaacccactgtctgttgttcccttctttatgttcaagagttctcaccatttagctcccacttataagtgacaacatacagtatttggtttgctgttcctgcattagtttgctaaggatgatgggctccagctccatccatattctacaaaagacatgatgtcattttttttctggctgcatagtattccatggtttataagtaccacattttctttgtccaatctgtgattgatgggcatttaggttgattccacgtctttgctattgggaatagtgctgcaatgaacataatatgtgcatctgcctttatagtagaatgatttatcttcctctggttatatacccagcaatgggattgctgcaaatagtatttctgcttttagctctttgaggaatgatcatactacttttcacaatggttgaattaatttacacttccacttgcagtgtctgcattcccttttctttgcaacctcaccaacgttggttattttttgactttttaataatagtcattttgactggtatgagatggtatctcattgtggttttgatttgcatttctctaatgatcagtaaaattgagggtttttaaaatatgcttgtttaccacatgtatgccttctttagagaagtgtctgttcatgtcctttacccactgtttaatggggttgtttgttttccttttgtaaatttgtttaagttccttaatgatgctggatattagacctttgtcagatgcatagtttgcaaaaaattttttcccattctataggttgttcatttattctgttgatagtttttcttgctgtgcagaaacccttatgtttaattagatcccatttatcaacttttgcttttgttgcaattgcttttggtttctttgtgatgcaatctttgcccattcctacgtccaagatggtattgcctaggttgtcttccagagatttttatagttttgggattcacatttaagcctttaatctatcttgtgttgatttttgtatatggtgtaaggaaggggtccagcttcaatgttctgcatatggctagccagttatcccagcaccatttattgaattggaagtcttttctccattgcttgtttttgtcagctttgttgaaaatcatatggttgtagatgtgggatctacgtgtgtttctgggatctctactatgttctatgtgcccgtttttgtagcagtaccatgctgttttggttaccgtggccctgtagaatagtttgaagttaggtaatgtgatgcctccagctttgttctttttgtttaggattgccttggctttggggctctttttggttccatgtgaattttaaaatagttttttctagttctgtgaagactattattggtagtttcacaggaatagcattgaatctataaattgctttaggcaatatggacattttaatgacatcgattctttctatccatgagcatgggctgtttttccaatgtttatgtcttctctgatttctttgagcagtgttttgtaattctccattgcagaaatctttcacgtcctgattagctgtatttctaggtattgcagaataaacttttaaaattgattgatacctgtctcagatacttgtggtttacaacattagtaaatttacatacctttttttcctattaatctgccttttatctgttgattttcaggaaacctccaaagggtgaaggggaaatttttttgtttcttggcccctacaacccaaagaataaaaaggtattctcacaaacttataagaacatgaataaaatagagattaaaaaggaaaagataaagctagaattaattagaaaggtaaaagaatctaaataacatgatattagaatgttaaaaagaatctcttcctttttcagtttcaaccaagaacacaatagatttcataaggaatgctgtgccaaatttacaaagatgttttggaagagatgtcaaaactcttgaatccctcagccactttgaaattataacagagtcaagaacgatataaaacaaattatatacaagcgagaaaatatcaggttaatctccctttttcacctccatttttaatgtcatgcgacaatggggcactgcctacacagctctgaggaaagcaatgactccaaaatttcatacacagtcatgatgaattcatatatgaagtaaataaaactgcctttgcaaaaattgtaacagtaaaagaaatctaacctaactgtctccaccttgcttctaacttcacaagctatctgcctttgtttactttaaaaacaaaaatgaactaatccccttcttgcttggggaccaaaataatcattataggactagtgaaaaggccacaagtttaggattgggaggggcctgaattctgttaagatgtaggcatagttaaacaataaccagtcattgttctggaggtcacaggatttgtaatttccccaaaggctcctatagaaaacatcagtattgttaaaacctaattggtctttgagattactttcagacttttgaattctcgcaatcaactgactccacccagatccatgactcataccaagtaactggatcaactggtcctgtgacccccacccagaaactgactcagtatgtgaagacaatttggatacttctataatttcatttccaaccaatcagtagcacctgttcccttgtctgctacctgccaaattatccataaaaaccatagcctctgagctttctgggagaaggatttgacaattaactcccatccttctgcttggctggccctgtgattattaaactctttccttgctgcaaaagcctgctgttctcagtgccattgcttttgtgggtggaagcaggcaagataaacccatcaggcaattatagaaacagacaaatacttggaaaaagagaaaagtcagagactagagatcctatcagtcctttgggaaaaactaagataataatgaaatccagccagtgaataattggattaacataaagactttaaaaatggagaatttatagtaaaatgatagttggtgaacactggtaaaacagaatgtaaatgttataaacattgacaatttatgaaattttatttttcatacacaaaagtccctggaggtagaaaattgtgaaacgtgagaattacattattacattatctgtcatagtggaacgtcaatcaatactgcataaaactgaaacatagtaacaaaaaaacccataatttataatattactcataatgtattttgttaaatttgagaactatttttaaattatggtgtttattttggtgacaaatagttacatgaagtttagtaattcttcaatttaacttcaaaatattttgtctattagattctaatagaattaaatttaatacatttgatttgatacagtctaatcccattttataaaaagtaaatctagttttctatccatccatctatttatttgtccatccacctatctatccacccacttcaagcagtgaataagcctgcaatgcagtttgcttaatgttaagaattgattcatgcatagtgagatttatggttatttttacatcatcctttttacttttctgccattttaaattctaaatattgagtatgcattattttttaaagtcattatgataatttttaaataaccgaaaactattgtttcaagtgaaaacagaagagttattgtaagaccttacataattagctactaaatggtaaagacaataattgctgtagtagatcaggggaagaggagaaaaagttataatcattgcctatatttatttgtggtcatttagccttagcaaataatgctgataatagtttttatttacaatagaaactctcatctacttttaaattgttaactttaatgcagttatttgttactgttcgcacatcttaatgagccaggcagatggagtcatgtttcaaatacttggtgattccaggtaagtatgtatataagagagaaaatagggtctgacaattggtctatttttatacctccattttctgggatacatgactattgccttgttaatcaaagcttattaccatgcctctctagtcaattggagaaggtttgcctttctgttccacattcattttgtctctttggcacttctctgaacttagtgctgagtttcacactaatcacaccatccatctattgactgactgtcactctcctgaaataaaacagtgtaaatataatgtaacaatgtcagattaccctatttccattgtccctgtgcgttctaatcttgcaacgccagtgataaatatttattactgacatttaaaggaacgatttggcacctctggaagaaacagaaacactttgcaaataattattactttctagttcagtaaaattaaaagttagacatacttgaaataaatcaatgcctataaatttaagacttcaacaccatattaattttaagaatacataaaactactaaaaggccattagaatgtctgaaacactaaatgttgcttactttaacaaactattacaaaatgaacactttaaattttatgcagaaattcaggggcatctttagatggtacaaaaaataaaacattaatgttaccaaatatacataaagctcttcttcactaaatagcataatagcagtattttcatatgtgggaattacagttattatttcatcaaaaatgtggaaatagcataaggaaaatataataaaaagaatttattttgtagaacatcagttatttgagcagacgtttccaaatgtcccaggtgctagattttgctaagagtatagtcaaatgaaaatacttagttttgttggaaattacaccttagcaatagaaaatgctctctttgctgctttcagaactaccaggtgattacaggatgataaaattgccattggaaatccaatgtagcaattgaagaaaagggtcaaaaggaattgcactgaagataccttatgataggcatgatctattaaagaagatactggtcagcaaggtgtgaaaaaatgttagtcagtaaaaaatgttaaatatagtgttaatgctaaaagagttttaagcatatacagtgcaatgagctattggaaatagaaggatgaatgtgtaggagcaagcactggcaagcattacaaaggccccttattcacatgaacagatgtttattaaatgaaaaaatatgtatatttttatttgcaccacacctagaataaataaccacatgttatggagtcacaaacacagaatgtgtatcttattttgtttttgtttttgtttgcctttttaaaataagaggtttccagcaagtatctttagttactaaatgaatatttccccaaactactgcgtggtatcttgtgctcttggacaagtttatagtagtctcagggctaagatattttagtcagcaatcagtgctgctgccagactaaatgcatattttattatactgtcccaggctcattcatctcccatgactctccaaggcctacagaatgaagttgtaaaacatctgcttggctttcacagccctggatagttgggccatgtagccaactatttccaactttactacttactactgtccaacaggcctcctgctatcaagctagtccctcgcttgtgatccttccgcattacatcattgctaagaaactctaatgagagaaatatagtagatctgttatgtaatgtagaaagagcttatcatgttgactctactgctaaactctcaaggttttgggaaaatccaaaaagaacttaaaatactttattaatgccccatttggcctattttagaatagaatatacagaaagatgacactccccaccaccaactaatcagtttacccaaataatatgcaagcatgacccacttcttccccctgcagtgtttaaatcttgtctctgctctgatttttatgctttctgtttctgttcatgttaaatgaagtcaacctatttattggttttccttgtatacaagtaaacagtgtgctaaaaataacctctaggtccctgagttattctttggcattccaatctttactcttttgtattgttttttagatctactccccaattttcatcttcaagagaaatcctccatgctttcccatccagattgttcatctccattcacgacatttctttagcatttatcattcctaccacttgctttgtattcgtctcaacaaatttacagagtatcccaaataaatccaaaatcagggttttgatgtgattcttctttttaatactcaactttctcaacctgtgcttttcattcttagacacactatctctttattttatttcctttttttatttcaatagaatttggggtaagaggtggtgtttggttacatgaataagttctttagtgatgatttctgagattttggtgcacccatcacccaagcagtgtacactgtacccaatgtgtagtcttttatcccttgccaccccctaccctttcctctgagtctccaaagtccaatgtatcattcttatgcctttgcatcctcatagcttagctcccacctatgagtaagaacacaagatatttggttttccattcctgagtcacttcacttagaataatagtctccaattccatctaggttgctgcaaatgccattattttgttcctttttatggctgtgtagtattccatttatatatctatcgatcacattttctttatccactcgttgattgatgggcatttgggtttgttccatagttttgcaattgcaaattgtgctgctacaaaaatgcatgtgcaaatatctttttcatagaatgaattattttcctcttggtagatacctagtagtgggattactgtatcaaacagtagatctacttttaattcttaaaggaatctccacactgttttccatagtggttgtactagtttacattcccaccaacagtgtaaaagtgttcccttttcaccacatccatgcaaacatctattttttttttttaatttttcaattatggccattcttgcaggagtgaggtggtatcacattgtggctttgatttgcatttccttgataattggtgatgttgagcatttttccatatgtttgttggtcatttgtatatcttcttttgagaattgtctacttatttaattagcccaccttttgatgggattgtttgtttttcttgctgatttacttgagttatttgtagattctggatatcagtccattgtcagatatatagattgttaagattttctcccactctgtgggttgtctgttaactctgctgctgattattattattattattattattttgctgtgcggaagcgttttagtttaagtaagtcccatttatttatcgttgttttagttgcatttgcttttgggttcttaatcatgaagcctttgcctaagccaacttggcttctttcagactattcttctatgtccttcctcattctaccactctgtcttttctttgctgattcttcatagaattgtcttcttcaactttctcttatattccttatatcactctttatattcatcctagaaactttgcttggcctttatcaaactgttctcaaatccatcacaataactacaaccccattcccacctttctaattgtctctacatggctctatcatcaattcagcatggtcaaatggagcttatcatcttcagcccccagtcagcttctttctttcgctccttccagtgactcaattcataagttttaaaaacatctctgactctacctcatactcctcatccaatcagtagtgaagttccttagatctggacttataactgtgctcacattgtaactaaaatgcaggttcagtcactcatcgcttgcagagtctaattagcaagagcaaagactaacgtaaagaaagtgactttgtattccaaagctagcttagaggaagaagtacagctttcctgctttaaaagtaccatttctcttctagagaagaaagcaggtgctgttaaaaggagacttagtgtgaatggcccacagggaagggagcgaacagctgagggtctacatgactagcttcggtgccttatctatcaggtggttgagctgactccatcatggacaaaagtagttgtacttttggttgtaagctgacttttgtctcttgaggctatctcctggtgggataagcatgccctgtaaggagtgtctggtgaagggaaggtgtaaggttataattgcatttctaaagagctaagtaggaagaagggaacaggggaaaagggagaaaaagagaaagaaataattaaaatatttcttagaaaaattggggtacttggttttaacattggttttctcttccaataatttgacttcttcaaattattattctaagtgaagtaactcaggagtaggaaaaccaaacattgtatgttctgactcataagtgggagctaagctatgaggatgcaaaggagttcgagaccagcctggccaacatggtgaaaccccatctctactaaaaatacaaaaacttagccgggcatgatggcgcatgcctataatccccgctactcagggggctgagacaggagaatcgcttgaacccagcagaggttgcagtgagccaagatcatggagtgcagtcactccagcatgagtgatagagtgaaactctgtctcaaaagaaagaaagaaagaaaaaaaagaataacacaatggactttggggactcaggcggaaaaggtggaaaggggatgagggataaaacactacaaattgggttcagtatatactgttcgggtgctgggtgtgccaaaatctcacaaatcaccactaaagaacttactcacatatccaagtacaacctgttcccccaaaacctatggaaataaaaaaaaattatctaaaacggcaggagagatatcttagttaatggagatgttctaaaactgaatttgcaatggtagcatggctgtaaatgtactaaaaatcatcatcgaattgtgcatttaaaatgggtgaattttatgatatttaaattatgcttcgataaaactgttgttttttttttaaaggaaaaaaaacaaattatgtctatgtaatcttcacatgtaaaatcccatccagggtaatttaaaatatttccacagccaagcagccctcctttaatcctatagttctttgtttctacctcttcgcattcattgtattttctgtatattttccaggtaaatatttcattccaagttttctttttctttttccttttcttttggtttggggagcagtggtatttatttggtttttctattatttatcattgacaggtaataattacaaatatttatgggatatacagtgatatttcagtatgtgtatacaatgtgtaatgatcaaaccagggcaactagcataaccaccatgtcaagtgtttatgatttctttgtgttcatttgaaatattctcttcaagttttttgagcatatacaataaattatagttacccaggttttattttattttttgatagagatgtttaagaacgaagacaaacttactcatttttgtagactctgcaggaccttgcttagttcctcacatatgaaacattttatcatattgaaatagaagacattaactaaaaatatactagaaaaagggataataaatacctgctacttcaaaaggaaagtcaaaagcttttggtcataagaaaaagttggaagagaaaattacaaagcagaggaacataaagttggagataatcacttggcccaaaaaactggaagtgcagttaaaacagttacaccagtggatttaaaataaatgagaacacgagagaatgatgtagcaacagtggatttctttaaatgtctttggttccttagaacacatttgtgaacaagagtttttgagttttctattaattctaagcagttatatcttggtatacagctctaaccctagatgcttctaagcaaaattacatttcagtcctaaaaccttctgctgaaaaggatgcctctagagtgttttattccctatcacctttagagaatttgcaaagtggattccagtgtccacttttattcttgaagtactgtgtggtctcagtccgtttaataaggggattgttaacacctttagttctaaggaaaatgtaaaccctttcttccaaaattatgttaagaagaaaaaacaataattttccatcttctcatgaaattcgtaacatgagcccaagctaaaggagattatcagcagcaaaacacactaggaatattgtggctgatttagaataagtgaaggaagagatgtttaaagagacagagataaagctgccatatatatacctagggggatggaggggagtggttctcaaactttgatgtgtacaagaatccaatggcaaatttgataaagagaaaattatcaggtaagaatcccagaagttctggccgggtgtggtggctcaggcctgtaatcccagcactttgggaggctgaggcaggcagatcacttgaggtaaggagttcgagaccagcctggccaacatggtgaaaccctgtctctactaaaaacacaaaaattacctgggcgtggtggcaggcgcctgtaatcccagctacttgggaggctgaggcaggagaatcacttgaacccgggaggcagagactgcagtgagccgacatcacgccactgcactccagcctgggtgacggagagatcctctgtctcaaacaaaacaaaacaaaacccaaagaaagaatcctagaagttgtgatttagaccattctgaataaagcctgagaattgcattttaacaagcatcctccagtgagtctatgtatgaagtctatggtgtatattttgggttaaattactacaagttctagtcttacactaattttcacctcagtatctactaagacaaacagacgtatttaaataacacagttctatttacatgaaggtgcatcatgtgtttaatatttaaagctggaattcagtaaatatactaatctcatctattaaaagtccattcgtgtactctaagtagtcatcactaatgtttctaacggttctatatggttatactttaaaatgagcaagatttagcagatgttggccacagatctgatttaaggattttttaccttatgtcattggaactatatttggtttttagtaaagcagaaatgttcatacagaactcattttacaatgttttaaaatgtccattgaacaaaaattctgaactatctcattttattttttaatgcaatccatgatgtcttcaactggcatcttgccaacacagctgggctctttaattaacacacagttaaatttatgttaatggcatatatattgaaattgatgtcataaaatgtaactatgacaattctggctgtgaatgaattttacctaacatattctacatggcttgtgccaaaataaagcaaacatttaaagagagagagagacacagagagagagagaaacagatctcattgcaatacaaagaaaaggtcagagagttatctggtctccttgtctttatgtttagatggaaactgcagatttatctcttattacatatgattattctgaaaaatctgtgatgagtcaatttttatgactagagtcatatttgaagtgcacagggatgctatgaagaactccaataaagctaagagtcatcctaattttatatatgttggttcttttatatataaatgtatattttaaatatcagccattttatagctaatcttatctgtaatattattctgtatctcctgccatttctaggcattctcaacaataaatcataattttattataattatgacacttttccaattttcctgtctgaattcctgataggtcctatggtttagtaaagcatatgaaatgtctaattttaatccaatgccttcttatcatagatattgtgctggtgcagtaccttgccaaataatgttgacttgttgatgtttattattcttatatctctaaatgagagacacctagtatgtgtgaaactgttctttgattttttgttaattattttttaccaagataaaattcgaataacaaaatttaccattttaaaattcaatcattttaaagtgtacaattcattagcttttaatacattaagaatgttgtagaaccatcatcaacatccagttgaagaatatttgtgacactcaaagacaagtcatactcatcagtcacttcacattctcccctcatccagcttcttgcaagcagtaatttgtattttctaactatgaatttcatataaattgaattataaattatgtgtcctttggtgttttaaattcttttacttagcatattttcaaggttgatccacactagaacatgtatcagtattccattccttttatttattttttatttatttttatttttatttatttatttttttgagacagaatttcacacttgttgccaaggctggagtgcaatggtgcagatttcggctcattgcaacctccgcctcccaggttcaagcgattcttctgcctcagcctcccgagtagctgggattacaggcatgtgccaccttgcccggctaattttgtatttttagtagagatggggtttctccacgttggtcaggctggtcttgaactcccgaccttaggtgatccacccacctcggcctcccaaagtgctgggattacaggcatgagccaccacgcccggcctccattccttttcataattgaataatattccattatatgaattcattgcactttattaatcagttgtattgtttctacatttttgtctattgcaaataatgatgttatgaacattcatgtacaactttttgtttgaactcttgttttcaattctcttgggtatatacctagaaatataattgctgaggcatatggtaattctattattgactttttgtgaaaatatcaaaacttacagactgatgcacctttttacatttccagcaacaatgtatgaggatgacaatttctctacatcctcaccaatacttgtgatttttggtttttttttggtgtggttttgttgcttttaaaataaatttattatatgcaccctgctgggtgtgaagtggtatctctttgtgtccccagtggcaaatgctgttaagcatcttttcatgttttgggggtttttttggcaatttgtatatctcttttttgagaaatgtctattcaagtcttttgcccatttttagttggtatttttgcctttttattgttgaaataaaggttttttctacatattcagtatactaggccattatcagacatatgacttgcaaatattttctcccattccgtggattgttttttcatactcttgatagtgcactttgatgtacaaaaatgtctcattttaataaaatccattttatctatgctttctttagttgctcatgaatttagtgtcatctctaataatgcattgtcaaaccatcgtcataaggaatagttcctatttttctttaggagtcttagagttttactattgtatttagatctttgatctattttagttaatttttatatatggtttgagggaagggttgaacttcattcttttctatatgaatatcagttgtcccagcaacattccttgaagagtctattctttctcccattgaattattgccactcttgttgaaaataaattaatgatattgatttccgtgttttcttctaagattttatcaaacacattttactgtccttttacatcttatatataaaaatgtttctccagtagtctcaattacatatgttacaatgttaactcttaacaacttttattttcagtgaaaaacctggtaagtaagcaattttaaccatctgtcagtttgcagagtgcaggacaagggcagagttgtgtacaatgtgtgactctttgtgttacaaccagaggacatggctacctccacatgaccccaggccttacctagaatttaatagttgtaaaatagacaagtcaaaacaattatcaaaaatgtttagaatcagtttgtaaccttaaaacatctaccaaagacagtatctgacctgcctaattcagaccacatgtctaagttttgaagaccatttaattttgccaataatttttaaattgtctttattttccagagaccactaaagtcacatgaaccagaaggcatttcatttaaagttttttatttttctgataaaatattttatttaagtgtctattctttccttttaaggaaattacttagagctctttcatgtactttggtagtaaaatattacacacacgtgacatatataaacacacagacagaagcatatcttatagagttataagatgcatttgcaaactaactatcaggaagttgtattttggctttttaacttaacttgtttcttaagtagattactggatttagggagggggggtttctggtttttttttccccccaagggatcccaggctgttagaaattattttaggtcctctcatgtgggcattgagggtggcacgaagaaggatggacagacagttgtaaattgaaaaacagacagaatttttaagtgactaagaatttttttcttctttctcagaaatagaagagaggccttaaaattatatgtgtgtgtgtgtataactatatatataattttataatatacacatacacacagagatctatatcaattataattaagttggcatttaactatagagctcttaaagataaatcttttcaaatattaccagatcttagctgggacaaacagctgatatttcaaaagtagcataaatatcaaaacagaaagaattcatttcttgtgttggtaattgaacccagactgtcactgtgacaacacaaaatgtaaccactaggccacagcatggggtggtctccattgcagccagcaggctgcataggtgaaccaaattaacattttctattctggcagtgagtaatatacacattacaaaacacagacactaaggtgccaaagacaaccaaaagacctttcaagacagagctccaaaccaaaatttcccaagggttttcttccaaacatgcttcctgtttttcatccaattgaggaatatttcgtcaagtcaagaccctccctacaatctagggagggccaatccaagacttgtaagggagtcctgatgcctctgggaggctatggaatcaggagaagggaagggatgttgattgcacttagaatgctcacctcaaaatcccaaagcatatcttccaattccataaacttttttcactgcaaggaagttaagacacaataggtcaaccacaccagtaagaacagtgccaggtgcagccttcagttcaaaagagctgcacagctgctgtggcttgcctcctggtccactccattggcaaggggccgccaaactgagagtaaacacccttagggcagatactggaagagcccccaaatttgttacagcctgatgagctcttcttgcctactgtcatgtgtggcagaaaagaaagagtttaataatcacagcatcagccaagcaaggagaacagggagaaatttctcaaacctgtctctctgaaaattcagaggccagggtttttaaagggtacttgggtgggcaaggggctggggaactggaacaattgactggctggggatgaaatctcaggagcatcttaaactgtctttgtgcagcttagttggttcctagaagaggttgtggttcaccaggtggtgccaaaatgctgaatctgaaaacatctcaaagatcagttcttcagttttcacaatagtgaagatatctatagaagtagttgggggaagttataaattttacaacccaggttgtgtgactttgggacagccagcaacttataggaaaacatattaagcaatggcaggtcgtttttaactatgtctattctttagcaaagttcaagcacctaccataattttaacctgtgttaagaattaagcttcagtctccagacaacaaaaggggcatttttcttgcctccaagtttaacaataaaccaattccctctcatagttatcttagcatttgtgctacaataagcaattattattattattattattattatttagcctgtaagattagaaggaagatgaagtcagtcatgttagatttctttcattatttatgattctggaaaggtggtttaaatatacggcctagttcactgcacttgctgagtaaattcattaaataaatactaattgaaaacctactattttgggggcccagaaaccaataccctaaaatatagcattttggccaggcgtggtggctcatgcctgtaatcccagcactttgagaggccgaggcaggcagatcacctgaggtcaggagtttgagaccagcccggccaatatggcaaaaccccgtttctacaaaaaatagctgggcatggtggcaggtgcctgtaatcccagctacttgggaggctgaggcatgagaattgcttgaacctgggaggtggaggttgcagtgagccaatatctcgccactgcactccagcctgggccacagagtgagactcagtctcaaaaacaaacaaacaacaaaaaaagtagcattttacaatgctacatttaaaatactacatttaaaaatgtagcattttaacgtgctgaacaaaagaagcctcaagttctcacactcctcctccccctctctccacagtcttgcccaaataagttgaagttcctttatctttctaggatccagactcactaagaagaacaactgttttttctttctcttcctgttatctcatcatctgttggagaaaagaagaccaagatgtgaccgcctctgagtggatctttttagatttataatgactgtctttgagaatcattaaaatgccaaagaaaactatttacaagttaatctctgttttctgatctaatcattccccctcacaatgatttatcgcccctcaattcctcttctcccctaacccataacctcttgccaggatcaaaatccctattcttactgtaatcttaagatggtgtaatatatgtttctataaccactgggaagttggttcttcattctgaaggctccattgtatacaaattaaataaatttgtacactttttctcctattaatcaatctgccttatgtcagtaattttttagtgaaaccttaggggacaagagtcttggcccccacagaacccatatatgaaagcctagcactgaaatagcggagattcactgctatgcctgaaccattcactttttgagagctctatgaaaaagaaatttctgtcttattcaaaccacttgattttgtgtctattttacagcagcattgtctatccttcaactaatatatttttcatgtgaatcaagcaaaaaaaaaaacagctttaaacacaattagaagtattaccttgtatagctgaagaaatacatctgtacatgcttgtttacttaagactttaaagatagtaataactataacaacaaaattatatttcttaggtaaacaggaactcacaggcatgttttaagtaaaaatcataaagaaataaaattttaaaacattaattaaaatggaaagcaagcataagtccaaagttttaactacttagtcaacaaatagttcattaaaaataaaacgtgttagatatttatcaatagctaaatgaataaatctatgactccaataagggattcagtgttccataaagttacctaatgactcatattaccaacacttgaaaatgactattagctcattctgtagtagaagtaacaaaaggagatataaagttctgagcctgagtcacaccctttggactaggccacaggggcttagcatagtaccaatgaacggggacctgactctcctacttatgtcacatggccagcatagtaccaatgaacagggtcctggctctcctacttatgtcacatggccagcatagtgacaatgccacagctaaagtagagttgcctcatagcctgcaggctcctcaaaaacaattatccttctcaattaatttacataaaaagaatggtttattttgcagaaacattatgcatttttgctttaatttctctctgttcagcctgagatttttttttaacccctaaaactgaagaagggaagtggtaatcagtggagaaatgaagccattttttttttttttgaggatgtatattttgaaaagtctattgagaacaaaatttacagaagcatacaatgtattttagttctaaatttccaaagagatgtaagtagatatttctgttagaggtgtttgtaatcatttttgcatagaaacaccataaagatttgtggagaaatgcagtaaaaacagggctgcccagaaataatcaagttttgggatattatataaatgaaacccaaaagctcaagaatgaagttgtcagagtaggcaaatgagcaggaggagaaggccctgagaaaagaagatctgggaaatctcacacccagagaccacccaaaataacatgggataggaactaggcggggttgccgaggagagggggaagctgaggacttaaggcagaagcaggaaactaaactaaacaaagaggcaggaacctaaagagtccaacataataaaagccacaaaacggaactgtcagagctgctggctcattctctttcaagcagccccaactgcctctttaaataaactctgctaccacttaattcttgctgctactgctgtgtctcccagctgggtcaacccactcttctcttgaagtatatttacttcaataaactccctgctctttattttccttcaataaattatctgctgtttgttaaattgtcctttggcccaattctttgtaccaagaacgacaagaaccagggactcaactcttcccagcaagaaaatcttctggcaaaacccaaacaccactctattcaacaataactatgtagattgttcctagaaattacattcctttactctaactttcacaaaataaataaataaaaattttaaataaaaactctgtttaaaactctgaagtcatagctagtaacctccaggttcctggcattttatttttcaacttttattttaggtttagtgtgtacatgtgcaggtttgttacatgggtaaattttgtgctgctaggatttggtgtagaattaatttcattacccaggtagtgagcatagtacccaataggtagtttttcaacccttgccctcctcccacctgtctccctcaagtaggccccagtaccttttattctcatcattgtgtccatgtgtactcagtgtttggctcccacttataagtgagaatgtgcagtatttggttgtctgtttctgtgttaattcacttaggacactggtcaccagcttcattcatgttcctgcaaagggcatgattacattttttttcatggctgcatagtattctatgatatatatgtaccatatttttaaaatccagctcactgttgacagacatctatgttcattccatgtctttgttattgtgaatagtgctataatgaatttaggagcatgtgtgtctttctggttgataatgatccgtcaatgttatttcatctactgtagccaatgtaccactctggtgctgaatgatggtggtcagggaggctatacatgctgatggggagaaagtatatagaaactctctgttccactcaactttgctgtgaacataaaactctctaaaaattagagtttatataaaaattgaaaaaagagagtcttacttttttatacaacagtatattatcaatggacattctatttttattatagggatatcataagagtcaattttcagtatggcacacatggtttctctagtggaataatttgagggatcatcttgactataatttcttccattttaaaattatcataattatttactgtatgtcatatgatatatataatattatttgtaattcatctaataactaagtcttgcaatctttatccttaacttcatagatattgagagcgaagctaaagaaaggatatataagttttgcaaggtcacagtagtagtaaaaagcagaaatgaaattaagacagggaccaactaattctggagccatgttattctaacccagttcagggatctcctccagaatcacttcttagatcttttgccttggaaaccatttcactaagagacacaaatccttaaaaaaaaggtaccagaatgtccatgcaaaaaataattttgttaaaagttatttaaagcactttgcaaagcaataggggttgtattattggtgctcatgtcctctatattttactaatctcattatcatcattatgtagcatgcattcatgaacgcattgaacagttttcagaaaaatagcgcttactgactgccaagtacattgagtaaaataaatcattctcacatgcagaatgtattttatgtacattttaggatagcagataaatgggaattataaaataatcctgatagaatgaacatgaacttttggaggccaagacgtgaggataatgagatcaagagatcgagaccatcctggccaacatggtgaaactccatctctactaaaaatacaaaaattagctgggtggagtggcgcgtacctgtactcccagctactcaggaggctgaggcaggagaatcgcttgaactcgggaggcagaggttgcagtgagccgagatcgtgccactgcactccagcctggcaacagagcgagactccatcccaaaaacaaaacaaaacaagtagaactcttactagaaaatgatccaaaaatatattagaagagagtataaaagtttgtattttttgatccagtcatatcacgtttgagaactttataatatctagaaatggctgcagtcatttataaacatatgttagcattttttgtttaacctttttttttgcatacttctagtttccaacatccttgatgactgaaatatgccaagtcatacttcagacaaataatcatgaatagtccacttcagtttctttaaaaagattgttcattttttttgtttgtttgagatggaatctctccctgtcacccaggctggagtgcaacggtgcgatctcagctcactgcaacctctgcctcccagtttcaagcgattctcctgcctcagcctcctgagtagctgagattacaggtgcacaccaccatgcctagctaattttttgtatatttagtagagacggggtttcaccatattggccaggctggtctcaaactcctgacctcatgatctgcccgcctcagcctcccaaagtgctgggataacaggcctgggccaccgcacccggccaagtttgttcattttttatggtcgtcatgatggagatagggatcctctgtggttaatgaaaaccactcattaaattcaatatagatgttgcaattaagtatctgcagagtacttagtgccaatgaatataaattatttcagaattcatccagaaattgaaaatatattatttctgacctgagctataatagtactaacatggtattaggttgttattaatcacaaatctcttcttttcatgtacaattctatatactattttagtgtcaactacattaattcaccctgactttaccttttccttaaagcctttctgaaggaagtcataatacatgagaatttaaatttatattttataatacataacttgattaggagaatataatgaaactgacagatcacagaaacagggatttataacaagatatcaaaacagccagttattttttagggccgcttcttcctttaacaaccaaattctgaattctaacatttcacctcggatccctgattcaatattttcctcaaataccttctgactaccatcagctcattaaattttacaagaattattttattaactaatttgcataaggacacagaagtacatattaaccaagtttctcaccatcataattgtttgaaggaaataattcactgaggttttagtgtttttattgctgttctctacttaattgatggttgcttccctgacatttgctcattcttaaattgggggcagattttgttatagttctcacacttatttggatggtagctaataagttcttctttgctgaaggaagtgccattcaacttttaagtaacttaagatatattcatgcttccataatgaaatatttccaattctgttcatactgcttctccagacatgcctttgatttctttgttgcttttttctcttcatatgaacataatctattttgccagttctgaattatgtcagccactaattgggagattttgtgattgagcagagaagtgatgtatttatgaaaatggttcactgggtaattctgcagttacataaagacccaagcctcagaaaagcattatagcccagttggcaccttgatttcaccctgtggaacctgagaagaggatctatctatgtcatgttagactttgattttcagaactctaagataagtgggtgttgtttaaaggaatttagtttgtgctcaattggtatgaaagcaaaagggcatttttagcagtttgaggaaaaatagagttaaaaggtgaaaatataaaatataaactgtatttctcagcctacgttcagtcaagctcaaaatacttttgtaagtgattatacaagccatttagtccatccccaaaggactgaaggtcttgagaatttaaccattacaatgcagtcttttttacatttttaactgacgagaaatgggtgacctttaaagatgcttttaagattaggaaataaaacgatgtcagaagtagccaaatcaggattgtaaggtgaatgcctaaagattttccatcaaaactctcaccaaattgcccttgtttgatgagacatataagcaggagccttgttgtggtgaaaagtactttctggtgaaactttctcaggcattttttctgctaacgctttggctgattttctcaaaacgctcttgtaataaacgatgcttttttttttggatggagtcttgctctgttgtctaggttggagtgcagtggcacgatctgggctcactacaacctctgcctcctgggttcaagcaattctcctgcctcagcctcctgagtagctgggattacaggtgcccgccaccacgcccagctaatttttgtatttttagtagagatgtggtttcactgtgttggccaggctggtcttgaactcctgacctcttgatccgccagcctcggcctcccaaagtgctgggattgcaactgtgagccaccgcgcctggccaataagcaatgttattattcttcagctctccataaagttaacaaacaaaatggcttgaacatcccaaaacactcttgtcatgacctttgctctttttaattaatttatttgtctttcttaaatacagtactttgagttcctgtgtagacttttgctcttgactagtctgctttgctttgactggcccacttacacctcttggtagcaattgctttcattgtgctttgtcttcaggatcataatggtaaagccatatttcatctcctgttttaattcttcaaagaaatatttcaggataatgattccactcatttaaaatttaaattgaaagctctgttcttgcctgcagctgatctgggtgcaacagttttggcaccaattgagtagaaagtttacttaactttttcagtcagaattgcataagctgaaccagctgaggtgcctgtggtgttggctatcgttctgctgttaatctttgatcttcttcaattagagcatgaagattaattttttcctcacaaatcgatgtggacggtctgccacttcgatcttcatcttgaccatcatctcattccttctttaaacaagttatccatttgtaaactgctattcctttgagacattgtcccaataaagtttttgtaaggcatcaacgattttaccattctttcacccaagcttcactatagatttgatgtttgttgttacttcaactttagtagaattcatgttgcactgatagggttattttttcaagctgatgccttatccttcttactgcctcaaactatatcttgattagacatgttataagaagttagtaagactatttttgttcaaaacattttgaaaatcatgcattttttcataatatgcattttccatgaaatttttgaagactcctcatataattattttgcatgctgtcccatttacaaatacaacttaaaatttattgacagcaagaattattactttattaattgtgtatttgtgcaaagatagtgatcaatgaaaaattctaataactggccaactgtatttaaccaataattacctctattatatacaacattttattcacagacaccatgatcattgatatcatagaatcaaaagtgttattttgggtttagcagtgattcttaaaagaagggaaagaaaaaaagaatagatagactactccagcaaatgctgtgattgctctgccctttcgtctttatcctctgggatgttttttacttgtgctttgctcccatcatctggggaggcatagtgggctatgtgtaaccttcctcagcgaactacccttgggctacaggattgttcaaaaccagaagaacctgggagtttatgtctcctgggacaggcccacatccaatacctgtgtggtgtgagaatttcaaatcccagctccctatcctcaaactagaaaaacactttggtgttatttaaggtccagagaatcatataggatcaaactgagcctgggtctttaacttaaatttcactcttatttggagggtttaagtctgtttctctgctatgtttgaatgtgtccccaccaaaatacagggattaccaatatgatggtattaaaagatgaggcccttaaatgcccttaatcccagcactttgggaggccgaggcgggtggatcacttgaggtcaggagtttgagaccaacctggccaacatggtgaaaccccgtctctactaaaaaatacaaaaaaattagccggggatgatggcgagtgcctgtaatcccacctactcagaagcctgagacaggagaattgcttgaacctgggaaatggaggttacagtgagctgagattgtgccactgcactccaacctaaatgacagagcaagattctgcctcaaaaaaaaaaaaaaaaaaaaaaaaaagatggggtctttgagaggtgattaggccatgaggtttcctctctcctgaatgggattaggtgtccttataaaaaggtttaatgaagaacattcatcccttttttgcccttttaccttttgccatgtgaggacacagcattcctaccttctgaaggaggcagtgttcaaggcaccatcttagaaacagagagcagccttcaccagatgccttgatcttgaattccccagcctcgagaacattgagaaataaatttctcttcttcataaattactcagtcttaggtattttgttttagcaacacagaaaagactaaggcgttttcctacccccttactgtttttttcctaggagtgtttccttaatatatcacatatctatgactcttcatttaagagttcgtttgtagacaatttcactgaagaaaaatagaaaacgaacaaacaaaaagagaattattggttcaatcatttataaaaagataaaagataatgaaaataaaattttattcagagaatcaggtgggaataaatacactaatttttgttacaaacctactttattgaagatgaccatatttgatatcagatgttcccataaagagtaattgacatagaaaatcgacatgaccacattcttctatggaacacagaacacagaaattctttaagttatgtaacatagctatataggaaattcaaacactggaatcattagtattacaatatattaaaacagaaaaggtatttgtggttaataatattaatattctaagctttaataaaaatattttctggaaaatatatgatacgtttttcaaaaaacaatggtaataatatttatggattcctacaccaatttaagcagacagaaatattgaatggtatgggcttcactctaaaaatagtagtacagtgacagtgaaatgaaaagtcactctgacactatggatttcaattccgttctggaatttaaataccaaccttcagacattgattatttataatggttctactgggcataaatcaggatggacatttctggtaacaagaggaatgatttgatgcagatgttgatgaaagtgatggcaatggacttttactattcttgccaggtcctgtgctaaacacctaatatgcattactttatttccataaattctctcaacagtcttagagattgtgtatgactacctttctcagactctgactctaataaaggtcctgaaaaagtcagtcacacaattagaaaagtaaaaaagtaaagaaaaagagtcacacaattagaaaatagaggggtaaggtacaagttcaccctacttataacaaaactatagtcttagccactgcaatgggaatggttagttgccagatatgtcttgctctatatatatgctcaaatttaggaagtctgcataaagccatctacacaacagtgaatttaagcacttgtaccccttttcatcaaattctcaattatgccattaagcaaaatatattttaataatttctggctgttctgcaatgtaaaattttatgtttattttagaaaatagtttaaataaaagttctatttgtgaaaactataaatattctcttaggttctcaggagaaaatatatttgatttcaaatgctccttggaattaacattaactgacctgtacaaaattgtcttcaccaaatatttatatggagcacatgatgaattcttaaaagagatgggaattagcagggagaaaaggcatacaaatttattaacatgcacaagtgcacaggagccacacaaaatatgaaactcaaagaaggtccagatggttgaagcttaaatgccctcctcacagaagagagggaagtgggaggaaaagtaaataagttttaggggacatgagtaggcataagagcagatagtagcctgggacaaagtttccttaggccctgggtaaggagaagaaggtggcctgcagaactgcactgtgaaagaaggttgttatattatgcagataaagtatctcaggtcactgcccttagaagaagagttgaaagaatggctgaaaagtctgtcctgtgtggtgtcctggatatggagacttttagttttctcttctgggatgcatgttaatcttctctggtttatgtagactacagggaggaggcccaagacaattgcattccctctggataaacttccctcagccagataagggaacttcagagacagcccctgcacttcagaagggaagggtaggagatggtcaaagggagaatttagttctgaggcttattttagaggccttgcaatctcctttgttcaaagcactcagtatgccaaagcagcattatttcgtagtattgttttctgagccccaacaatttcttagctcccccttaaatctgtagtttatattttcaacttgtggaagaattggaagactagtacaataaacacacaaacatcttgcactagctcaccaattaacattgagccacatatgtgcttttttctcttttcattgctgttatttacaatttattttcttaaagcatatgcatgtatgcacatgcgcacacatatacacatgcacacacatatacacatacacacacattcacacataaatatttggcagatgtcttctaagaacaaaaacattctaccatataataacaattccatcatcacaaacaagaaatttaatcatgatacaacaacattctctagtttatagatcatatccaagagttccaatgatgtcagggtccaaattgggatcactcatttcatttagtctcctttaacccaagacagtcttcaaactttgtttaatagttcatgtcatggatatttttgaagaatcaaagtcaatctctttattgctctcattgtcctctgaatgtaaaccaaaaataaaattctaagcccccagccaactagatagaccctttctcttggtcaaggtcattctaaagtaaacctgaaacactagctcaggccatgataagaatgaatggtaggacacgccttattataatctctttcctttggaattcacgcacagctaaccagcatgaacattaaaacagagaccttaagactaaccaaacagattctttgtagcaataagaaaccaacatgacagataacagatcctgaaagaagcatttcaggagtattttacaccccaaatgtattgttttgacatattttgaaatggccctgtaaagctaaacatttacaatctattttctctgaagcctgctcctggaagctccatctacatactaagattcttggtgtccacagccccttatcttaacccagacactcccttctattgattccaaggctttagataaactcttaaccaattgccaatcaggaaatctttgcattaatctatgacctggaagccccctgcttccagttgtcccacctttctagactgaaccaatgtacatctcatgtatatattaattgatgtctatgtctccctaaaatgcaaggtgtagctcaaccaccttgggcatatgttctcaggatctcctggggctgtgtcacaggccatggtcactcacatttagctcaaaataaatctcttcaaatattttacagaggttgactcttttcatcaacacatgattggataaagcttaaccttttctggcaagagagcttcatgtatgctttcaattagttttcattatatcccatcaggaagctcagcaggtcagtgcaccaagttattagtgacgttgagtttgatcatttggctacaatggtatccacaggatattttatgttaaaactaccttttcccctttgtaattgacaggcacctcaaagtaactctgaaactgtgtgagcatctttctttatcagcttttccccaaatgatcctgcagataaagtgtacactgtgtttgggttgtgtaaagccttctggaaagactcttctgagattctattccagtggttccaagatcccaaaactgaaagacacagtgacggacaacatcagaaattattgtcaatattagcctcatgtggtggcacatacctgtagtcccagctactcaggaggctaaagcaggagaatcatttgagcctaggggttcaagactgcagcaagccacgattgtgctactgcactccagccagagcaacagagagaaagagaccccgtctctaaaaacaaagaaacaaacaaacaaataaatatcacttttttttttgtaacaaacttcaatccatgtatacagtcctctgatactacaggaaatcaactcctgtacattcctcctagtgattgtttaagaacagcagtcttttagaaccacaagaagctaaggattatggtgataattgatctacttctatgcaaataaagtacttctatgtaaacactttttctatggtgcatcctttttgtatttaaatatacaaatatatatatatatatatatatatatatatatatatatatatatatacacacatacacacacagatatactccaaatatatcacgttaatttttggctagttcacattttataggatatgagttagttcattcagccaaatcatttgactaacttctgctaagaatttatcgacaagagtctgtttatttctagtacaaatcagcatacaataaatgtcataggcttataactgggatgttagttttgttattataattcaaaaatgtatttttataatgctgtaattgcccgataattcttcctttctgctgcacagggaaaatcagttcactgagatagtggtattacagcaaaaaaagagcttaattgatatgaggccagccctgtggaagaactggacttatcactcaaatcagtctccccaaaggttcggaggttaggatttttcaaggatggtttggtgggcaggaggctagggaatggatgttgacgactggttgtggatgcaatcatagtggtgtgaaaaatggtcctcatgctcccagtcagcctctcagtggttgggggaggggcacaagactgagtaaagagttgagtgtcctggtggagttatccggtaatcagaaacgcaaaagtctgaaaatacgtctcaaaaggccaatcttaggtttggtaatagtgatgttatctacaggagtaattagggaagttaaaaatcttgtgacctctggaacaatggccagttattgtataacaatgcctacatcttagcagaattcaggccccttgtataaccctaaccttatggtcttttattacttttataaaagtggtttagttttgggaagaactattatcatccttgctttaaggttaaactataaacttaattcctcccaaagttagcttggcttacacccaggaatcaccaaggacagctgggatgttggaagcaaaatggagtcaactaggtcaaattcctcttcctgtcataattttgaaaaggcagtttcaatgcctacattttcacacaatgaaagctctcaatcttctattaaactaaaaatgctaggattaatgaacactgcctataaaactcccatgccttagtgcatttttttcttacatacataatgtaagaaaaattaaagtgtgatcatccaaatacatttcagaacacattagcaatacatgtttatgaatgaaactcataagctatataaatcagtaagtcattttacattgctactatgaaattctgatttatttgtttcatttttagctataaaatgtatcaattttaatatatcatcccaatgtttatgttaatcttaaccaacacttgtatattaagtaactaatattttatttcaatgaaagcatcaaagaatgtaaaaataacctgtggaggacacattgagaccatgtgaacatccctttccttatcaaactttcatccagtggcaatcattattttctgatgttgcaacatgcaagaatatctcagtctcttgtgagggcatcatgattcattttactaatatattattagactattaaaagatgtgttacgtgtaatgaatcaaatctgactcaagtttctggataatgatgtaactcttcatttacttctacttttatatactcacgaggctgttttggacttatctctatttcttgctgcgaaaaaaaaacatgcttctgaatgctacaaattaattatgggatatgcctgaagctgcagtggcacccattagatttacattaaggcagcaggcattaaaagaatcactaaatattaggttgaacagtacaaaatggtaaactacaaaaatggcagtttcatttaaggctgactgattcatttgtgttcccgagtttaatgcacatatacacagacacagatgcaccccccacatacacactcaccacatccttctctccaggcccaagcatacaatactatctcaactctgttttctaattatctccacagctagactgtaggaaagaagtcagtgtcttctataaaaggacaaagcaaacaaaaatacctaaataaaaaataaaaagtaaatcaatccacaatttccaggtacacaataaagtataatcaatcaaatacaaatgatagttttaagaaccataattttgaaattgaatgatacaatgaccatgtataacatattacagaaagtgtgtaaggaactctttttcatcatctaacttattggagaaataataacactcaaatctcaaatctctcagctgttagtgaagttaagagacttttatccttgtcttcccaaattattttagggatgaaattttgaagttctatcttaaatttctgtgataaatggctttataattggagtattttattcattctcaatggcttatgaaatactatgatgacctgtcaaaaatacaccatgtactctaagattgtagtggtatgatatatctttcgatcttagtgaaagttttgttcttatgtgtattaccagaaaacgggttttgtgttcaaaaagcagttctattgaaaatcgctttaattcatagaaatagggacagagcaagagaaaagagcagggctttatggtgtggcttttaggagcaggtctctctagttttactacagttgcctgtctaaacttttttcctcaaggctgctgaaccaaagattacatgttggcaaaactaaaagatactagaaagggttaaagaaagagttcactgctttcaatgtgtagggccgaataaaatgaaaaataggagaagaaaagaagttgagtcaacctttgaaattgctattcattgtgaaaccaactaccaccaccatcaccatccaaagcaagtgcttattactattattttaaagtgaagactaacaattagtgaaatgattttgaatgactatacttgcttcaggcaaagttactgcagaaaacaaacttccctcagcaagctttctaaagcagcttgtactacttacatgtatccaaatatatctcaatttaatgactggtaacaacattatttgcatgcaacttaacctacacaaagagttaattattatgtttatttaaatatttaatgtttactatagctagtttttttttttttagttagctaaatttatgggacaagtgaattttaattctggtagtgtaattagtatatttataacagtacagtttgtccataatattgcagcattcaagaatgtctctaccacatttgaagacatcaatagttgttttgccagttgtgatagacttccagagtttttattcatttattcttttttttttttttttttgagacagagttttgcttttgttgcccaggttggaatgcaatggcgcaatctctgctcaccgcaacctctgcttcctgggttcaagcgattctcctgcctcagcctcctgagtagctaggattacaggcatgtgccaccatgcccggctaattttgtatttttagtagaggcagggtttctccatgttggtcaggctggtctcgaactcccaacctcgagtttaatggctcacagagattcatacgtttctctataataatgtagcttttactcctctgtattttactatctccgagtgaaaaagaaaagaagtagagtgtagttattctaatgggcattgcaataacacagactgctatctgtagccctgaaagacatcgttatttatgaacataaacacttctaaactaagtgttaaactgatttagtgccctaatggttttaacttcatctgaatgtgcctggtccatgcaaatgtatatcttctaatggtttcatcacagcagaataaattctgagaattattttttatagcacgagtctacaaatattcaccaaggttagaaatatatgttcacttatcagaagcttgaatttgtgtaagttattttcacaataatcatctcatctgttagataataatctgataaaataaacaaaggctgcaatttctataaacatttgagaaatctgaaaatctcttttagggcctacctttactattttaaaacattatcttggataaatatctgtcaatacatattttcttttcaggagagtgtacttacagaaaaattctataatcttttgttaacacaatttaaaatactgtttccaggaatgaattatgccaaaagtgaaaaattgccattccctaaatatacttaaatttgggcaaaattgcatgtatgtatgtgtacatatgtgtgcatatactctagatttatatactcttttgtcctaatggatggatagaaacacacacagatacacacacccgcacacacacacacacagacacatagaaagagaaaaagagagaggtgattacataaatatacaagggtaggacataaattgtaagcatttgtaaaggtacacagattacttcaaaagagtaaacagtactgcattaggccccaaagagaacttctatatatgttagattgctctggtagtgcaatcagctttataatgactaatgaagttaagtcaaaaaattatctgtaaaccataggaaccattaacagttctgctatttgcatccttacatctttaatggttaattccaaagaattctcagtggaggcaatagtcattaaatatattatctgaatcattatctgcaacctgctgataaccaaaagctaaaaatcccacagtgatgacatgaacccatataaacacagcaatctcattttcattaagccattccttagaaatgtgtaatgtacttattttagaagagagccaagaactagctaaaacataaacgaagtaatttttatgggttatttttattttatctcttaaataatttcagcatgttttttagtgggcattttttcaaaaagaagaagaggtagttatgcattgaagtacctataattaatctatttgaatgcaaggttttttaaataaatatattgtaatacagactaaagttagagctgaccgtacaagttattaaaggaggctatcaacattgtgtcataatggaattctctttgatagaatcgttattaaaaatgtatttttctcaatcatctggccaaatctctgaactctcaccatgaaatgttctttttgattagagcaatgacaaagcagaatttttttgttgactataaatcactagcttggaagctaaataccgatgcctgagccagggaaatgttatccactgggccacaataaaatcaccacaggaacttgggaagcaacaagttggtcaggcatcactttcctagggaatatggttgcagaaggtgaggtcagctgcaaactcctagtaatagaagagtgacttagaagagaagacaaaaagaaaattaatcagaaactgtgttataccaagtacagccaaaaacatctttagcttatttaatatttcaaagttacatgatctctttcaagacattatcgtgtgtgtaaggccagtgataggaaaagagacaaactgtattggtattgcattgttcctttataataagaggtcaataaatttttttttttttgagacagagtttcactcttgttgcccaggctggagtgcagtggcgtgatctcagctcactgcaacctccgactcccgggttcaagcgattctcctgcctccgcctcccaagtagctgggattacaggtacctgccaccacacccagctaattttttgtatttttagtagagatggggtttcaccatgttgggcaggctggtcttgaactcctgaccttaggtgatcctcctgcctcagcctcccaaagtgctgggattacaggtgtgagccactgcgcccggccagaggtcaataaaatttatcaaaaacatctctgctcaatattaatagcagacattcaatggtagaattaccaaccagtttccatcatctgtgaaaatgattaccgatttctggcctgaagacacccgaaaagcagcaaatatgtaagaagcagttgaggctctccatgtccttacgcacagcagtcagataaataacttgccaaaaacctgtttttaaacatgatcttatggctattagtgccttctttaatagtaaatacactgaattttttaaacattttgtttttatctgacacattataattgtatatatgtatggggtacagtgtgatatttcgatagatatatacattgtgcaacgtatcagggtaactagcatatccgtcacctcaaacacttgtcatttctttgtggtgagaacattcaaaatcctctcctctaattatattaaattaagtgttgctgagtttacagtaacttttggtcatacgttttctcacaacagagagtaaaataaagtactctcagccgggcggggtggctcatgcctgtaatcccagcacttggggaggccaaggtgggtggatcacgaggtcaggagtaggagacctgtctgaccaacatggtgaaaccccgtctctacttaaaatacaaaaacaaaaacaaacaaacaaaaaatacaaaaacggtggcacgtgcctataatttcagctactcgggaggctgaggcaggagaatcgcttgaacctgggaggtggaggtcgcagtgagcggagatcgcgccattgcactccagcctgggggacaaaagagagacttcgcctcaaaaaaaaaaaaattctctcatgtagttggtttaatgaatggtttgaggttaaaagtgtctgcagaacttgtaaaacatgaaaccgctgctcttcatattgaatatatagtcttaaacagagcacaccaggctctcataagtttatacaaactgggatgaaaataagaatggaagaaaggaaggcatcgctacaagtattaaaatagaatttggaactaccttttgaatttagtagcagaaaaatgaattcaacttcctccgttgatgcttctttccatagaatttacttaagtaagaagagacagaatggccaatcaaagacttcatatccttcctaaacctgtgaagcctttaggaaagcagtttcttggcacgccaatcaaaatctactaagtataattgtgaaacgccctcctgagtaaaatatcttcatttctagatcttatttgtaagtgaactctactgcataggtcatatgttacttatctattacagtaaatattatttgaatacttaatgacaggtgatctaaaatggtatttaaaactggtttcgtcgagagattaatgcaagtcaataataattttatttcaaaagtaacaagaagaataagtcctctaagattatttgaaatggcattcatctttaaataaaatccaaagatcaaaataatgaattttaaatagtctgctaaaattctgaaacacttttatcaaagcactttttaaatctggtttctattcggttggaatagtgaaaatgttcatgctgtaggtaaaggttaaaaaattaaatgctgaaattaaataaaattaaggatattaaaataagatcgttcagtatatttaataaaataattaaataaggaatggaagaagtatagctagttttaccttagatggaaatttataaacagagcaaaatatttccattagtagtgccatattctacctttatttttaacccgaaggaagtcaatgaattatgatttcttataacacatctagtaagcataaaaagtaaggctgaatttttcttatgtgaaatgccccatactatagaaaaccatagttatagagaactaataactaaaatatttaaacccatgctatgattaagaagagatacattagacccttggtgtgctagtaacattctatttcttgaccagagttgtggatccaagagcatttactttacattggtttgttaaaatattcaaataagttttatatcattttctttattttgcttccaaaaaaacttttaaaagcaataaactgtaataacaaaaaaactgacttgtaaaccaaaatgccttcaagatcatattcctgtgatacttgaaaattaaaactgatatggcttccactaaatataaatttagaaataattgaaaatttcttttaatcaagtaaatgttttctgaaatactcctgagatttcccactgcctaccttttagcaaccatcatgctaaaattcaagatgtctccttgatcatgggcagcagatctgagctaaaaatggtgtccacaagatgaaaacatcctaaagaacagctgttcttaatcagtgaagggcgctttgagtatctcaaaagttgtttttcactatccggtagggtcccttagaggtatatgactcactttacatactgattataagtatatttttaatccaaacatcccagaaaatcatacagagagtggatattaatttacctacattacacttattaagctgttgcgagcattagtgcattcacactccaagtgatttgactctgggggtgattcattctctgctagtgttctcaatatgatgcaggtttctacctccttcaaaaaaagcaggaagaagcacgtgtaaaatacttttaaaatactaaattctgacctattatacccaggtacaaccttcacaaatacctaagtatatactgaatacatctaggatcaacttccattgatttcttgtttctagtttagttttataaagctttttttttaaatagtaagatttcgctttacaaaagtggcaattcctgatcatattaatgagacaagcataacaagctttattatgcatcaaaagtgtttataatgttatacaaggctaacaaaatgcttctgtagtatagataaacacagtatgattataagttttaatatcagatctgcacattctaaaatacattttcatcagaaaatgttcagcacatttatgataaacaccaagtattgatttagctttaaaattataatgggatggttaaaacctactaatgagtaaagtataatttatactttgtttattctttaaactatgtctaaactcacatatcgttatctgtgtatacacggttcctttttattgttacctgcttcaaagtaagaatgtgtagatgattcagtattttaaaaccagcaacttcctaaagtaaacaatagatgcctactttctttttacaaaaaggccaaaaattcagctaaaccatatcttacccttgattagaaagactgctaattattataggttttaaggggacaacttaatcaggcactacctagtagtttgtgtaccaagcaattcatagaatagacacttcagtggcagcttttctgttaatgacattgaggcttttgaacaccaaccaattacaaatgtgcaggaccactgctcctgatgtcataaccataataactatgttctttatacatacaattatgtttcttagaaaaaaagagtgatattaaaaaaattaacttccaataccaatgaatcctacaacgtataaggaactacagataaatagtacaggctcctgaaggacctctgccatgccagggcatagccctttagtcactaggtcctgaatgcatccaaaatccagaaggagtgtttgatgcagctcaggcactggatgtgggcactgatgacagtggctgcttatcaacctgcatagaagtacaaagattttaatttatttttagaagctttttctaaaactttcaagatttcatccactggttaggacataccatggtgtgccctctgatcactagcactgattttagttcaagcttgtctaccagacattcctgcattattattactgtacatttctaatttgcctatcatttagaacatgagtggtttagcctccattaaaacaccaatgttttagtatacatgtaatgaatattataccacatagcataaaatgacttgaaaataattttattcaattttcttaataaactgactatttaatggcaataaaattatggttgctaaaattgtttcccatgtgttataggttagcaataccaaaaacactacacatgtaaactaaatttaataattaaataagtggatggcggatgataaatacaggtttctcagtgttggaatgggaggttacagacaggcaagggacaaaggctagaattagccatgtgatactggattagaattggagatattagaaagaacttatgtttagcttaaaatagttataggttgattcatacattaatatttataggtatattcatatgtaggcattggtataggcacatatattttcttgctctgtcagctgaaaaggtctaaaagcattgacaccaccaagcaatgaacacacctacaactcattctccaataaataattacattctccaataagaggaactagagtttcttagagaaatggctggctgatcttgaactggaacaaaaaatatgccttatgaacaggaagtatcttatagtgatacaaagtaaagaagcacagtattcaaaaatagcaacaaagggaagggcattagaaagaaacacaggagccagtataaagagtttccagccgggcgcggtggctcatgcctgtaattccagcactttgggaggccgaggagggcggatcacgaggtcagaagatcgagaccatcctggctaacacggtgagacccccccgtctctactaaaaatacaaaaaattagccaggcatgttggcaggctcctgtagtcccagctactcgggaggctgaggcaggagaatggcatgaacctgggaggcagagcttgcagtgagccaagatagcaccactgcactccagcctgggccacagagcaagactccgtctcagaaaaaaaaaaaaaaaaaaaaaacaacacaaagagtttccaatgaccaaatctgggacaatttgaaggatgaaatgaagtagtgtaaaattatacctaattatgtaaaataaatgttagagttcatagtgatttatgtttttgaataaatgaaaaataaacaggataatagacaaatctccactgaacaacagttttgaataatatatgtagagagtatcctgaatgtagagacagtgtttgatgtacacctctgcctgcgcactgagaatagccagttggccctgtgctgcaataagcatgtggctgagtttctcatgcatgagataagtttcttccgtggactaaacaatttagacaactgatgaaggaaatgcagattcaccatgaagtctcacaaaattagttcaaaataatgctttctgtgatattgttataaaaatgaataccaaacagatttatgcaatgaaaatcctcagcaagtggaagacgctttaaaaagcagagaatgggcgggggtcgtggctcacacctgtaatcccagcactttgggaggccgaggcaggtggatcacctgaggtcaggagttcgagaccagcctggccaacatggtgaaaccccatctttactaaaaatacaaaaattagccaggtgtggtggtgcacacctgtaatcccagctactcgggaggctgaggcaggagaatcacttggacctgggaggcagaggttgcagtgagctgagatcttgccactgcactccagcctgggcaacagagcgagactccatctcaaacaaacaaacaaacacagagaacgctcatttccaaggagaacttgatgtgttggtaaattgtgatcaacagtagatcacttcatgcttttcatctcaaaaaggatttttcaagatgcttgaaatgttcatgctttcaaaatgaaaatcatttgtacttagtaatgcattactatgtgaatgatgatttactggccctggttagtaaatctgaaggcaatcttctgaattatttggcaagattctacattgaggaagtggtgttagccatcaactttactatgtgcacagaaacgttaaacctgataatgttattttgagtataaaagttcaggccaggcatggtggctcacgcttgtaattccggcactttgggaggccgaggagggcagatcacctgaggtcgggagttcaagaccagcttgaccaacatggagaaaccctgtctctactaaaaatgcaaaattagctgggcatggtagcacatgcctgtaatcccagctattcgggaggctgaggcaggagaattgcttgaacctgggaggtggaggttgcagtgagccaagatcacaccattgcactctagcctgggcaaaaagggcaaaactccatctcaaaaaaaaaaaattagttcatattttcctggctgacccttggttatgactgaagataaatgatgaactgtttggtctcccatggccattaacatacttaactacataacacctgagattctataagcaatggaagatagcatgggaaaatacagcccagaatatgactttttttttttcttggtgttgttggggctcagaaaactatgccccaaaatgaaggcttcagaagcagcctcagaagagaaagtttttttctgaccttctcctgctctactgtctttcactccttttctccacagaggctagctgtagaaatcagaattcctctaccccaaggtggattttagcaatcaaaaccccttttccctacaaccagccataaaacctgaaaatattactctaattttccctccacctttctttgtaaaaactggccataaattatctgacatacattgactgtaggtcgtaagacccgcattccagagagtgctctgccccacacccagaagaaaagaatgcatgctcagagaggagaatctaggcatacaggccttgctgggtttcctcactcagtattagattatgccctttttgtccaaccatatttttacacaactgttcatactttattgaacctaagcataaaaatagatattttcccctctatctttggttcttcactgatatggtttggctctgtgtccccacccaaatctcatcttgtagctcccgtaattcccacgtgttgtgggaggggctcagtgggagatgactgaattatgagggcgtgtctttcctgggctgttctcttgatagtgaatgggtctcatgagatcctatggttttttttttttcttttttttttttgagatggagtctcactttgttgcccaggctggagtgcagtggcatgatctcagctcattgcaacctctgcctcctaggttcaagcaattctcctgcctcagcctcccaagtagctgggattacaggcacatgccaccatgcctggctaatttttgtatttttggtaaagatgggatttcactgtgttggtcaggctggtctcaaactcctgacctcgtgatccgcccaccttgacctcccaaagtgttgggattacaggcatgagccaccatgcatggctgagatcctatggttttaaaaatgggaattgccttgcaaaagctctctctttgcctgccaccatccatgtaagatgtgacttgctccttcttgccttccaccgtgattgtgaggcctttccagccatgtgggtccgtaagtccattaaacctctttcttttgtaaattgtccactctcaggtatgtctttatcagcagcatgaaaacagactaatacattcactctgaaggctcccgggtatatacgttaaatatatctgtatgccttttctcctattaatctgtcttttttgagttaattttttagcaaaacttcagaaggtgaagaggagctttcccattggcccaaagtgtctgtatgtgtaattgctacatggaggaacagttttatacataatcattaatgaaaactgaagtaaagatcatggacctaaaagaacaatttcaattcccttatcacatcatggttgtacctgtagaagccagagagacattattcacagactcatcttcagaagagagtgtaatctagggcaaaatgaaattaaggatttcaaaagcatgcattttttgaagatacaaattgagaaaatatacaagagctataatcaacttgtgttttggatgttagcaattcttctaacacaccccaactttgatatgtatgatgtgtaaagaaatactgaaattctgccttctttttcttttacagtatttttcaattacatttatcattcattggttttacatgcacaataaaaaagtgtttttttccaattaaggctctctaaagaacatgatgcagtccaataagtacattaatcacaaatgaggatgtgcagcagaattgcagaatttagagaacagcttttgaattgaagattatgtaagaataataagaaccctagcaagataaaccagaactaagtaggaaatgacaagaatgcacacagacctaatagccctttccttgtccatcttgtatcatagagaattcaaaccaagataaagaaattttataaattaaatgaagataaaatatagatggataaataaattatagatgaaatagttgattcaatgggttcagggacagcttgaggatacagcaacattttcctaagaacatggagattccacatctagactgaagagaatagaatagcagtaccacactgtgaggtcatgtactcattgagctgtgagaactccagaaggaccaaattttgctaatgatgggtattttttagtactttcacattcagacagctgtaaatcccaggccaaatgattcaaagatgtctatcagtagcaaaagctggcccttcaggagttctcacagctcattgagtgcatggcagaatcctgttcccaaaagcagatttttgaaaagcttagtgacaaagaggaagtgatggaagtgattatgcaggaaactgactttatgaaatgggaaatccccaagtctgagatgtttaggaaagtgctggaagctcaacttgaggatgtcattgctgagacttcaaaggaacatagacttggtgatcacagacagaacgtctctgaacaaacagaatgttagcttcaggtctcacaataaagcaagaaagccagtaaccaggtgccactttagaatatcgcaagatatttctaaaacaaaatagtaatttgaagaggaagtattactttataaatagaaatgtgtcagacatgaggcctctcgtgttttagaagcaaaaaaacatgcataagaggagctgcatgtttcagaatgccattagcagcaagatatattaatgtttaaggagaaattataaaagtctaaagaagaatggcataatgaaacaaaatgtgaggcagaagacatggtaaaagtgtgtgtgtgtgtgtgtgtgtgtgtgtgtgtgtagaataaggtatatgaaaaagcaagagcaataagatgtgaagaaaatgagaaaataactggtgaaaatgaaagatttgttctattgtggataaattaacagctcaaaatagataacatgaaaatgagtttaaggattttgcaactaagagtaggctgcctgctgggaagcttagactgcagaaactactcaggaggtcagtgatgagaaacattcccccgagatagtttcaagttcttaattctaaaatgaccgagctcatgactcccagttctagtttgatatagacagtgctgggttcactctggaaagatcatattcagaagttagatatggcaatagtgttagaattacaatctgctcctgagataggcaactgggcctgacagcaaggttccaaaacctaccgggtgaagaaatgatgacaaaggatttatgtgttggtatgtgattgtatattatttttgagcttgcataaatacagtgctttatataaacttacatccttgaagtagctacaagaaattgtagataaagaattgttgataatgatctttcaaatccatcacagtcatgaaaaacttttttttattgtggtaaaatatatataacataaaatttaccatcttaactattttaaagtgcatgattctatagcattaggtatagtcacattgttgtttaaccatcaccaccactcatcttcaaaatatttttatcttccccagctaaaaccttcatactacttaaacaataactactcattggcctctcctctcaaaccttggaaaccatcattctattgttttatgaatttgactactctaggtacctcctataagtggaaccatacaatatgtatctttttgtgactgctcatttcatttactatagtgtcatcaagattcatctgtgttgtagcatgtataagaattttcttttttttaaggctgaataatatgctattttatgtataaaccacattttgtatatgtattcatctgttggtggacatttggtttgcttctaccttttggatattgtgaataatgatgttatccacatgggtataaaaatatctgcccaagtttattctttcacctcttttgtacatgtatgtacccagaagtggaattgctatatatactaattacgtttaattactttgaggacccatcatactgtttcttatagtggctataccattttactatcctgcaagcaatacacagggttccactttctccacatccttactaacaaggatgggaaggatgtattttatgtatttgtttttagtttttgttgtttttgagagtagcctttttaatgagtgtgaagtgatatttcattatggtttgaatctgtatttctctaatgattagtgttgttaaacaactttcatatgtttataggccacttttatatttttggaaaaatgtttattcaagtcttttgcccatttttatctgtgttgttattgttgttaagttgtaggagtacttttttttcccactttttttattatactttaagttttagagtacatgtgcacaacgtgcaggtttgttacatatgtatacatgtgccatgttggtgtgctgcacccattaactcgtcatttagcattaggtatatctcctaatgctatccctcccccctccccccaccccacgacaggccccggagtgtgatgttccccttcctgtgtccatgtgttctcattgttcaattcccacctgtgagtgagaacatgcggtgtttggttttttgtccttgtgatagtttgctgagaatgatcgtttccagcttcatccatgtccctacaaaggacatgaactcctcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcacgatttataatcctttgggtatatacatagtaatgggatggctgggtcaaatggtatttctagctctagatccctgaggaatctttaatatattctgtatattaaatccttatcaaatatataatttgcaaatgttttctctcatttcataggttgccttttcactctgttaatactttcctttgatgcacaaaaatttctacttttgatggtgcccaacctataaactttttcttttgttgcctgtgcttttgatgtcatatccaggaaacaattgctatatcccatatcatagttttatatatggtataagataatgatgcaacaacttcttcttctccttgtcctcctcctcttctaactcttctgtgggtatccaattttcccaacagtatttgttgaaaaaattgttctttccctattgaattgtcttgacatctcttattgaaaaccatttaatcttgtataataggatttatttggaagctttgtattctattccattggcatatatgtctgttatattgccaataccacattgttttgctttgtgtatctttgtagtaagtttggaaatcatgaagtgtgagacctcaaattttgatcttctttttcaagattgctttgtctacttggagtctgttgagattccatatgtatgttaggatggatttttttctaattttgcaaaaagaaacattattggaattttgaaaggattgcattgcatctgaagatcactttgggtagtacttgcatcttaaaatattaagtctcttaattcataaacacaaaaatatcttttcattcatttgtatcttctttactttctttcagtagttttatagtttttacattacaagtcctttacatcctgggttaagtttattttaaatcattttattctttttgatattgttgtagatggaattattttaattttctttttggattcttgaactgttagtgtatataaatgcaattagttttttagtgtttattgtgtatactgcaactttgctgaatttgtttattaactccaaaagtatttgtgaaatctttaggtctttctatatacatgatcacctcatctgataacagagataattttacttcttcctttccaatttgcatgcctttttaaatttttcttgcttaattgctctgactaggatttctactacaatggtgaatagcagtgaaagcaggcatcctagtcttgttcctgagcttatggggaaagcttccactctttcatcactgggtataattttagtcttggattttttcatatacaatctttgtcatgtagaagaaattttcttctatttctagtttacagtttttatcatgaaagggtattgaattttgccaaacactttttctgcagcaactgagattactgactgaatccctttaatagctgtacttctgttaggattttctatgtatttatgattcaatcctggtgggctgtgtttttcttcgagaatttgtgtattacattttgcttatttaatacattggcaaagaattgttcatagtgctcttataaaattcttttaatttccctttaaaataggtggtagtatagtttgaatatgtgtccctgcccaaatctcatactgaaacgtaattcccaatgctggaggtggggactggtgggaggtgcttagatcatgggggcagtttctcattaatggtttagtaccatgctctttggtgctgtccttgtgatactgagtaagttcttgtgagatctggtcgtttaaaagtgtgtagcacattcccccttgttctcttaatcatactgtggctatgtgtcatgcctgctctccctttgacttctgcaatgattgtaagtttcctgaggcctcttcagaagctgagcatgtgtcagcatcatgcttcctgtacagtcttcagaactgtgagccaattaaatctcttttatttataaattttccagtctctggtatttctttagagcaatgcaggaacaaactaatacagacagtaatgcctcttctttgattgcatacttaagttgtttgcgtaatctctctttttgtcttagtttagctgaagatttgtcattttgtttgatctttttcgagaaccaactctttgttttcttgattttctctgttgtttttctattttctattggatttatttctgctctaatctttaatatttccttccttctgctaacttttggtttaatttattattatttctatttccttaaagtctaaaattaggttgttaccttgagatatttcttcttttttaatataagtgcttccagttttaagttttcctcttagcactggtctcactgaatcccatgagttttgggatttgtgatttcattttcatctgattcaaaatattttctaattctccttttgacttatttgaatcattgttttttatgagctttaaccattggctctttaagagtgtgttgttcaatttccgcatatttgtgaatttttttgtttttcttctgttgctgattctagctttattccatttgaagaagaaaatatactttgtatgacttcaatctttttatatgcattttttttttctttgagacagagtcttgctctgtcgcccaggctggagtgcaacggcacaatctcggctcagtgcaacctctgcctcccaggttcaagcaattctcctgcctcagcctcccaagtagctgggattacaggtgcccgccaccaagccccgctaatttttgtatttttagtagaaatggggtttcgccatgttggccaggctgttcttgaactcctgacctctggtgatctgtctaccttagcctcccaaagtgctgggattacaggtgtgaaccaccacatccggctttaaatgtattaagacttgttttatgccctagcatgtggcctatcctgaagaatgttccatgtgtacttgagaaaatgtatattctgctgttcttgggtggagtgttcgctatatgtttgtttagtctaattgttctgtagtcttgttcaggtcctatattctcttattgatctttctggtttttctattttttgtttaaagtagggtattgaaatctcccactattatggtagagttgtctctttattcaattttgtaaacatttgcttcatatatttaggtactgtaatacttacataagtaatagaaaaaaacatgaaagaaagaatgctttatttttttagtgatcccacagtcttcgactcagacaaaccagatgcaaataaaggctgcaacttaaagcaaacactagtaggtgtagtttgtcctttgtgactttactatcccaaagtctatctccacactgaggacatcattacttgctctatttgggttgctttttctttctacctctattggcaccaaatagagtatataaagagaacttattagacataattttaccatagaattgaggagtgtgcttcttgtatttacataaaggaattgaaaactatgttcatacaaaaacatccatacagatatttatagcagccttattcatagttgctaaaacacagaagcagccaaggtaggttgtggtaggtgaacgataaaccatcgtagatccagacaatagaatattatatagtgctaaaaagaaataagctataaaatcatgaaaagacataaaagaaacttacatgtatattactaagtgaaagaagtcaatctaagaagactacatactgtatgattccagctatatgacattctggacaagataaaactatggagacagttaaaatatcaatggttgccagaggttagtggggaggaagagatatacagagagcagatgattttcagagcagtgaaaatactctgtattatactagaatgatacatacacatcattattcattagtccaaacccatagaatgtacaagaaccaagagggtactgtaatgtaaattatggactttgagtgataatgacatgtcaatctaagctcatcaattgtaacgagtgtactgctcgggtgtgggatattgatagtaggggatgttgatagtgaggaaagctgtacaagtgtgggggcacagaaacacccgtgtcttttggttgattttgctgtgaacctaaaactgccctgaaaaatcaagcccccaaattgcatttgttgaaaaatttttctttcctactacgctgaccttcatcagcaaatggccccttgcttaccctaaatctgggacagagtacacatatggattgtctacaataaatatgaactaatagattaaaaacaataaatgaatttaatttatttcataacaattctgtgataaaaaggaaacttctgagaaatttcttgctgaaagatgtcatttgtctcaatgagatcagaggtgaaatacctaaagacaagaaaagtaagatcaactttggagaggtgagaagaaaaggaggatctgattatattcattgtgagaaactagataagcagttaacaagacaccagtaagaggacctgccactattaagattccaaggaactcatgactttggttccttatttacttaagtgcatggaaaagcctttcattgctcatctataatttacaaagtttctaaattgtttccaatggttctactttatcctaaacctactgagggttgaaacagtttaatggaatttgaggtaattaaaagaaaagtaaggaatttcaggtaagagaaaattttaaggctaaagagaaacactcaacaaaaataaaagaaaacttttgaatacaatcatactcctccaagagaatatttccagttctcctcatcatcctatttgcttcccagacctcaacacattggctcagtgaagtctattcatgcccctcttaaaggcagttgtactcttcatctcagaaggcacttagtccacattagtattcagaaaaaccatttccttcttcacttattttatatttcgtgttatatttttggtaggagattagatcacactggaattagaaaccaaagcatagaaaagattttcatcaaaattgttatttttgtaggaaatttcatacttgatcacagtcaacataaaagttcatttcttcaaaaaattttgacatatgtgagacttgttctaaaactccccttcatgatataatgcattttattttgatatattatttggattttagggggcattatcataaaaacaatgaatactcagtaaactgttttggaaaggtaaaaataaccacaatttacagtctttttctcatgcatacccacatataatggtttttaattgtgtgctatatgtgcacttgcctgaacttctatatattggtaattttcttagtaactgcttgtcaaaactgccaattaatgtttacctaatgttgtattatatacttttactttgtttagccattcaaaaatgtttcccattttaaaattttcaaatgtcctattcagatttaaatctaattaccactttataattggtttagggcaaaataaatgttcatatatattatatttaaaatttttattttaatattgtctactaaaaaataagttatcaaattatttaatcatatttctataaaatacgatttctcagtcagcagatgacaaaaaataatcaatatcagagctgaagtgagtgaatttgagatgtgaaaaaccatacaaaagatcaatcgtctgtacaccaaactcccatgacatgcaaattacctgtataacaaacctgcacatgtacccctgaaattgaaagttaaaaaacgaagtatagtaaataccagaaaaatagaaaaaagcacaatgatatgatttcccttctataagtttaataagaatcagaaatattcatctaattagttaacaattaagaaaagtctccattgggattagttaaaccaatgtgattcttttcaaaatcatggataagtaattgagaaattggttttgagttgaagtctgctgctatttagctatcattggacaactcatttatgccgttaattttattgtatatgtaatgagaaaatttgattaaatctttttttttttttttttttagagacagggccttgttctgttgcccatgctatagtgcagtgacatgatcactgctcactgcagcctcaacatcctgggttcaagcaaacctcctacatcagcctcctgagcagctgggactgcaggtgtgaaccaccatgcctggctaatttttgtattttttttgtgtctcaataaaaaaaaaaaaaaaaaaggaaaagaatgcttataagcagttcatactggtacatttagaaatccttaaaatatatatgactaatttggcagctaactactctttacttttaatatgataattgtatacacatggcaacagaaagtcaattttaaaacctcaaaatttgaacttcggttatacatttcattggtttttcctctatcggtcatgattttaaaagttttattgcttaaacatgcatttaaacaaaagaatacatgtaacttataatttataagtaagctaaaagtcatagtaataaaatgaatacccatgaatcccactattcaagtgaattaaataatattcctagtacttctgcatttttcccttggtgctcttgctcaatcttattctcttatacccctgaacatcaacattctggatttttgtgtaatcatgtcttttctttatttttgtatctttatttaggcatatatttctaattataaatatgcttgaccttgtaccttttgttgttttgtaaaatgttatcataccataccataatatatgtggtcttctgtgactcatttttttaaactgaatattatgttgctatgattcatgacatcactgttactttagctgaggttcattaactttcacagatatataatatctgaatgtacataaatatccttaatatcccttcacttgtcaaaggaagcttgtgtgcttccagattggctattttgaataatgctactatgaaataaaatggaacgttccttgttttgcacatgtaggagagttttcttcagatatacttagaagtggaaatgctggtctgtaggattcacaaacattacacttgcataatactacctggtgtggttgtatccaccaagaatatggcaaatagtcaccaacatttggtattattggggttaacttttgcctaaggcaagtaagtaaaataatatatcactgtagtcttaatcttcttttctaagtttacaaaaaaaattagttatatttttgtttatttatttacatcaatattcctgttgttaaatatctgttcatggttttgccaacttttctacagaattgtttgatctttttgttctgattacttcttatcaattcattattttatatttagcaccttctaatggcaggtttgagaaattcttccctactacttaatccttcaaaagtggatttttgtgtatagtgtgatgcagggatcttgaggttgtaatgatgacagggtaacctccacaggtatctctgcatagggcatcttcctttagtcaggggtgatcctctggagaaggggacaggcataacctgtcaggagccaacatccacaactgaggcatgcatggaaaagccctgtaatggggatctgggtgtgctcaaagagtgtatgcaagaaatagggaacctaatgtcaccttataaataagcctagttgtgaagaataccaaataagttattataaccctcctttaaatagaaaaattagtatgaaaaatggcatgcaacattattattattatttttttagactgagtttcgctctcgttgcccagactggagttcaatggtgcagtcttggctcactgcaacctctgtctcccaggttcaagcgattctcctgcctcagtctcccgagtagctacggttacaggcatgagccaccacgcttggctaattttgtatttttagtagagacggggtttctccatgttggtcaggctggtctcgaactcccgacctcaggtgatcttccggccttggcctcccaaagtgctgggattacaggcgtgagccaccgcacccagtctcaacattcttattcaggtatgggctatcaagtattaaatgactgagctagacactttaaataaaagacgaacatcagtatagactttctaaacaacaacaacaaaaatttcctacatgttattttccaactttttcctgctgttactttgttgcagcctgcttaaagtaactacttgtcaatgctctcactctctcaagtttattacaagaaaaaatgacatatctgtatgtagtggtggctgtcaacttgataatttcccaagctgtgtgcaccctgggtgtcagattttcctaacattgaggctatttacatgagaactaagaagcttctcagaacaagattatacaagaagggtgagaatctagccacatgaattgaattcaagaagaatggcttatattcggaaggggttggagatttggatagaactcaatgcgaataacacatataccacccatccccagtcttctgatccctgtggcagtccaaagtaacaatgaaggggaagtataaatttaaaaaaaaataataacctcacccaaactctaaagatattgagagtataaggctgccatgctctacagccagtataacagggccagtcagagtggggacaaagtatatcagctcccattcagggtaatattaatggcaagggttgcatctgcaagccagagggaatagaagtgaactccaagaccttgaccacggcatggcacaggaagtccatatcacagccagattatggaaggataaaatgacagaacaggagtgtaattagttgccaattcaggctggaagaaaacagcagatgctatggggatagcccaaagaacaggtgtaattggaaggtattttaagtcagttagagattcacattcctcaattactagaggaaaagagaaagtaaacaagctgttttctgtgctttttatgaccctatatttaccctcaagctcttgtaacctaggggtaagaaggcaaaagtattttcataatatctgtgaatcatggtttgaacgtaagtgggagaccgtataaagaggctgtgggtgaatcagatttaaggaaaatcaagtagtaggactagaaaagtacattttaatttaaaaagcaaaacagtactgtcgaaagttgttaagtaggaaaccgttctcgtccaagactttgattctattttctaaaacaaacaactggagcaattttgattcatctgaagcgcacagatgcacagaaatacctctagtttccattcttttaaaacaatatcttagtgggaaaagattgctgcagtttgtaacataaatgataacgatcaatttctcaaaatcctaaaatgagttacaattatatgttaaataatgtccaggatgttaatctgtagcaatagcactgagattggtgaaaaacgggggggccaaacagataaatggatcctgactgtaggatttttttcttgcctactcatcactatggtaaccaacatattttattataacaacttcccatgctgtcgtgttccctgctgacctatttcttcaacacttcactaccagactaattttttgaaaatgtactataaatctttcagttccttgctcaagaacttaaaatggcttcctgctgcctatgaaaaagttatggcaattaaatggctcaacaatttctaaggtcatttattttccattgcccaatttctaatcttcatgaccaccaagccctttgccaagttacttctatctattccactgttaggactgcttaaaaacttttgcctaacctgtttcctccatcttccacatcgtgtccaaactttaaactctgcctttttcagtagaccatctctgataaatcgtgctctttcttctctgtacttctgctacagttttaagaaaatatcatgcacagtagcaactaaatattctgagtgtttgaagtgtattttacttatacactcagttctttaaaggcaagtggagagcaaggacaaggactgtatcttgtacatttatggtgatctacatgaaactcaacaccatacatgctccattagatacacacagaaagtagctgtttttctgggctttcagtgctgacacaccttacatttaatctcagctttcttttgctcttctagtggcattatatctccacgtcacagtttcctcaaaatcaaaatgagcacaagagctatttttatcctagaatacaatgagataatgtatgtctgataaatagtgagtttttaataaattcactattattaacctataaagacagaatttaaagcattgtttttgaaagcttggtccagcagcaggtggggaaacgtgttttctacatttccatcaatggcttactatataaacatatcatgttgctcaaggatgctatgggtacagaatatgacagagatgagaagaatggaagtagttatctgcttatataatctgatgtgagtcaaccttctccactgaaaaattataattcttagaactgactccagcttaacctctaatccaccctattcgtaagattcactatctttggaaactggaaaaaaatttagaaggcacttgccataattcaggccaaatctgtcaaaaactgaaaataggagataaaattagggatagacataaggaatgaaaccagaaaagttaatgaaagaagagaagacaggatttggcattccaaaaatattgcattggtgtagctaagagattagcattaagctaaaggaaatatttattaccttgattacaaaatttaaaaagctccccagaatattgtgacattcaagtcttggattatatcctagaaataaaggacagcttttacagcagtcacataatagtaataaaagaagatattattgctgagctatcgctctgttccaagtctgtgcagtcttttggaattctcaaaacaactctatgatgcagtcactactattactctctattataggagaagaaacaaggcttagagaggtctagtaattttcctaaagtcagagagctggtaaatgtcacaggcaggatttgattctgggccaggcctgctccaaagatcacgcgctaaactgcagttattacacttctcaagtcacatcagaaggttggctcaaatggagatggtgatgccccacgcttcatggattattcaattttctctacttaatctttaggtgactttaaaggctttatttgcatgcaagtttttcaagtaacaacagcaactaatttaacaagaacatttattgagaacttactgggtgccagagactattctaggtactttttctaaatattttttaaacttcgcagtcatcctctgatgtaagcattaatcatcatcatcatcatcatcatcaccaccaccatcaccattactactatcatcatcattatctatgcttaccagataaggaaattgaggcacagtgaggtaactgtcattgccaagtgttaattcacagttagtggtggtaccagcatttaaaccctggcaggctgatcaccagacttgtgctgtaacatacaggggcaaatagtatcctgccagaattctgtctctgttttctgtattaatttttcaattaaattttggcttgttagtttcagtatattattccagcctgtcaaggttttaactttgattctctctcattcatctattataataggtagcctgcacaggtttctaccatctgcaaatttgaggtttgaattgcactttctgttttttttttttgcaacagaattgaattataaacattactaaaaagccaaaatatacatagatatttacacataaggccatggatgatttgtttttcgatataatcatgaattatttttattccgtatttattatctgacaaaattatgtatttaaaatctaacaaattgggttcataatagattccaaaagtattcagggataaagctaccatgatgccttatttctgaaagctaaaaacatgtagtatgtttaaattgttcatacttaaaacattctcattgcattgttgagttatttccagtatttctgtcatttttgtatttgctagagcaccttaaaagagataaaattcaaattgctagtgtttagttttgaaaatccaatgatgctcaagtgggacctactatgatgtgaatatatgaatatttggtatgcttttagtttttcaatatttattttgaaataatgatagatgcataaaaagttccaaaaataatacagaggttcttgtatgcttcttccagcaccctataatggtaatatcctacgtagttaggctatagtatcaaaatcaggaaattaacattggtgcaatatgattaattacactataaatttatttagaattaatccatttttacatgcactgatttgtggggggtgtgtgtgtgtgtgtagttctatgtatttttttcaaatttatggattcacataaccaccacagcaaccaagacatagaagaataactccatcaccaccaagaaattcctttgtgctaccccattagagctgcatccttccctatgtccctaaacactggaaaccattaatcaggtcttcttttgtaaaattttgtgatttcaagaatgttatataaatataatcacatagtatgtaacattttgagattgactttatttactcagcataataatgttcttgggacccagtcaagttgtgtatcagtaatttgttcatttttattgctgagtaatattccatggtatgtatgtacaatacttttatttatttgttttttatttagagacggggtcttgctatgttgcccaggctggtcttgaactcctggcctcaagcaaccctctcaccatggcctcccaaagtgctaggattacagatgtgagttaccatgcctggcctacaacaactttaaccactcactcatcaaaagatatctgggcttttcctgtttttgactattacaaataatgctgctataaacacttcagtgcaggttttatgtgtgtacatgcataggtttttgtgcagatgaatgcccaaaagtatcattaccatgtcatataagtaatagcaaatttaatgtcataagaaagttctaaattgttttccagaatgacgtattactttatattcacaccagcaatccatgagtgacccaatttctttgcattcttgccagcatttggtgttgccactatttttaactatagctattccaataggagtctagtgataggtcagtgtggtattttatttgtaatggctaatggtgtccaacttttcatgtgcttattagccatctgtatatattcttcactgaatctctatttatgtctttttctgattttctaattgagttttttactgttaagttttgaaagttctttatgtaatctgcatacaattttttgatgtatggtttgcaaaattttctccagaattctactattgttggtagaatgttctaagtgtcaattagacatgtcgatggattatgttgttcagctattctatgtatttttctgaataactgtctagtagttctgtcagttcctcagatgggtacgttgaagtcaccaagtctaattgctgatttgcctctcctttcagttctagcaaaattgcttcttgtatttttctagatctgttgtttagtatatacatttaggattgctaagttttctagatatatttgcctttttaccattacataatgccctttgttcttaatttgtcactggtaattttcatggcaatgaagactactttttatgagataatacatatatttatatatatttgcctatatatatcccaaacacatgtatatataaatatgtataaatatacatgtgtgaatacatttatatatatatctaactctctctatatatatacttgtatatacataaaatctatatacctatatctagctatttattcatgtgtgcaatagtttttttgattttttttggatgagtgcttgcatggtataacttattttatccttttaattaccaccttctcatattatatttgtagggagttttaaaaacctactctttttttaaattggcatattgagataatttacatgtaatataaataatatatatgttagaactaaatctgccactttattattcgtttcctctattaatcatctccctttcccccctttctaaccttcctgtgggttaggtggggtttttttttagaattctattttgtttaatctatgatttctgtaatgttttgcatacagacaattttattggcatatatgtatgtatgtatatgtgtgtgtatatgtatgtatatatgtgtgtatgtatgtgtgtatgtatgtgtatatgtgtgtgtatgtatgcatgtatatgtatgtgtgtatatacattggcatatttacacacatacatatacacacacatatatgtatgtgtgtgtatatatatatatatatatatatatatatatatatatatatggatcaatggacagacatagctatatagatgtagatatctatttcagcctctctaccatttccccatctgacaatgttatactttttgcttcaacaatcaaatagaattttacacactcaaaaggagaataatcagttatatttgcccctatttttatctttcctgttgttcactattactttttaatattcactgtttccttttgttatttcttgtctgtttgaagatcttactttatccactcttttagggatggtctgctgctgacaaagtcttagtttacatccacctgaggatgtctttatttcaccttttgtcctaaatatatttttattgcatacagaattcggcattcacaattattttttgcacttgaaaaatgttgtgctacttccttctggactgcatggcttctgaatagaaatatgccatcattcaatgtattttgttcctctataagttatgtgccatttctctctatctgttatagaacattttgtttatcttcagttgccagaaatgttaagacaatgtgttttggtgttgatttgtttgaaatttatcctatttggaatttgctgagttgcattattttataggttttcacctggttgccaaaattggaaaagcttctttctttctttaattatttctcaggcctatattattcttttcccttaccttcttggactccaatgatacaaaattcaggtattctgctgttgacccacaggtctctaaggctctgttattttatttatttttagcctatattttctctattattcagagtgggtgttttctttttaactatcttcaaattcactgattccttcatttgctatctctaatctgctattgaatgcttcctgtacatttttttagtttcatggttatatattttgtatttaaaattttctttttaaacatatttttcttttttaaaatttttggtaagatgttctattatttccatttgtttcaagagtgtttgtaatttctccttggttgtttttatactagttgctttaaaatccttgctagataattacaacctctgtttcagactcatgttgatgcttgttgattttcttttctcattcaagttgagatttttctggtttttagtatctctacattttgcatattatgttttaagactcttattcctacggaaataatctattttaggaggcagctattcagttttgacttagcaaacagatcttagcctacttttgtgagctgtgattaaatgacaacttcaaatttcagaactatttcagtgttattcttgtctgtttcttttgtgcagtacccggagagcaatctgattcttggaaaattctgaaggtttaaggttttagttcttaaaccttctgacattttgatatggtcagtttcacatgagacttactcaggagtttgcacaggactttatatttgttttaagagtccctttttctcatctctaccctctctgtaattccttttcacctctcaagtgtggaggggcaggagcaccgcttcatttgtactgggaaggaatgggagtccatgtcctccagtcaacctctgttgactccaaaccagcagtgggaagagggagaggcacctcctcgttactgctatgcagggagtagatgtctgagctccccactcaatctctgctgacactgtatcagcagcagcaagtgaagtgtcactgcctcattactgctctgtatggataaaattctaggtttcccactcagtttttgtcagtgaggagggggcacggcttcactgccgttggggaggggatgaaaattcatacttcctcctcagcctccaaagacactgtgtggacagcagagagggacaggtcagtgtttttcatcatggtcttcagctgaagaagggtgattatcgtaaaaatgatttttgctctccttttttgtcccccttctggtccttaggctcgagagggagctttttttttttctatacttgctgccttttctagattgtgagtttttccagcatcttgtctgggatacataggaagtaagaaaaaaaccaaaacccagaaaacttactgccttgccgttcatcaaatgccaagatctttagccaaattcctcatcctttccaactttttggagggtatttctatggttgctttatgtgtcatgtataggagttttagctctgtttaatgtgaggaacaaagagaaatctgtatttatttatttattttttgagatggagttttactcttgttgcccaggctagagtgcagtggcacgatctcagctcactgcaacctccgcctcccgggttcaagcgattctcctgcctcagcctcctgagtagctgggattacaggtgcatgccaccaagcccggctaatttttgtatttttagtagagacggggtttcaccatgttggccaggctggtcttgaactcctgacctccagtaatccacccgcctcagccttccaaagtgctgggattacagtcatgagccaccgcgcccagccatatctatctttttaagaactaaagtccaaacattttttttacaaacaaatttatatttgctttatgataacagctcacacacgtgaatatagggaaagctgttaacagttgtgttagaatggcaagattattcctctttttttttaaccaatattctaccatgatacttatattacttctatgaaggaaacattaagtttctaattaaatttctaaatgtgcttattgtgctttatgtttctcagttatttaaatactctttagctcaggtttacttacttacctatcaccgtaagtgccaacgtctctatttgccagatcaccgctgacctttcttttgagaaggaaaaaattttaaagaagtaaaatactctatcttttgctgagcataacactcaaggtttgaacaggatcaaaaggagatatatatttaaaaatttattgccaggaattggcttacatgattgtggaggttgtttaggcaagtctgaaatttatagtgctggccatcaggaagggcaggctagaatgctacaataagaactactgctatacacagaatttattcttgtgtagggaagcctcagctctgattttaatgcctagtaaccgattgatttagccttaccctgattatctcgggtactttactttacttaaaatctattgattatgagcctggtgcagtggcaaacacctgtaatcccagctgctgaggaggccgaggtgggaggatcacttgaggccaggagttcaagaccagcctgggcaacatagtgagaccctgccaaaaaaagaaatcaaaagattatagacttaaatcacatctacaaaatactttcatgacaatacctagactagtgtttcaatagctgaggactttagcaaagccaagttgacatactcaaaaacccaatacactgggtaatctaatacaagattttctgttatagctaataaaatatttcaaaacaaaatataaaaattacatcagagcataggtcatgttcaaatgtgtactaaaaaaagttatttaagcattgtgattgtacaagatggggcatgaattgtatataatttataggtaacatattattatatggatttaagatatgttaaaaacagcaaaattatattgtgaaaaattactacaaaatatttctgtgtaataaataaaattgccttagctatctttttatcagatttaattaatataaatgtattacctaacctttacaatgtaatatttgtaaaaaattaattttgaagcaacaaaatgtgacataataaacattctggaaatgtttttataataaaatagagtgaaaaatataagatgcaaaatctagtatgtatattatgcactcaatagtaatgtttgttttgttttgttttgagacagggtcttactctgtcacccaggctgtagtgcagaggactgatttcggttcactgcaacccctgcctcccgggctccagcaatcctcccacctcagcctcaagagtagctgggaccacaagtgcgcatcaccatgcccagctaattttttgtagagatggggtttcgctatgttgaccaggctggtcttgaactcctgggctcaagcaatctgcccacctcgggctcccaaagtgctgggattacaggtgtaagccatggcacgggcctgctaatgtttattataatgttaattattactagaaaacattattaatcaatgctatagtaagcccatactatatgccagtcactccaataaatgtttttgatgctcaaagcaactccattaagtattattatcttccccttattacagatgaggaaattgaaagtccaggaatttagctcgtagggattaaatctaacacataggcaatgtaacaattatctctataattaagtttaaatacataggaaggaattttggtgaatagctttaaaatctttaggtaggccgggcacagtggctcacacctgtaatcccagcactttgggaggccgaggtgggaggatcacctgaggtcaggagttcgagaccagcctgaccaacatggagaaagcccgtctctactaaaaatacaaaattatccgggcgtggtggcgcatgcttgtaatccctgctactcgggaggctgaggcatgagaatcggttgaacccgggaggcagaggttgcagcgagcagagatagtgccattgcactccagcctgggcaacaagagcgatattccgtctcaaaaaaaaaaaaaaaattcaggtaggggaaatcctttttaaagattgaaactttccataaatcatcaagaaaaagcccataactgacagtctgcaaatttaaaacttttaaaaaaagtttaaacgtaaaaagcactgcaaaaaacaatgtttaaagacaagaaacactggaagaaaatattttcgtttttctttctatgttacatatttttctgctggttatcaatttattgactctcagctccaaatgcaaaatttcaggatgctctctgaaattgaatctgggctctttaaatatttttcctttgccaactgaaattgaatcattctcaatagagggcgccaaagatacactgcaggaggaaagggttgtacttccttgttccgctgactcagcgggttcctgaagcatgcttagctttctccgacattaggctcctgcagcacaggcagtttctccagtacctagctcttgcagtgtacagtgccagccgtatccagcagtaagtagcttcccctggcatcctcccgaaagcctttttgtagcaaagtgtttctgatgaaatacctctccacgccgggagcggtggctcacgcctgtaatcccagcactttgggaggccgaggcgggggaatcacgaggtcaggagattgagaccatcctggccaacatggtgaaacctcgtctctactaaaaatacaaaaaattagccgggcatggtggcacatccctgtaatcccaggtactcgggaggttgaggcaggagaatcgcttgaacccaggaggcagaggttgcagtgagccgagatcgtgccactgcactccagcctgggcaccaagagcaagactccgtctcaaaaaaaaaaaaaaaaagagaaatacctctccatgggcaacttacctcctcaccatagagggaagatttccaaaaagttctgtgagtgtagtattccagacacgtctctgttattcagtgaaccatggctgtggtctctccaacaaggtctggatttcaaccctaggggaggggtgtcttcctggggtgctctatcttaaccctgacatagtgattactcattatatctgctatttctatattctttagagtcatcttttcttcctactagccggtctttcatgatgccaataatataattatattattgttgataattttttatgctatagttaatgattatagtgaatattctttatattaaacactccctgttcagattataatatggtttgtctcagattcagattgatatgcaattggtaccagtagtgatcccaggagatagactctctgtcaaaaataggattttagtttggtcatacctttgggtttgagagctgtgctgatctccttgccaatgggaaaattgatgttggtgtggtggcctcaaaattaatcaagctatcacttgtggttgattgtgataaaatgctaactgaaacttgtgccttaggagcccaagtggctgctaaacttgattattatgacagtaatgatgactaaaatgactgtggtatggaatagattatttggagttcacttgagtgctaacaaagagaaaatgacaagctcagaaatgttaaatcccagctccagttatagttcacgaatcaaagaccttctatgacagtcctaaaaggagctattacttattgtactcagagggctgatgttgctgaaaatcaaacacaaaatttaattatgtgggttgctgaattacaatgacagttaaattctcaggcttgccaagtttctcgtgaaatttagggctaagaatgggatcctgaaatttgcagtggagacaattggttggatccacataaaattgacaatctcgagctccagtgtcaaactttctaaggcatttcattgcgaaagctgtgggcaagagctaacaagccaggtttgaaaatgcatcacaggctgcagactttatttcaacctgtagtgcccttgaacatgttcagaggtcaaaaatatcactatatggaatcaattccagaaacctgtcagtggataagaaaaccctgagagtatctcctgaagaaaaaagaaatctttcctctgaagagtgaatggagtaggagccattagaaggacagagaaaaatagaaggaaataggagaggaggatgttggggaaacacatgtaggagggtatttacaaatgatagaaagggccaatggtgtaaaatactgcagtaagttccattagtgaaaagacttaaaagtgtccactggattttctcttggtgacgtttgcaagagtggtttgagtatagtggagtagagagtgggatggtagatgaggaggtaggaatacagattgccttaactcatctgcaataagttacttcctttgagtttgccctgtgtttccttgactgacagtaattgtgaaacaatatgtgtatttccttacagacaggaataaggtcagcatgcctgacatcaccacaaaccttaaatataattctggatgttctgacagtgtaatgcagtcataaaaaaggaaatgataatgatggtgatgatgatggagatgcataaattcttgacataaagataaacatttggtaaaatatcattatatgagattgagaaactgtttacttagaaaaccttgaaaaataactgatgatatactagaaataatcagagaagttcagtgagggaaccagatgccagatgaaatggaaataaataaaattaagctttcttttaacgagcaataacaaattaaaaataataatgaaaaatatttcccacttacaatatatgtgcatattaaagataaatatgtggtaaaatttgccatttcttgagtggaaaaactcaatggcttaaatgtatcagttttctgaaaattatatatttaaggtcatcccaattcaacattacaaaactttttatttcttaacacagaaaaaaattactcaagagtatagacagttgaatggatgaaaagagtcgagaagtcaatgtaattgatatctttgaggtagaactttctgtaaaaaatagtaaagagtagtataaagttgttgtagtttaaaagaaaaaagaaaaacaccaggatttaaatggactgatagatcaagagcacataattaacttagcatatcacaaaagagttattttatatcactgtagatacagaatagtattcaataaataatgtctatcaggaaaaatttagggaacaaatactgctagactcctacctgaactcctccgtaagaataaatttaaatgattctttccattataaatgtctgtgaatatgcttttcccccaagctccaaaaaattagtcataataaaaacacacagacgagtatgaaacaaatgacagtgaaaaggtactgactgcagcactggtataacactaaatagttggagatgacctaaatattcaaagaagggattggtaaaataaattagggtgtatctataaaactggataatatagaaccattgaaatgaggatttatatatgtgtataagacaaagatgatcactatttgttgcgtgaaaaattgtttaaaatattattggaatatgtatgcattttagtaaaaatgtatatattaatatatgtttagaaaaatttaactatgctgacagtgatatattcatgtataatatataatgcctatgatatttatttgctatcttcattatattttttctgacataattttgcattcatatgaagtagcaaatctatttcataattgacagtaatatattgatggcaaccatttttgtgtattaacagaagctgccttttagattatttgtaatgaaaatagaaataatcgtataagctaggtattactgcataatggcttaaaataacaatcaattgttgtttaccatagttgttatgagtccgaaattggagagggccttggatggttgcttctggctttgggtctcctattaggtctcaggactgaaagatcagattccaaggtagatcatttacatggctgggaagatagtgctggcttgtggatcaaagaccacagttcctctcctcatgaggagagcagccacgggactgcttgcatgtcctcaatatatacctgctggcttctcccacagttagtgattcaagagcacaaattggaagctgcaaaatcttttatggcatatcctttcaagtcacaaactgtcgttttcatagtatttcataggttgcaggtttgccccattttttattggaggggattacataagggtgtgaatatctggaggtgtggatcagtgaggactattttgaagcctaacacataattatattaagaaaacataaaaataaaataataaatgtataaaaaattataagatgcaatagaatatctgttatgttagcatagcaaactgattggtcttattcatcagctgaaatgattgaaagcgttattgcagagaaaatattttaaaactaatattaggtaaacaaagatgcacacaaaaatgcatatagggtattagctactatttaaagtgaacggtggataaagattgaggtaaaatgaagaaattcaaatggttatattagagagtaggattatgggcagataaacatttttatttattttctttaatatcgtaccactttttttttttaacaagacgtatttaaaacagagacaatgtcagtattatacaacatttaagtcattatatattctgtttgtctataattgaaataatggatgattaattcaaaacagtatcaaaaattaataaaaacaacacaaaagcctacaaagaaaccaagaaaatttataagaaatttataagaaaatttataagaaatttataagaaaatcttacaaacatcaaagagcaaacataacctaatgataaatatggataaaccaatattgaatatgcttctgtaaaagttgagggattttaaatttggacacatgaatacaaatgttagaaggtaatatgatcccagcactttgggaggccgaggtgggcggatcacgaggtcaggagtttgagatcagcctggccaatatggtgaaaccccgtctttactaaaaataaaaaaattagccgagtgtagtggcgcacacctgtagtcccagctactcggaggctgaggcagaagactcgcttgaacccgggaggcagaggttgcagtgagtgagctgggatcgcgccactgcactccagcctgggtgacagagtgagactctatctcaaaaaaaaaaaaaaaaaaaaggtaatatgaactgtttccaaattgttatggcacatttatttcttcattcaataaacaattatggagcactggttttttgtgtgatcattaaatgaggtgtttattacataaagttggataagacactgtctttattctccaggtacccataatcaagtagtgaaagcaaataattgcgatatattatgataaatcttatatttaaaagcctggtataaataaggaagtaatctccataaaaagagaaagaagggatcagcaaaatgatttaaaaactgagtagagctcttattttctatatactatcaaaatgaataacaaacccaagaacattggtgttttaaaagattaattttgttctattttgtaacatagttttctgtacatatgttagcctctttcaagttgcaagacacatgctcaatttccttcctgtaataagatttgttttaaagataaacagagaaggcaggaacagcagccacacagccaggactcatgtgcgattgaattgtcaatcagaatgcaacaaagccttagcaattcaggtatcctgtccttctcttaagaaaagctacaccttgctggcatatcctgtagatatgtaataccaagtttgttttttcagtgtgtaactcaaggttcctgctgttcgtgacttgtaccatccaatggcttctccaccattagctgaatttatcatccactcactacttcatactcagtgccctgctgggtagcagtctaatgtcagaccatataatgaaataccactcagcaataaaaaggtatgagctactaatccatgtagcaacatggatgaattgcaaatgaattatgccgaaatacaccactcaaaaggctacatactgcataattccatttatgtgaatttaaagataaaacaatattttaggggcagaaagcagaccaatgcttggggttggtgataaggggagagtatgaggtaatattttggggtgatagaagtgctctatatcttgagtgtgatggtggtcacatgactatatgcatttgtcaaaactcataaaactgtacaccagaaagagcaaattttattgtatgtactttatttttatttatttatttatttattgagacaaagtttcactctagctgcccaggctggaatgcaatggtgcgatcttggctcagtgcaacctctgcctcctgagttcaagtgattctcctgcctcagcttcccaagtagctgggattacaggtgcctaccaccacccccggctaatttttatacttttacaaaatacaaatgaggggtttgaaatatttgtcattctttcttatttatttcctcttacttttagtctctaaccaaggaactatggagagacggggtttcaccatgttggccaggctggtctcgaactcttgacctcaggtgatctacctgccttggcctcccaaagtgctgggagccaccgcacccagtctactttgtttttaaacaagtaaatataaaaactaatttacggtttttatgcacgtagcttcaagatccaaaacaaacttacaacagagttacctgggaatcacagaaagaaaaatgaaatttagatctagaaaacttgctgtcaataacccctcattttatttaaaaaattcagaagttgagccttgatggaaacaaaaatacttgcaaaagggggcagaaaatatttagtcttgatcctttgaggcccacatcaaaatataaggagaagatgacagctgctaggcacttcccagaacccaccatttgattatctcaaggggccagagaaataaaaaagagaaataaattcttgaaaaatgtccaggaatctctgaattagattacaggtgaatatgagacctcaagggaatattctatatattgagagtaaacaggttattctttctaatattcttccatttttcagaaagtttaatccctgacaaatagtttatttgaaatatgagatagtcaacccacaaactccaacttgaaattttctccctcactctaagcttctcagagaagaattaataattgaggaatcgggcagtttgagtggagtctattactttgccttgatattggggacaaaatgaaggtttcccttctttccctttctctgactcctatgtgaagacatcacaggaatagggagaatatttctcaactctggaaattaagtatcatttaattgacccgcttttctaataactgattcaattttcttatctacatgctattttttttaaatataaacatagtgttagattacttattttaaaaataagtttgaaaagattaactcttcctccatagttccttggttagagactaaaagtaagatgagataaataagaaagaatgacaaatatttcaagagttggaaaaaagagagtaatagtactatttggcctctaagatcttaacagcaaacactgatggttttagaggtacatatacctcatgctgtgctgtgttaataaatacaatttttaaatgaaatgaaaagctaaatagtataaaagttatactttcaactccagtcatgcatattgtgtaactggggctgaacacttgagttttcattatttaacatgaactggtcatatcactgccaattccttttttttttagagatggagtcttgctctgtcaccaggctggagtgcagtggtgcaatcttggctcactgcaacctccgcctccttgattcaagagatttcccctgcctcagcctcctgattagctgggactacaggcacacgccgccacgcctggctaattttttgtattttagtagagacagggtttcaccatgttagccaggatggtcttgatctcctgacctcgtgatctgcccgcctcagcctcccaaagtgctgggattacaggcgtgagccactgcgcccagcccaattccttcttttgtcatagaatttttttggaaatagtttgttttcatgacagaattatgaaagcataaaatatcagagcacttgttactggttactgagcactggaaatatggctattgtgatacaagagatacatattttatttcatttaatttcaattgatttaagctttaaatagccacatgtggctagtggctaccttataaggaaacataattcgatacactggccaagaagacatgtgtatggcacacaagaaaaggagaggtttgaaggacaaacaaattagtccagtcaaggatgtcaaatataactgcaattgtctgctagcacttttgattatattgaaaccttatgcggcatgggaaagggttaccactaaaaataaatcagggcctttactgctgatttcacgttttcttgctacataggtcaaccaagagagtaccaactggctggctatttacatttccacaagaaaacaacagacaacttacagctgcctataaatatagtggaggacacttgaaatgggaaaccagataatcaatctgcctcactggcacaaatttactgagcgaattctcgccgggtgtgctgtctatgcaggattttatatattcttcacactgtctggctgaattatattcatataaatgaaataaatctccctttgaatccacaacaaaagtggaatggtttagaattttgagcaaagtggtacactcaccatcaggaatattgtgcccaaacacgagatattatgttttgttatattcttagacctcatatacattttcctcagatatccgaatggtaacactttcaggagtagaggatgctatatacattttatttatttgtatttattcaaaattttatttaaattctgtattaatataattgtggattcacatgcagttataagaaataatacagaaatctcttgtgtaaaatttttcaagcttcccttaatggtaacattttgcaaaactatcatataatatcatatccaggctgttaacatttatataatacccctatattattcagattgccagttttaccagtacgtgtgtgtgtgtgtctgtgtatgtgtgtatttagttctatacaattttgacacctttaaagtttcatgtatcctcaaccaaagtcaagataacacttccgacaccacaaggatactttatcctgctcttttctaatcatacccagcttgcttctgccttaccctatacttaactactgacatgtcctccatttctaaaatgttatcattttaaagattacagaaaggaatcatgcattatgtcatcttttgggaatagattttttctcactcaactattgatacacccaagtttctgcatgtatcagtagttaattcctcttcattactgagtagtgttccattgtatagatatatgacagtttgtttaacaatttaccggttgaagagcactcaactgttttcaggttttattattatgaataaagctgcaacgaatattcagttttgtgtgaacatagtttgcgtctctctaggatgaatgtgtgtgactgcatttggtggactgtatggtagttatatttttactttaataagaaaatgtaaaactgctttccagagtggctataaatgttacattcctactagaaatttctgaatgatccagtggctccacattctcatcagcatttgatgttatccttattatttatattagaagttgacaatttagtggtctttcaccaagcagctctcggttacatacaaacacttccctcatcaccaagttccccgtatagtttagcataattttgtttggattaacatacaactgttttttagttttgattttaatttttgaggggaggtaatgggcatatatatttatggggtacatgtgatattttgatacaggcatgtaatacataataatcacattatgtgaagtgggatatctatcccttcaagcatttgtcttttgtgttatgaacaattcaattatactgttttagttattttaaaatataaaattaaattatttttgactatagtggccctgttgtgctatcagagactagatcttatacattattcctaactatgttttctttttgtacacattaaccatctcaacctccgccccaccctcccactacccttcccagactctggtgaccaaccctctactctctacctccatgatttcaactgttttgatttttagatgctacaaataaatgaaaacatgagaagtttgtctttttgtacatggtttctttgatttagcataatgacctccagtttcatccatgttattgcaaataacaggacctcattctttttatggctgaatagtaatccattctgtataagtaccacactttctttatctgttcatctgttgatggacagttagcttgcttccaaatcttggctgttgtgaacagtgctgcaacaaatgtgggagtgcagatacctctttgatatacagatttcctttcttttgggtatatagacatctacagaactctccaccccaaatcaacagaatatatattcttctcagtggcacttggcacttattctaaaatcaaccacataattgtaagtaaaatactcctcagcaaatgcaaaggaactgaaatcataagaaatagtctctcagaccacagtgcaatcaacttagaactcaggattaagaaacttgctcaaaaccacacaactacatggaaactgaacaacctgctcctgaattactcctgggtaaataacgaaattaaggcagaaataaagaagttctttgaaaccaatgggaacaaagagacaatgtaccagaatttctgggacacagctaaagcagtattaagagggaatttatagcactaaatgcccacaggacaaagtgggaaagatctaaaatcaacaccctaacatcataattaaaagaactagagaagcaagagcaaacaaattcaaaagctagcagaagacaataaataactaagattagagcagaactgaaggacatagagacacaaaaaaccctttaaaaaagcaatgaatccaggagctggttctttgaataaattaacaaaacagatagaccactagctagactaatagagaagaaaagagagaagactcaaatagacacaataagaaatgataaaagagatatcaccactgatcctacggaaatacaaactaccatcagagaatactaaaaacacctctacacaaataaacgagaaaatctagaagaaatggataaattcctggacacatacagccttccaagactaaaccaggaagaagttgaatccatgaatagaccaataacaagttctgaaattgagacagtaattagtagcctaccaactaaaaaatacccaggaccagatagcttcacagccaaattttaccagaggtacaaagaggagctagtaccattccttctgaaactatcctaaacaactgaaaaagagggactgctccctaactcattttatgaggccagcatcatcctgataccaaaacctggcagagacacaacaaaataagaaaacttcaggccaaatatccctgatgaacatcaatgcaaaaatcatcaataaaatactggcaaactgaatccagcagcacatcaaaaatcttatccaccatgatcaagtcagcttcattcctgggatgcaaggttggttcagcatatgcaaatcaataaacgtaatccatcacataaacagaaccaatgacaaaaaacacatgattatctcaatagacgcagaaaaggcttgcaataaaattcaacatcccttcatgttaaaaactctcaataaactaggtattgatggaacgtatctcaaaataataagagctatttatgacaaacccatagccaatattatactcaattgacaaaagctggaagcattccctttgaaaactggcacaagacaaaggatgccctctctcatcactcctattcaacatagtactggaagttctggccagggcaatcaggcaagagaaagaaataaagtgtattcaaataggaagagaggaagtcaaattgtctctatttgcagatgacatgattctatatttagaaaaccgtagcatttcagccccaaaacttcttaagctgataagcaacttcagcaaagtctcaggatacaaaactggtgattttgcccgttattcaatgcagtttcttcatagtgtcatcggtctttattatcttggtgtgtttttgcagtgactggtactggtttttcccttccatatttagtgcttccttcaggagctcctgtaaggcaggcctggtggtgacaaaatccttcagcatttgcttgtctggaaacgattttatttctcctttgcttatgaagcttagtttggctggatatgaaattctgggttaaaaattcttttctttaagaatgttgaatattggcctccactctcttctggcttgcagggtttctgctgagaaatctgctgttagtctgatgggcttgcctttgtcagtgacctgatctttttctctggttgcccttaacattttttccttcatttcaaccttggataatctgatgattatgtgtcttggggttgatcttctcatggagtatcttagtggtgttctctgtatttactgaatttgaatgttgacctgtcttgctaggttgggtaagttctcctggataatatcctgaagtgtgttttccaacttggttccattctccccatcactttcaggtacaccaatcaattgtaggtttggtctttttacatagtcccttatttcttggaggctttgttcgttccttttcattcttttttctcttctcttgtctgcacaccttacttcagcaaggtggtctacaatttctgatatcctttcttccacttgatcaattaagctattgatacttttgtatgcttcacgaaattcttgtgctgtgctttccagttctatcgggtcatttatgttcctctttaaactggttattctagttagaagttcctgtaaccttttatcaagtttcttaacttccttgcattgggttagaccatgctcctttagctcagaggagtttgttattacccaccttctgaagcctatatctgtcaattagtcaatctgattctccgtctagttttgcaccattgctggagaggtgttgcgaccatttggagtagaagaggcattttggcttttggaattttcagcgtttttgcactggtttttcctcatctttgtggatttatctacctttgatctttgaggctgatgacctttggatggggtatttgtgtgtggggtgtcctttttgttgatgttgttgttgtccttgctttctgtttgtttttttttttttctaaccgtcaggcccctcttctgcaggtctactgcagtttgccaaaggttcagtccacaccttgttcacctgggtatcaccagtggaggttgcagaacagcaaagattgctgcctgctccttcctctggaggctttgtcccagagggtcactagcctgatgccaggtggagctctcctgtatgaggtgtctgtcgacccctgttgggaggtctctcccagtcaggaggcatgggggtcagggacccatttgaggatgccatctgtaccttagcagagctggtgcactttgctgggagaatccgccttgtcgagatctgctgctctcttcagaactggccagcaggaaagattaagtctgctgaagctgtgactgcagccgcccctcccccgaggtgctccatcccagggagatgagaattttatctgtaagcccctgactggggctgctgcatttcctgtagagatgtcctgcccagtgaggaggaatctagagaagcagtctggccacagccacttttctgtgctgtggtgaattccgtccagtccaaacctctcagtctccttagcactgtcaggggaaaaccaccaactaaagcctcagtaatggcagatgcccttccccccaaccaagcttgatcgtcccaggttgactccagactgctgtgctggcagtgagaatttcaagccagtggttcttagcttgctgggctctgtgggagtgggatttgctgagcaagaccgcttggctccctgacttcagccgcctttccaagggagtggatggttctcctgtctcgctggagttccaggcaccaccagagtatgaaaaaactcctgcagctagctcggtgcctgcccaaacagctgcccagttttgtgatggaaacccagggccctggtggtataggctcacaggggaatctcctgatctgcagaatgcaaaaatccatgggaaaagagtagtacctgggacaggtaacacagtccctcactgctttccttggctgggggagggaggtcccccagttccttgcacttcctgggtaaaatgatgccccatcctgcttctgctcactctccatgggttgcacccactgcctgaccagtcctgatgaaatgaactgggtgcttcagttggaaatgcagaaatcacttgccttctgcattggtcttgctgggaggtgcggaccagagctgtttctattcagccatcttgaccaatactattgaacaccttttcatatgcctgtttgccatttgtatgtcttcttttgagaaatgtctattcaaatattttgcctatttttaaatcaggttattatacatttttttcttatagagttgtttgagcaccttatatactctggttattaatcccatgtcagattggtagtttgcaaatattttctcccatgctgtgtgttgtatcttccctttgtggattgttccctttgctgtacataagctttttaacttaatgtgatcctatttgtcaatttttgccttgcttgctgtgcttgtggggtacttactactcaaaaagtttttgcctagaacagtaccctggagagttttctcaatgctttctaatagcagttttatagtttgaagtcttaaatttaagtttttaacccatattgatttgatttttgtttatgacgagatatatggggctggtttccttctgcatgtggatattcagctttcccagcaccatttattaaagagattgtctttttcccagtgtatgttcttggcaccttgtcaaaaatgagttcactgtaggtatgtagatttgtttctgggttctctcttctgttccattggtctatgtgtctgtctttatgccagtaccatgctgttttggttactatagttctgtagtataatctgaagtaaggtaatgtggtttgttctgttttcttctttttgcttaggatagttttggctactatgggtcttttgtggtttcacataatttttagtattttttctgtttctgtgaagaatgtcattggtatattgatagggattacattgaatctgcagattgttttgggtcttatggacattttaataatattgattcttccaatccaggaacatggaatattttttcactttttggtatcttctttaatttttttttatcagtgctttatagttttcattatagagatcttttacttctttggttaattcctagatatttaattttatttgtaaatgggattactttttaaatttctttctcagattgttcaatgttggcatataaaatgctactgacttttgtatgttattttgtattctgcaaacttactgaatttatcagttctaatagtatttttttgtgggttttaggttttttcaaatatgagatcatatcatttgtaaacaaggataattttacttcttcttttccacttttgatgccctttatttctttctcttgtgtgattgctctagccaggatttccactactatattgaataacactggtgaaagtggacatccttgttgttttctagatcttagaggatatgcttcaaatccatttatttatgctctgatcttgattatttctttccttctatgaattttaggtttggtttgcacttgcttttctagttctttcagatgcatcattaggtggtttatttgaagtttttcttcttttttgaagtaggcatttgtaactataaaattccctcttagtactgctttccctgtatcctataggttttgttatgttgtgtttccattttcatttgtttcaagaaatttttcaatttctttcttaatttcttcattgatccactgatcattcaggaggatattatttaatttccatgtatttgtacagattccaaaattcctcttgttattgatttgtagttttcttctattgtggtcaaagtagatgcttgatattattttaattattttgaatgttttaagacttgtttggtgacctaacatatggtctgtccttgagaatgattcatgtgctgagcaaaataatgtgtattctgtagccattggataaaatgttctgcaaatatctattaggtccttttgttatatagtgtagatgaagtttgatgtttctttgttgatttttctttctggaagatctatccaatgctgaaagtggggttttgaagtctccagcaattactgtattgggggctatttctctccttagctctaataatgtttcctttttctatgtgagtgctccagtgtcgggtgcatataaatatatccgtaattattatagcctcttgctgaattgacccctttatcattatacagtgaccttctttgtcttttcttatagtttttgtcttgaaatctattttgtcttatatgagaattgctactcctgctcttttctggtttccacttacatggagaatctttttccatccctttattttcagtctatttgtatctttataggtgaagtgtgttgcttgtagagaacatatcattgggtgttgtatttctatccattcagccacttaaaatcttttgcttggaaagtttagtttatttacattgaatgttttattgataagtaagcttattcctgccattttgttatttttctgattgtttgtggtcttctgttccttctttccttccttcctgtctttctttaagtgaaggtgattttctctggtgatataatttggtttcttgctttttaatttttgtgtatatgcattgtatatgttttggtttgaggttaccataagccttgcaaatactattttaaattccattatttttaagctgataaaaacttaacactgtttgcctaaacaaacaaacaaaaatgaaactaataaagactctgcaccctaagttcatcaccctagtttttaactttttgttgtttcttcttatatctgattgtcctatgtcttgaaaagttgtagttatttttttattggtacatcatttagtctttctacttaagattagagtattttacacacctcacagtgttataatattctgtgtttttctgtgtacttactattactagtgagtcttgtactttcagatgatttcttgttgctcattaatgttaatggccttttctttcttattgaattacaccctttagcatttcatgtaggacagatctggtgttgatgaaatccctcagcttttgtttgtttgttaaagtctttatttctttttttaaaatttttttgagacagagtctcactctgtcacccaggctggagtgcagtggcatgatctcagcacactgcaacctccaccacccaggttcaagcgattctcatgcctcagcctcttgagtagctgggactacaggtgtgcactgtgaagcctggctaatttttgtatttttagtagagatgggtttcaccatgttggccaggctggtctcgaattcctggcctccagtgatccacccacatcggcctcccaaagttctaggattacaggtgtgagccactgcccctggcctccagtgattttctctttcttaacagaaatttacttatgtataataacatctctttacaatcacaccaagaaagtcctaggtctcagaatctcttttttattttattgatataatagaaataatggctgtcatttgtggaaactgcatgtaagtctggttgtaaaacagtgtattgagggttcagccaaaagcaaaccccccccaccaaaaaaagaggaaaaaggggagtaggagggtgtcaggaagaggggaagagacaaaactttcaagagcttcttcatggagaggaaagagtttccgatgtatgctaacagggatgaaaaagcagtttatccaacattgaataacataatggatttgggtacactacaagttatattttctgcaaccattcaacaggagcaaaactttcctattcccactctcacctcccgactcctgcccctgaagatataattgctaggattactggtactcttcagatgcaaatcatcagtgcatttttaaacactcattttttattatgaagaatcagctactttatatatttactttctaaaataatatatgtatatatatgatttgatatattaattttcagtgtgcttttctataaaagaaaatatatataatatatgtataatttgatatatcaatttctagtatgcttttcttttcttttattgaaaagcaaaacatactgaaaattatatcaaatgataattatattatacatatatattattttagaatctgtaatcaaactttttttcattacctgtttcacagttttttcatcccctttggttacagaacatatcttcaaattatctcatttattttgccaatatcacaagccctatggaaacagattttttttctattgcacataattaataccaaaggggtttggggaagcactaggaaatgaattgaggtaagaaagattcttgaatcatttgatgaataattgctttcacaattactactttgggacttttttctcagtcaactagtcacatttattcaggtcctgatttgattgtagttgcgttgtataattcaaaaggcatcaatatcccatagccaaaatatatttgatacaaaactagttttgtctaaaacgccagcgtatatagttcagcaatcaaatactgaactcttaaataaaagacagaaagatacagcaatttttgctttgacaaaagcataaagttaaagggagaaatgacaaaaatggaattggaaatgtacaacaaagggaaagggcaaaaattcaggcatgttgaaactatggaaaaaatcagagtgaaacaatttaaaaatacattcagagtcattacctagatatagtaaatcacaacagagaaatataattattaatacaaattgaagagaaaaagtaggaaaaccaatatgccaaagtgattatttgatagaagtattggaactcaacaagcaattcccagagaataaataagggaatgtgctatctaaagaattaatgttcagttgttaagttctgctaatcatacactaaattaaacttttgaggaaacttttaatatactgtactacattttgaaattattatcataaattatgcagtaaatgatgttggggtagtttggatcagcaaatcacttttatatcaggataaattttatatgaataaaaacccaaacaaacaaaaacatgaaaaagccccccaaaaaccccaaacagaaacaatagtaaacaaacagtaaaagcaccagaaggaaccatgggagaatgttggttcttcattatccaattttggcataaggagagtttttctaggaataaataaaaatgctttttaaaaacctgaagccataaaaaatgatacatttcaccaatacaataattagaaaagtttaaaaaatagatatacagaaacatatatttatgcagacaagactaatttccttaatatataaagcacttccactattgataataaatagatcaacattccaagaaaaaatatatgaatagacagagtataggaaaaaataaatactaatgacttttaaataaatgaaaagatgttcatttctatcataataagagaaatgcaaattaagatgcatggaaatatcatttcttatgtaagatagttgcaaaaatatcaaaacattgataaagtttttgtttcctgttgctgcataacaaattaccacaaagttaacaacttaagacaatagacatttattatctcacgttttttggggggcagaaatctgagcactgcatggctggattctctgctcagaaatgcaaacaaaatcaagatgcccgcagagctacactcctttctggtggctctaggggaagaactcgattccaaggtcatttaggttgtcgataggatttagttcatttatactagaatattcaaattcaaatcagtaatggtgtattaagtccttcttatactaaaaatgtctctgactggccgggcgcagtggctcacacctgtaatcccagcactttgggaggccgaggcgggcggatcacaagttcaggagatggatactatcctggctaacaaggtgaaaccccgtctctactaaaaatacaaaaaattagctgggcgtggtggcgggcgcctgtagtcccagctactcggaagactgaggcagaagaacggtgtgaacccgggaggcggagcttgcagtgagccaagatcgcgccactgcactccagcctgggtgacagagcgagactcgtctcaaaaaaaaaaaaaaaaaaaaaaagaaataaaaatgtctgacttctggctcactcctgagcttgagaaagcgctcttatgttaaattaggctcacctggatactctccgtatcttaagatctgttatgccatacaaatttacataatcgtgggagtgataagtcatcatatccacaggttttgtgaattagttcaggatatatgagtggagggggtattttagagaccctgcctactacacatactgtaacagcttaggcgtgggaagaaatgtactctcattttttgctagactatgatgaatataaactcactgaagaacaactttctagtttctattaacagtgacatttcttgataaccgtctagtgacaagtgcacagaactttggtcaattctccttatagtaattctatattattctatagatatactcacacatgtgagaaaaaatatacacgacaacagtcatcactaccctgtttgtaattttaaaaagattgcaaacaactcaaggtgaatcagaagttcaccaggtcaataaattattatacatccacataatggaatattatgctgttgtaaaaaatgaagatactcttgatgtactgatatgacttccaagatgtattgttgtgtgaaataagcagtaaagtaatgatgtaatagtatgctacgagtgatatcaaaaagagggagaaaatattcccccttcccctgtgccccacgggtacatgtagcaatgtttggagttagtttgggttgtcataattgaggggagggggatgtgctactgacatctagtgggtaaaggccaaggaagtagctaaatattctacaatgcagaggatagcaccttaaaaatataattatctggtcaaaaaatgtcaatagttctgaggttgagaaattctgctgtaaagctaccattttgagattttcagagtcttgttggttttaaagtttcatgaaaaagtttgtgtctattttgctctttcatgtgagtactatataattcagccaaattctttcctaattcttcacatttccatactgtaaagtcctgatattttagattgcttgtctttctctcgattcctgtagatgttattatccaactgtgttaaaactttcttgtgatagattgactaaaagtgccaacatcctttcaggtagtacgagaaatggccctgtaggagagtaaaataatgcaaaaattactcttgttactatcaagtgaggcctctcctgatgagagatactgcatgagatgattgactttcaattgcctgtttcactcaggaatctataattactcaggaaccagaggtatacttgccatcaggtatttgcccccagtgaacatgagaggaaaatcgagggtcaccacagtagtctagaggtaggaaaggttggcaggagctttggatggctaaaacaaggtttttcaaaagttatgatactcaatctaatagggtgatattatcagaactgttcaacttcatggggacatgcccttcagagctcctgtcctctgttggtgtctgcgttgattagatttagctgctctatagggactcaaactaatagtgcattaaatatgatttagtttcaactctctctcaaataatagtcccagctgggttggtagttttgctatacaatttagtcaaggcccaggctcctttgatcttttcactctatctaccttaaagtgatcaggtggcccactaccatatttacaatgagcccaagaagcaaggtaagagggtagggaaagcatctcccaccattgtaaggcaccactttaacattataattcagaagtggcacaagtcagttacactcacaacgaaaccttgtttgcatggctatatctagcaacaagaaagcctggaaaatgtaatcaacctgtgcagtcataggcacatctaaaaactctaccatgaaaaaataggaaaaaatggataatgcggcacagttagcagtctctgaaataatttctgtttgtagtaaagcacacttgttactaacgttagagaaacgtgtatcctttggccctgatctcttgaagcctttcctcattcatcatatcctttgtaaaaacaatggattatttttctggtaattcatcttgctgccatccaattcacgctattctattctatccaggcattagtctcatcacgttattcttattggcatggctttttattatctagaagaacttttaatcatatgctacgttagtcaattgtattgtacattactcactttcaaattatttcataaacacattgattactatacttttgtattttatgtcaatgatttttggggaacaggtggtttttggctatctgaataacttctttagtggtgatttctgagattttggtgaccctgtcactcgagcagtgtacactttgcccaatatgtagtattttatccctcaccctgcttctgcccttctccctgaatctccaaagttcattatatcattcttgttttttttttgagacatagtcttgctctgttgcccaggcctgagtgcagtgggacaatcttggctcactacaacctcggctcactacaacctctgtctcctgggttcaagagagtctcctgcctcagattcccgagtagctgggattacaggcatgtgccaccacactggctaatttttgtatttttagtagagactgggtttcaccatgttggccaggctggtcttgaactcctgacctcaggtgatccacctgcttcggcctcccaaagtgctgggattacaggcgtgagccaccacgcctggcccattatatcattgttatgtctttggatcttcatagctttgctcttacttataagtgagaacataggatatttgattttccattcctcagttacctcacttagaatagcagcctccaactccatccaagttgcttcaaaagccattattttgtttcgttttatggatgtgtgcctagaagaaatctttttatcctatttcagtaacatctaagtcagtactctaaccactatagtagatttttcttgattgcatgcagactgcattttaaatgaattatttgatcttttaaatcatttttttcagtcctttaagcagatctaaaagtaaatatccaaacattctactaaggataattttgcatacttcctcattgttatccctgccttgttgttcagaaactctacacttcattagaatttcctctagctatatatgaagtagagccttcgatttctagttcacatggcaacttttatagttattagatgagagttatattttttcataaattaattcagagtagaatggcaagtctgaattgaacatttaggacgtctctccttaacttcaatggccccgtaatagtactgttcatcattcactataataataaaataaagtttaaccttatttataatatatacattgtttcagtaagaacaccttctttgacttttacatacaagttcttgccaactatgctgtcttggaaatgtgaacaaaaatgcacatgcatatttaatccatggtatataatcaacattattcttcatgaagcccccagaagattttttaaaaaatataaatagtattctatatgtataacatatagaatactatttatattttaattatgattatgcaaaatctcttgtcattttgtgttatttgttcaactttaaagtaattacataaatacacattgttgaaaatttggctaaaaacagcttatatttcagtaaaaagccttgaactgttagtcaacataatactggaaatctgagctaaagcaatcagacaagagaaataaatggaatggaagaagtcaaattatctctgtttgagatgatatgatcttatatttggaaaaaaaatctgaagactccaggaaaaaacctattagaactgataaacaaattcagtaaaattgcaggatgcaaaatcaacatacagaatcagtagcatttctatatgccaacagtgaacaatatgaaaaagaaatttaaaacgtaagcccacttgtaatagccacaaataaaattaaatatctagggattaaccaaagaaatgaaagatctctaaaattaaaattatgaaatgctaatgaaaaaaatgaagaggacacaaaaaaatgggaaactattccatgttcatgaattggaagaatcaatattgttaaaatgtccataagacccaaagcaatctgcagattcaatgtaatccctatcaatataccaatgacattcttcacagaaatagaaaaaacaatactaaaatttatatggaaccgcgtaagacccatagtagccaaaactatcctaagcaaaaagaaagaaacagaacgaatcacattatcttacttcagattatactacagagctatagtaaccaaagcagcatcatgatactggcataaagacagacacacagaccaatggaacagaagagagaacccagaaacaaatccacatacctacagttaactcacttttgacaaaggtgccaagaacatacactggggaaaagacagcctctttaataaatggtgctggaaaaactggatatccatatgcagaagaaaacaaaccccatatatctcgtcatatacaaatatcaaaccaaaatgggttaaagacttaaatttaagacttcaaactataaaactgctattagaaagcattgagaaaactctccagagtcctgttctgggcaaaaatttattgagtagtaccccacaagtacaggcaagcaaggcaaagattgacaaataggatcacatcaagtaaaaaagcttgtgtacagcaaaggaagtagtaatccataaagtgaagagacaacacacagaatgggagaaaatattggcaaactacccatctaacaagggattaataaccagaatatataaggagctcaaacaactctataagaaaaaaaaaactaatgatccaatcatgaaatgaacaaaaatttgaatagacatttctcaaaaagagacatataaatggcagttacatgaaaaggtgttcagcatcactgatcatcagagagatgcaaatgaaaactataatgagctatcatctcaccacaaataaaatggcttttatccaaaagtcaggcaataataaatgctggaagggaatcctcatacactgtcggtgggaatgtaaattagcacaatcactctgaagaacagtttggagattcctcaataagctaaaaactgacccaccatgtgatccagcaatcccactgctgggtatatatccaaaagaaagaaaatcagtatatcaaagaggcatctgcactcccacgtttgctgcagcactgttcaccatagctaagacttgaaagcaacctaagtgtccatcaacagataaatggataaagaaaaatggggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacaccctggggcctgttgtggggtggggggaggggggagggatagcattgggagatatacctaatgccagatgatgagttagtgggtgcagcgcaccagcatggcacatgtatacatatgtaactaacctgcacattgtgcacatgtaccctaaaacttaaagtataataataaaaaaagaaaaatggggtacatatacacaatggagaactattcagacataaaaaaaggaacgaggtcctgtcatttgcaacaatgtggatggaactggagatcattatgtcaagtgaaataagccaggcacagaaagagaaacattgcatgttctcacttatatatgggatctaaaaatcaaaacagtgaactcatgcataaagagagtagaaggatgatttccagaggctgggaagggtagtggggggcactgggagaggtggggatgtttaatgtgtattaaaaaatcatttaaaagaatgaataagacctactgtttgctagcacaacagggtgacttgactatagccaataattacttaattgtacatttaaaaataactaaaagaatgtaattgaattgtttgtaacacaaaagctaaatgcttgaggtgatggataccccattctccatgatgtacttatttcacattacatgcctgtatcaaaccatcttatgtaacccatacatatatacacctactatatacccacaaaaattaaaaattgaaaaaattaaaaagtctttatatggccattctttgaaaatagaaactgaacaagagagtttagagctaaacatgtgatgcaaatattagactatttcatctaaaattaatagtttgagtggataaaagaatatataagaagccaagaaggtttatgtatagttactaaggacaatggattgagctttaggcttgttgaacttgtagagctatgtgacattcctcctttgttgatgagaataccaacagaacagataaacaaaattgttcttcatttgatttttattgccatatctttggattatacacagaagtccagacttggcttttatccttgagagtaaaaaattagggagttttgaggcttcttcgcagtttccaattttttcagaaattgattgaggggctttgtatgagctgtggtcttgattcagtcaagttatatgaactattgttatttcaatgctgtaaaattgtcctgcttaggggctcaggaacatggacaggatttgtattgtgatatggtagtagcgactagtataaaaattccagccatgattcacatctcccacttgttaaaccaagatctatagaattttgaaagataatgtcgatggtttgcatctatcaattcctaagaatttacaaataataatcaccacttctgctgtttttcaactattgacagcagttccaagaaatgtgactacttgtctttgtatttagaactacttattaatctctgcatccttgtggaaaatgaagcaagaaattctttatcatcttggtactgtgagaaccttgtaaaagtgttgtgggaaaggttttactgttcaagaatgactaactgtttggctggcagatggagaggccattctcctcagagtgaacataatgtgcagtagcaaggagtaaatgaaagcgtgtggtatattttgaaactctgagataacagaagaaggacgaggagagagtagggactgggcaatgtgaatatgagtttgttggaaaagtcctcatctagcagcgaagacgtgtgatctctatctcctgagcaacaccatttcacaaatgaggaccctggaacagttaacaaggttcctaaagcctctatattcaatgtgtggccccggaaccagaagcattgtaatcacctggaagcttgcttgtcataaatacagatacttagaccttgcttcagacatactgaaacagaatctgcattttaacaaaagacccagaggattgcttttacattgtgtgtgtgtgtgtgtgtgtgcatttaaaaagatacaggtgtcacaatttcttattgtttggtcaattttaaaatttaatactgtataatggatatctcttatgtcaacacagatctacgttattattcatcataaataaacagtaagttattgtatccatcgctactgattggtattcatattaatccaatattttgctattgtaagaaacattctgattcagaaacgctgacgtaaagacctctgagcaggacatctaggagacactgactttgttatatctccctttctgttatatcttgctgccttaatagaccacgtgggcacatcactttcactgatcttttttttctttgtaaatgtaaattttaattgaattataaggccagtttacagtgcatctgtgggcagatttctttaaaatgcatggtactttaaactttgtcttacgagaggtccaggaaaatgcccactaagcctctgtgattttaataccgtgccaggccatggcaaagtgaggtgcctctgacgtttgggctgccacagcgtgtttttcagttactctggtaacacctgtgacctgagggttattctattcgcgttagcaactcgcgcgggttgggaggcgccaatgagagcagggcttgaaactagcgcttggcgtctgatggttgcctagcgacggtcgtcgacgctaatccttggccggacggatccacatctgttttctggctaccgagagggcagccatgaacacccaaaagggttccctcaccataaacgtccacagaggttccctcgccatgagcatccaaaggggttccctcgtcccccgggatatggatagctcgggtagagacatgcagctgcgggtgatcccggctgaggtgaagttcctggacacgatggccgggagggtgtaccgcctcccgattactgtgcataatatttgccgctggaaccagaaaatccgatttaaggagcccgtcaagccacaggtgacacactaaggggtgctgggagcgggaccttgtgagagcgcctcctcacactgcgtctctctttgccccagggagtagtcatctggctcctgccgggatggagggaggattgggcttcccgggaaacagtgacaggtttctgtgtgtgtgctctttttgtttctctttgttttctgttttgtttaggattaggagatggggagggcagggtggagaaaagctgacctagagcctccccatttcttcaacctgggtttagaaacttgttaacaatcccaaaatctgtgcaacttggttttatgattttgctgttgccttaagaattatgagaacaaaattctctattaactgccctttgaatcataaagtgcctgataactccaggaactgtaggattagtggaaaggttcattatttcatattttaacaaacatttgttaagcacctactatataacgggtaatagacatgaggaatacggaatggacacagccctgccctcatagaacttagaaactaatgagggggttttagtacagatctaaccatcaagaaagttaatgttctgagagggtgtttctatcttctaatttaaagtgggcagaatttcctctgtatctcactgtgttattttacatcatgtgtgtgaatggatggttattagttcagtatgatcacattttctcaggcaaatttttgatataggaaatgcgataagaatttttgaaatgtaagcaataaataactgaaaacttcaagagatattcctaataaaaagtagtgttgaatacagctggactatatgtgcagaaaaaaaagatgtccgtaattttagattaaatttacatatatttctttgtatatatgtagaaaaacctatgttaatgattagaagagcaatgagaaaaaggacttccatgttctaatttttgctctgttaaaaaaatcgatgtattatttacttactaaagtgcacagatctcaaaagtaaagtttgatgaatttacaaaaaaataaatatgtgtgtgtgtagatagatagctagatagataatctccattagctaccacctggatcaaataatagaatatgttcactaccccagaagatccccagtgcttcttccttacagtacctggagtaatcaccctgtggaactgaccactattctgatttctaacatggtagattagtttggcctctccttggctttcatataaatggaatcaggttttaatgattttcatatttaaatatttttattaaaaagtatatctcaagagactattaactcctctttaaatcaaaaagtacttgcttactccagacactgtaaaattaaggaaagcctgtgttatttcactaccttagcacatatttattgaacaattacttgtgtatctgaaaatactttcttttgaaacaagctggtggtaataatgtttggatgtggacaaccactattttatggatgttcaggggacacttgtatggatggtttctgtgcagtaacaagaaaaatattataattggttttatttcagtttatatctaggatataatggaaaacaattcattccacaagtcttgacattgacaagagaacatctagatatgcttagtagttagaagccaatatcagtgtgaattttcctttgttgcaagactatgaaatgcactcctgatccttcataaagggaattagataaatagtgaaaagtgcatcttgttggggtgggggataagaaaaagtaaaaacaaggtgctgtggaaagggcattgtcatcatcactattataatcactcagaaaatgattcctctaacatacagcagtgcttgtttttcacccagactcaagaacctgcattgaccctatgtattgaatacccactatgtgtcatagattgctggtagaaaaataagaagacacatactttatcttcaaagaaaatataattgatagtactattactgattttcaataacatccttcaatctcacgaacactatccatctaagagtgtttttatggcttgtgtggcctctggtctggtcagaccagccttactcatacctgccccctctcccttatgactcagacttctttttcttctcacccacattttcataccctgtcatctgcaaaaatcatccctttccaaatcccatgcatcttttaaggtcaatgtgagttctcattttctctaagaagtctgttattattttatccccaaattatttctgtcttactggataccattttcatttacagacattccttatagtttgaatttgtgtccctatgcctcttgttaaatgttagtactgcctccattttcagctcataaactgctaagagtagggatggtgccttgcacacatttgcatctcactaagagtgctcaacaacatgcagtttgaccaaaagcacatggttctgaagtattggttttccttcttgaaactatagcttacttacaagaagatagtcaaacctgatatgtggacttccaacacccaaaggcttatgtggaaaatattgtatcccttgttttccttctgttctataaattgcacgagggttgagagttcaaatgtggtagttaggaggtatcagcattgtttgctgaaagcatgaagctcccagatcagtgttacttccaaatcactccacttctctatatccttaattgctgcaaagcactatttagactcagcctcacattagaatccctgaataatcattttcaacataacctccattgtttctgattgaggactcttgcccagggaggctggcttattatctgctttctgagagactattttgcttattcttgtttctgcttgtgtctgagatatttttacacctataatgagcaccttcctcgcttcttctccacctttaatatccattctctaagactaggccaggtacactcctttctagcccacaataatcatgtcctctcatggattttcttgacacttatgtctctatcactcatatggtgcttaactagtccctggcttatatttaattttcaaggggtttgtagtctgcttccttaaagagattatgtattcaggagagggactctttctagttgaaggggaggaagtgcttatgatttagagtcagatagatatgtttttgagtcttcacttcctgagtgacttcagacgttaattatactttacatgtcccagttccctcatctatatactgagagccttaatatcagcctcacaggactgtagaagtgtatttacataagataatacatgtaaaatgcttgacacattataaatgcataatagatattatttctcttttttctccctttatatttttcctggcatctagcaaacgtcttactagaacaaaagtgtttttatcctctttgttgtattcttcttttatttttcctccaagttatgaagctcaaattcccatggataaagcatataaaatatacatatgagggctgggcacgacggctcatgcctgtgattcccagcactttgggaggccgaggcgggcagatcacgagttcaagagattgagatcatcctggccaacatggtgaaaccccgtctctattaaaaatacagaaattagctgggcatgatggtgcacacctgtagtcccagctactcaggaggctgaggcaggagaattgcttgaacctgggaggtggaggttgcagtgagctgagattgcaccactgcactccagcctggcgacagaacgagaatccgtctgaaaaaaaaaagtgtatatatatatatatgtgtgtatatatatatgtacatatatgtatatatgtacatatatatgtgtatatatgtacatgtgtatatatgtacatatatatgtgtatatatgtacatgtgtatatatgtacatatatgtgtatgtatgtgtatatatgtacatatatgtgtatatgtgtaaatatatatgcacatatatatgcacatatatgtgtatatgtacatgtatgcgcacatatatgtatatatgtacatgtatgcgtacatatatgtatatatgtacatgtatgcgtacatatatgtatatgtgtacatgtatgcgtacatatatgtatatatgtacatgtatgcgtacatgtatgtgtatatatggacatgtatgtgtgcatgtatgtgtatatatggacatgtatgtgtgcatatggacatgtatgtgtacatgtatgtgtatatgtacatgtatgtgtacacatatgtatatatgtacatgtatgtgtatatgtgtacatatatgtgtgcatatgtgtatatatgtatatgtgcatatatgcacacatatgtgtatatatgcacacacatatgtgtatatgcacacatatgtgtatatatgtacacctatatgtgtatataggtgcacctatatgtgtatatatgtgcacctatatgtgtatataggtgcacatatatgtgtatatatgcacatatatgtgcacctatatgtgtatatatgcgcatatatgtgtatatatgcgcatatatacacacgtgcatgtgggtatatattatgtatgtatatgattgagcaacatttttattaggttgttcttccttttttctgtattcagattttaagcttcttagaatagaagccacgttagttctataagtatcttatatttttaaagtagtccattggcatttatatgtttcttagctacctgcattgtcagattcaagttgtgtactcttgaaagcatatcttaaatatttagaatcagataggtaaaaacatgagcattaagtctttgcctttaggtacataagacaaatatcacttgctctcacttacatgtgaaatataaaaattcagactcgtagaagtagagagtagaatggtggttaccaaaggctgagggttggggtgggcagagaaaggaaaaatgttggtcaaagggtacaaagtttcagttaaacaggaagaatgagttccggtgatctattgtacagcaaggtgactatagttaataataaagtattgtatggctgggtgccgtggctcacgcctgtaatcccagcactttgggaggccgagacaggtggatcatgaggtcaggagatcgagaccatcctggctaacacagtgaaaccccatctctactaaaaaattacaaaaaattagctgggcgtggtggcgggtgcctgtaatcccagctactcgggaggctgaggcaggagaatggcgtgaaccccagggggcggagcttgcagtgagcagagatcacgccactgcactccagcctgagcaacagagtgagactccatctcaaaaaaaaaataataatgtatatctcaaaattgctaaaagaatggattttaaatgttcccagtacaaataaataagtgatgtgatggatatgttaattagcctgatttgctcattccacaatgtatacctgtattagtacatcatattgtagtcaacgaatatatacaattatttgtcaattaaaaataaaattaaaattagaaagtctttggcattagggcaggaatagagcctgtattttgataataatataacactcctaactatagttgctaacgttatttatttatttattttttgagaccgagtcttgctctgtcacccaggctggggtacaatggcacgacctcggctcactgcaatctccaccttctgggttcaaacagttcccctgcctcagcctcctgagtagctgggactacagctgcacaccaccacgcccggctagttttttgtattttagtagagaaggggtttcaccatgttggccaggatggtctcgatctcctgacctcatgattcgctggcctccacctcccaaagtgctgggattacaggcgtgagccattgtgcccagccatggtattttttttttataaggagttaaaatgtataatttgactctctttctcccactgaagttcaaactgatgttgaccagtctggataaagaacttgcttctggccttcagatgacagctatggtggaatatcatcctgataaagacgaagacacttttgaccggctacttatttcaatagaaaataaaacaacagaaattcctctaattgggtatgtaatcttcatagttcatgctgacattttgaatactctttaaataaaaatgagggtcaaagtaatattttgtattttttctgacatagtttcctgacagttgaacttaaaggacacatttttagaaaatagtagtgtttgtaagaaatgaaacctcattctctgttatttttatttaaaaaacgacattcaacaattgaatgtattaataattgaatttttgcaaacttgtattcacattttaatttaattttaaagtattgtcaggttcacttcaccaaattttaaattaggcaaatgtttggtgtcaaaaaaatcaaaatgctgttcttctgagactggttgaaaaatatggatggatgtaagtataaaaaagagctaagtgactgacttggttgttacaaattatttaaccaggatgaatgatgattcatttgttgttttttaatattaaaaagtatatttctgttcatcataaatttatcaaagttagtgttaaaatttaaagtgtttctttatttatatacatacatatatgatcctccttttccccagcagaatgtggtttccataggtgttttcttttgcctctatttgcccaccacctacagaattaatttggaatattttctgcggattacatggtattagatatataccttttacaaaattcccttctattcaggctgggtgcagtggctcatgcctgtaatcctagcacgtagcactttgggaggccaaggcgggtggatcacttgagctcaggagttggagaccagcctgggcaacatggtgaaaccccacctctacaaaaaatacaaaaaaaagaaaaaaaaacctgggagtggtggcgcatgactgtagtcccagctacttgtagggctgaggcaagaggatcacttaaacccaagaggtagaggctacagcgagccgagatcacgccactgcactccagcctggatgacaaagtgagaccctatctcaaaaaaaaaaaaaaaattccctttctttttcatttctataaactaaatttagatcctcaattattttgtttctttgtgttgttgagaagttctgatttagcacatcatcccatttttgcataggaatcaaacagtagacacatggtaggaaaaaaacaagctattaacccagtataaatatttaattcgtgttttgcagtttaagtagaaccattttgtatgcattctgcactttgacatatctatgactggcactcagatttgcttgtttgtggtatgtatggagagacaggttgaagatgcttctgtccttgaaaacagagatttttttcttgtttccagagtatatgccctctctcatcagaagcctgtttctcaccatggttgcaatataagaagagcactgcccttcttttggtgtgatggacagggttgaaggaaggtgtgtgtgtgtgtgtgtgtgtatgtgtgtgtgcatgtgtgttattaatttctacacattttttatcacctgcgtaggttcttgtatccaccaccacagtcaagatagtgaacagttccaataccacaagaaagtccctcctgttgctttattacaactgtatctacttcccttctgcctcacacccacgaaccctaaactgtggatactgctaatctgtcttctacatctcaaatttttgtcatctcaaatatattacataaatcgaatcacacactatgtagccttctgtttttttcttgcagcaaaatttcttgtagcaaaatcttgcaagagattcagccaagttgttgaatgtatcaatattttgctcctttttattgctgagtagtattctattttatatatatatatatatgtatatatatatatcacaatttgtttaacaattgacctgttgaagaacaaagggacagattccagtttttagctatcacaaataagctgctttaatattcctgtacaagtattgtctgagcataagtttttattttttctgggataaatgctcatgagtgtaattgtagggtcatatagtaattacatattttgtttaacagaaaatcccaaattgcttttcagagcgcctgtaccattttacatttcaaagagtgatacatgagtaatccacttttacggtatctttgccagtattttttgctttcatcactacttaaaaattttagctattctgatagatatttaatggaatctctccatagttttaatttgcatttccccaatgaataatgatgttgacaacatattttcaggtgcttctttgccatctgagtaccctctctagtgaaatctctgttaatgtgtttttctcattttatgattacattgctctttattattgagttttgcaatttctttgtatattctggatacaagtcttttgatggttatgtggcttgcaaatatgttctcccagtttgaggtttgacttttcatccttttaactgggtattttgtagaacaaaagggttttttttttaaacgttcaatgatgtccaatttatcaattttcctttaattagtactgcttttagtgttaagtctaagaactctttacctaatccttgatcataatggttgaagattttcttctatttttaacttttaaagttttacatttaagtctatgatatattttgagttaatttttgtataaagtgtgatttacattgaggttctaattatttcctatagatgttcaattgctctgaccaaatttgttgaaaaagctattttcctccattgaattgtgtacccttgaaaaaaatcacttcaacataatctgcattggtctatttctgtgttctgcattttttttccattcatctgtgtatccatacgtttgccaacatcatgctaccttaattacctttgctatatagtaattcttaatatcatgtagaataattcctcacgtgttattcttctttgtcaccattagtttagttatcaaaatatctctacctttccatgtaaattttagaataatctttctgagcctgcaaaaaaaaaataacttgctgggcttttgagaataattgagcttagcttatagatcaatttgagggaaatagacatctttactatagtaattctccccaaacatgaatgtgctatgtctttccatttatttgggtcttctttgatttcttttatcactattttgtaattttcagcccagagattctctacatgtgttgttaagtgtataactatttcattttctttggagtgattgcaaataatattgtgtttttaattttggttactgcatattccttgttgctatatacagagaagtgattgatttttgtttgttgacattgtatcctctgaccttgctgaactccctttttaggaggtttttgtatgtttttttagattccttgccatcttatatgtagataatcgtgccatctgtagacagggataattcgtttgtgtgttttttcccattcaaaagcatatgctttttacctttttttctttctttatttccatggctataactttcagtattatgttgtgtaagagtggtgaagctggcttggtggctcacgcttgtaatcccagcacctcgggaggctgaggcaggcggatcacttgaggccaggagttcgagaccagcctggccaacatggagaaacctcgtctctactagaaatacaaaaattagctgggcgtggtggtgcacacttgtaatctcagctacttggaaggctgaggcacgagaatcacctgagcctgggaggtggaggttgcagtgagctgaaatcatgccaatgcacttcagcctgggtgacagagtgagactgtctcaaaaaaacaaaacaaaacaaacaaacaaaaaaaaacagtgagacatcctttcctgacgattttagctgtcagtatttttggatggcctttatcaagttgaagtaattcccaactattctaaattgctaagagtttttattataaaggagtgttaaattttgtcagatgcattttctgtgtcaacttacatgatcatattttttttccataacttagtgatatgatggattacattggttaatttcttaatgttgaatcagtcttgcccttgtatacatgaaataaatccattttagtcatcatgtatcattctttttatatatcctggaatttgatttgctcatgttttattagggattattgtgtcccagtttattagtgatattggtttatagtttgattgattgattgatttctttgctttttttaattgtcattgtatggtttagctatcaggatagtgccagcctcataaaatgaatttggaaatgctgcgtcttctatattctagaagagcttatttaatattgatagcaattatttaaatggtagaattctctagtggaactgtctggcctggaaatttttctttcagaatgttttaaattatgaatttagttttttgatgcttatagggctattcatactgcctatattattatgttgttactgtagtttctcatttccatggaattcttccaactctaagttgtcaaatttatgattttagagctgttagaaattttttctgattatttttaaataaataataagctgctgcatctgtagtgatatcctttctttcatttctgatgttgaacatgtgtgtattttgtcctttttaaaagtattgctagtggtttatcaactttatattttttccaaagaatcagctttctatcgttgactttcctttcattttattttaaattccgttgattgctgctctctattatttcttttcttctgtttgatttgaattaatattgctcttgttctagtttttgatattggaaattagataatgagtttgagaaaatctctcatttctaatgtaaatatgtaacgttataaatgaccctcagcactgctttagctgtgtcctacaaatttttatatatttttattttgactcaattctatgtatttaattttttttaaagtttctctttgactcctggattatttagaagtgtgttaatttccacaggtttattatggacatatttatgatcgttattcctttctggtagattgatccttttattatatataatgtccctccttgtgcatggtgattttcttgcactgaagcctctagtagatattaatgtagctttttgcacttttttttctaagtaaaatttgaatactatgttttttcctattcgtttactttcaccctactatggccttgaatttaaactgagttttttctaagcagcagcatatagttgggcaatggttcccttccccatatttcgacctctgtctttggattgttgtatctaggctatttatatttaagttaatttgtatatgctataatttgtctgcttgtttattatttgttttctcattgttctctttgtttctcatacttctgtttctcatttttgcattcctgtaggttaattgaaggttattttagggttgcatcttgatttatttatactgttttgtgtgcatctctttgcataattattgtagtggtttttctggatacttcaatatgcatacatgatataatattctagtggcataaacattttgtcactttaagtgaagtgtagaagcttcatttccatttgagtctttttttctttccctacttttaaatattactgtcttgaatatctaagggtgttatgattcttgttttcatcatcaaatataatttataaaacttatgaggaaaaatatagctgattgtatgtagctagtgctttgctatttccattgctcctccccctctccctccctccctcctttccttccttcttggcttcctccctccctccctccctcctttcctttcttccttccttgcttccctcctttctcttttttgaggcagggtcttcctctgttgcccaggttggagttcagtggtgtcaacatggctcactgcaacctcaaccttctgggctctaatgatcctccctcctcagccccccaagttgcttggactacaaacatgcaccaccaagcctggctaattttttctttctttctttttttcttttcttttctttctttctttctttctttttttttttttgagatggagtctctctctgttgcccaggctggagtgcaatggcgcaatctcggctcactgaaacctccacctcccaggttcaagtgattctcctgcctcagcctcctgagtagctgggattacaagcacccgccaccacgcacttttaattttttgtagaggtggggtttcactatgttgtgcaggctggtctgaaacttttgggctcaagcaatcctcccaccttggcctcccaaaatgctgggattacaggtgtgagccaccatgctcagcctgctccatttttttctttctgatactccaagattctctcttttattatttcctgactttctgaagaactttattatatttaattttttttttttgagacgcagtctcactctgtcgtcaggctggagtgcagtggcgtgatctcagctcactgcaacctctgcctcctgggttcaagtgattctcctgccccaacctcctgagtagttgggattacaggcacgtgccaccatgcccagctaatttttgtatttttagtagagatgaggtttcaccaggttggccaggatggtctcggtctcttgaccttgtgatctgcccgctttgacctcccaaagtgctggcattcaggtgtgagctgccatgcctggccatatttaatttttatgggtgcatagtatgtgtatatatttaaggttcacatgagatattttgatacaggcatgcaatgactaataatcacatcaagataaatgaggtatccatcacctcaagcatttatccctgtgttacaaataattcagttacagtcttttagttattttaaaatgtacaattaaattattttttactgtggtcatcttgttgtgatagtaaatactaggtcttattatttattctttctaattatatttttacacgcattaaccctcccccttcttccccacccccaattacccttcctagcctctggtaaccatccatctactctctatcttcatgagttcaattgctttaatttttagatcacacaaataagtgagaaatagaatgcttgtctttctatgcctggcttatttcacttaacataatgacctccagttacatctatgtgtaaatgactggatctcattttttatggctaaatagtacttcatcgtgtatatgtagcacattttctttatcagttcatctgttgatggacacttgggttgcttccaattcttggctactgtgaacagtgctacaataaacacgagagtgcagatatcccttcaatacactgatttattttctttgggtatatactgagcagtggaattgctggatcttaatggtggctttatttatagttttttgaggagcctccaaactgttctcctttgctttgtggttgtactaatttacattcctaccaacagtgtatgagggttaccttttctccacatccttgctagcatttgttacttcctaacctttggataaaagacattttaattggggtgagatgatatctcattgtagttttgatttgcatttccctgatgatcagtgatgttgagcattttttcatgtgactatttgccatttgtatgtcttcttttgagaaatgtctattcaaattttttgcccatttttaaatttaactattgattttttcctagagagttgtttgaggtccttatatattctggttattaatcctttgacagatgtgtagtttgcaaatatttttcccatactgtgggttgtctcttcactttgttgattgttttctttgctgtgcacaagcttttttacttgatgtgatcctgtttgccaatttttgctttggttgcctgtgcttgtggggtgctactcaagaaatctatgctcagtctaatgttctgaagagttttctgggtgggtccagggggtaccatccaggaacaagggactggggtaaagtaccttagaagtctacctattgtactgtggctgagctggtactcaaaccacaagacaatgttcttcccagtctttccttccctttccagaggcagaggcgcctcaccctatggccgccaccaccactggcccacagggagtactgccaagcttactactgatgttctcttaaggcccaaggtctctttagtcagcttgtggtgaatgttgtttggcctgggactcatccttcaggtcagtaaactcccttgtggcccagggcaggtccagaaatgccatccaagagttaaggcctggaatccgggtccccaaaggcctgcttggtgttctatacctctgtggccaagctgatacctaaggtactagatacaacccttttacttttccctccacttatgtcaggtggaaggagtcttgccctgtagccaccacagctgggaatgtgttgaatctcacctgaagccagcaagtttccaagtgtcacccaaggcccatggcacactacttaggtatcactgcaggttactcagggcccaagggctctttagtcagcaggtgatgaatcttgccaggattggatccttcccttcaaggcaataggtttccttctggcccagggtgtgtctagaaatgttatgtgtgagctagggcctggaaaggtggcctcacacctctgactggtgctctatcctactgtggctaagctggtatacaagattcaagacaaagtcctatttattcttgcctcttctctcctcaagtagaaggaaggggtctcttttggagccatgagctatgcagcctggagttggggaaagggttggcacaagcactcccctagccacaccagctggtgtcttagtaggttgtgtgtctccccatgtccactgactttgaccccagtttaacactagaactcatctagaagttgcagtccttgtggcctagactgcctttcaagttaatctatggtcccagagcatgttagctcatggtggcaaggcttgctagaactcaagtcgtgaccactgggataggtgattcctctctggctagtgctggtttaaatgttccccccatgggcaggcatcagcttagttcccctgttttactttctgctgtgacagggcagcagtgagttcaatgcagtgactcacaattgctgtgatcttcctccctcaaatgcacagattctctctccatgccatgctgccactgctgggggttggggagggttgacagaggtgattcaaaactgtgtttcctacactcttgaatgcctctttcagtgatatgaagttaaaaccaggtactgtgagtgctcacctgatttttggtttttacgaagttgcttttttttttttttttatatagatagttgttaaattggtgtccttgtaggagggatgataggtggagccttcttcctctgcccacttgaagaatttttttaggtgatctttaagtgtgtgtttgctagtgacaagttcttttagtttttctttgtctaatgtctgtatttccccttcattatcaaacgtagttttaacagaaatcgagttttcagttgacagttttctttttctttcagtactagaaaaatattgtgacacttccttccggactccatggagtcagatgtgatacgtgcattcatttaatttggtgtttctctatatggaacacattctttctctctggctgatttcatgatttttgtttttatcttttgttttcaaaagttcaattatgatatgcctttacatgattttctttgagtttatcaggtttgggttcactcagcttttttgaatttgtatgtcagtgtctgttgccaagttttggaagttttagccattatttgcatttaactattatttcagccccattctctttcttctgttcttctgagactttaatgatgcaaatattggatcatttgttattgtcccacaggcctctgagactttgctcatttttttctctttctctctcagtctttgtcaagtctgggtgaattctattaatcgagcttccatttcactcattttatcttctgttatctccatcctggtattgtgttcatcactatgtttttagtttggttgttgtattattcaattctataatttctatttgattcttttttataacttgtatttatttgctgagattttctatttattcattagtttcaaaaaaacttgaaattgcttgttgcagcattttttttttttttttggcagttgctttaaaatccttgctagataatttcaacctgaggttcatcttggttgacatctgttgattgtctgctctcatcaaaatcgttatttttttggttcctgatatgacaggtgatttttgattgaatgctaaatttttttttctgttatgttaggagactctgggtcttatttaaatctgttattttaacaggcacacaccccatttatgttcagcatgtttttcttagcctattttgtatgctgtggttgtgatgacaatttagttttcagtatgtttgaggtattattttgatccattttatttatatgttatcactactgctcccactgtcttctgctggtgcttcctgaaggagtggaggcatttttttttcccaggcctggctgccacatgtctcttgatagaggagaaatgtggtgagaacgctatacaagtacccccttggctgcccaggtcttctgagcagatagaaaaatctgacttatggggcaaagaagtttgttgtactgggccagttgctgtatctagatctcttgcaagtcccgcttacctttccagtgtccctgagtgaaaaaggagaggtttgagccagcagtgacaaagaggcttttcagatatagctgcttgcaattgctgtttttttttttttttttttttttttttttcctggtttcctcaaaactaccttggtgtctttggacagaaaactcctgagaaagagaactcctcttctgcaggatctcaggcctggagtagaaggagagtgcttccccttgtcacttatgattggtatacctcttaattgatccccaggctggcattgtctggctcacctggtgtgttcaggggggctcctgtttgatccagaaaaagaatgattctaactaggtcagcgggcaaagaatactgggtctgcgtggcctttctctgttggttgggggattgtgagacaccctgctgctattgttcctccagtcccagagttctaaatcagccagttctccttttcaccacctttcatcattctcttttgcttgcctcgtgtaccattttcagggtttatagttgtgtttagtagaaggaacaggaaaaaataggcttatgctatttttttctggaccagaagtttgtatttgtttgtttctctccattagattgtaaaattcttgaggtccaggggagttttatttttttctataatctaaattgtatatactcagtgaatgttttgtgaataaagttagtccaactggatctgaactactccctaatggcatgactggaatgtgattaaaaaaaactgttggagtgagcacatttatttttacttcagagtttctgtatatggatcagacatgtaatgaaccttctatttgttatggagtgaaccctgaaaaaagaagaaagaaaacagaaactacatgattgatttctacattttcgtacatcaacctggacttccaaagtgccctagttggtagatgatataattagtgattttcagagcttttttttatgtgtctcccaaaactatgaccttcttttatatttaaaaatatctacgattttcatcattagtttgaacacttgtaaagaggtaatggcttatatatagtgagtgttacgatttaaaaataaaatacttatatgcctttttaaaatgtatccagtagaatgaaaatatcaataatatgttagcaggtgaaaaaattacctcttttcttttcctcttaaatttgtagctccattccatttttcaccacagcatcacatcctaatgtattacatttttatgcttagaagtttttttcatgatcaccaggaataaagtgcataggtaatttgtctatagtttatgtctatataggtatatgtacatatgaacctatatgtgtgcatcaaataaacagctatatgtttaaatatacttgctatagtcataaatccatgcatatttttaataattcttataaatgatattattaatacaaattgatttaaactccatatatcaaactaagtttgacgagtttttttttaacagaaaagcaaagtattactggaaatatttataatcagatgaatggagcattttaaacttttatttagttagcatgtttatggatgatagatacttattgcttatgtgaatcccacatgcattttatccctatttaaaattttttgatatggatgctgagagaagttgtctccataatgagtagattggaatgaaaggattttattgtagtaatatctctcaattttttcaactccgtaaagttatagggtaaaattacagcagttgtttatcaagtgttatttttaacaatgtgtcagctacgtcagttgtattcccctcttttaatgttgatgaaagaaaactggataaacacatttatgtaaatggatttgttacctagtaattttggtcactcactttatcaatatcaacaccaatattttcaattgtcccttagtttggtgtcccagagatgtttccactccaaagcaatgcatcaccattaaactaagaaaagatgacatctatttctccttttgtataaataaatgggagaggaattgtgaaaaatgggctgagaaaacaaaatatgcatagacctctttgttctatttgtatcagcaaatataccgaatgagatagtaaaatgagaagatgcctttataccattggaaggtattgtttacctattagggcatccctgagtttaatgaccacttgtacttagccttgttgtgtttgtcattctcttcttttctagagattccttatactattgtccttattttttttaaatttaatttaattttattattattatactttaagtttaagggtacatgtgcacaatgtgcaggttagttacatatgtatacatgtgccatgctggtgtgctgcacccattaactcgtcatctagcattaggtatatctcccaatgctatccctcccccctccccccaccccacaacagtccccagagtgtgatgctccccttcctgtgtccatgtgttctcattgttcaattcccacatatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggaatcaccacactgacttccacaagggttgaactagtttacagtcccaccaacagtgtaaaagtgttcctatttctccacgtcctctccagcacctgttgtttcctgactttttcatgatcgccattctaactggtgtgagatggtatctcattgtggttttgatttgcatttctctgattgccagtgatggtgagcattttttcatgtgttttttggctgcataaatgtcttcttttgagaagtgtctgttcatgtccttcacccactttttgatggggttgtttgtttttttcttgtaactttgtttgagttcattgtagattctggatattagccctttgtcagctgagtaggttgcaaaaattttctcccattttgtaggttgcctgttcactctgatggtagtttcttctgctgtgcagaagctcttgagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaactattgtccttagataggcacttcctctgatagctgactagatactctgttgtcctcagaggtcaactgtctttatatgctgtggtgtgtatgaagccaaaacaagatttcaagatttttttacaagaggaagagaaactaacaggagatgcagagaaatcattatatattaccaaaatcttaacactgaagtagactctgtctctctttttctctctcccccgctctctctctctgtgcgaagtgtggagattcctaagaaattattcttaagaccttttcctatatccaaagtatgataatatacttaggggtactttttaaccatgaatgtctagccaaatagaaaatgtatgtaaccttatatggtttgtatataagatgataatggatttttacaaacttgtaggaacacatgctacaaatatgctacagtgaattttttagaaatacatatggaaaataaattgtacttacattttgtaagtacttacatcttgtacttacatcttgttttagaccctaaatgatatgttacagcatcactgcattcttttatttcataagatttggagacattcaaactatttatttgggatgacataccatgcacttagatgcataaagtctcatttctttgttaaaaatgtaacccattaccttgttttcatatctttatttcataattccttttattgacaaacatgccaccagtagacctgtaaataaactgaaatgtcttttaagggcttaagtgtccatctatattcccctacatatttagctatcaggctcttatgattgttaaattaattatgtggccttcttttctcctccctaggttgattccatcctgtcaattggaaattgaatcagtagttaattttggcacactggttgccaatagtaaagtatattctaaagagattactatcactaaccatggcaaagctccaggtaaatccttcctgtcatatttacttacacttttagaagagttggtattatttgaaatgtataccttgtgtaatagattacctaatttaactgaaaaaaggtctatcatttcaaatagctcaaaaccaaaggtccttaatagtattactgtaaaagactgataggcaacaattcaagaaaaatgaaccttcctccttatgatcctgattaatacagtcagaaaatggtgaaatccctcaggataggaggcaggatagtgtcagagaagttacatagttcagagacagaattagagcacagcgccttattagttgtgtgatctggggcaagtatttttaaggattttgaacttgagattcctcatttataaacgggtgctgataaaatgtatgatgatgaattatgtacatactttaaactgtggtatgttacttggctcatcatagatgcttaataaatatttgtcttctttctcaatcatattcaactttaatttaatgtcaaactccccagaaggcttttactaattcttttttgaaggaataaatacttctctcttttccagatttaattatttccagggattcttactgtggcctaagagtttacataaggatgtgtgtgtgtgtctgtgtgtgtgtgtgtgtgtgtgtctgtgtgtgtatattcatatacactttaaattgatagcatacaataagcataggattgcttatcccttcagtgtcctgattcaatggcatgtggggttgcaagattgccatttctcccaatctaaaatgaggactagctccagacagggagggtatttctatctgagactgtttgttgaatatataaagtaggtcttaaatccaagcttctattccactaactgagagtgttctctggggccacctgattgagcattgggaattatgaagacaaaggcagtctgtcagtttactgatttcttcttaggatacaaaggaataaaactcataaccgttccacattggatgttactcatctcactttctatgctttggtttttaaatgagtgcatgtctgatgcctgtgggattatagaattaggctcgtttgtggcctgactcgagtgttaaggaggaagtctcttacagcaagtgatatgggcaatatgatcctttagactctctagttatattttagagcactgatatttaattaaggtatttttatttgtattattttactttccagaatttcttttaactgttgtatattcaataaccttcaatgttttgatagcaataatatattcccttcttgttctaaaatctcaccaaattttacagtttcatttcatatgaaaactctctgtaagtaaaaaaggaatatggttttacttttcattgaacatttaatataattttactcaataaattagaataagtacaattaagctgcagaccagaatacataatgttttaggaaaaatactgcgcattggctattaggattatgttagtattttatttgtatatagtatttgtaataccttggttgggtttattatacttgagtactgtgaaatgttaatggctattaccttacaaactgaaacaaattgtgatcaatgaattacattttcttagtgttgactttatcccacatgcttggaatcaaatcagattattgtttctactattatcaaaattgatactgtatattacattcagattagctagtgcctataaagtgtcataaagtccttatcatctacaagcaaaatatatacgtgttcatgataatagcaatgtatattcatgaagaaaaacattctgaaaatagattcagccatcaaagttgattttaataacatttttaaaaaacattttatatggtgaattttttgtaggtttagagtcaaagttcaaatgcttacaaatttgtatgtatacttaataggatatttaaaactcaacacttggcagatttaacatttccacatctttgttttctctctctggtagtatcactgcagttataacctttgtttttatagacccccaaagtttatgtgtgtaacaactccttgatgatttattttaatagtctcttatggagtaaacatccatggatctagccatatgttgttgaataacttttgtttcctcatcctttatagaaatggttcccaaatttacccctgactgtacaaagcagtgctcatcttttctttctgaagacatggtccattctttatggtgtctctaatgttagtactttgtaggttaataaattccatatttacttttatgattttatggcttgataataccactattgtttctcagcttttatcactgaagattagaaaaagaaattattaatttagcatgccttgaattaaaatcatttcttccttaatgtgagcatacttatttatttattattttttaaaatttttgtgggcacatggtaggtgtatatatttatggagtacatgagatgttttgatacgggcatccaatgtgaaataagtacatcatggagaatgttgagtagactttttctactacagtattataacatagaacagtttctcaaattcctaagtgagagccttacatatcatttctgagtttgaacatctgcctcagaacttatcatcctttaggtttatttggtctactttgtccaaaatatatgacctttcatttgctcttaaggcccactctgccttttcccctaatcagcagcatcatttctctacttcattgtctaaaatatcctggaatcaactgtaaaccaggaaatttgtcaaactgtaccaaacccagaagtggtcctggggatcttccttagtaactcacaaaagcaccccctacttattctcagtgcataattcttgtcttcaatttttttttggaaactgatgccatggcatctccatatattcttcatgcataacataaccctaatttataggattatatattttgacataatcataatttatttggtttagtgatttcttggagtttcactaaagaactatgaagcttttaatgaaagatgattaaacccagaaggaacctgttaaatccatatgagcattctgaagaatctctaaaaattagtcatttggaaacatgtggagcctcatacatatttagtgtgcttagaaccaagggaattttaaaaaatcataagaaatagcaatagcctggggtacatgacaactgatttttaataacattctatagaactacagaatctggttaccctggcttgatcttacagatactctgaggcaaaaatctgcttagcagttcctaaaaattttttcaaggagtatagacagtgtaaccatgtatactgcaccacttagtgtctaatttgcttctctagagaagatagaagaatccagattcaaaaatcacacagatttgtgtgagggacccctcatcgcagctgtagctgtgggtacccttatgttttatgtgcccccactaactcttatcagtgggcaagtctataggtctgttttacatggcttattggcaaaagttgacatagttagccactgccactttcttgggaaaacaaaacaaaaacaattcaaagccctttggcttctgtgacaactcactctcttatatagaatgctaattaataactcaggtcctgaagtgtggttgaatagggcccaaatcttagttgcatcatttactatctgggaggccctgggtaaggaatttgcacttccaaaacatccattgtctgacttacacattagagataaagatagtaccttcctcctctaatggtggtgatgattaataaaatgcttagcacactctctggcatatataacttttcagtaaatgttagctatttatgttataattattatttttctaccacctctgccctcttcagttctctttcctagactggtgtttctttttgtggtatattaaatgtgaatgtttcctaaggtttgccacagactcttatgtttcttcagtcaaggtactctccttggaccatcacttcccttccttttacttcactgactactcctagatctatacaatcctttgggtatccttcagttttctcaaacttaacagcttcccccaatacttcttttttctttgtcaattaatgttaccactatgtatttggagagttccaaaacttggcaaaattttcaacacctctctctttttcacttcctacccccttagtcaattagtaaatcttatctgttcacttcataattaagccagtaatactacttttctctgcccaatgccactttttttacaaaaagccattatcttcccctgctgaataactacattaacctaaattattttcctgacgttacttccttttagtttatttcccacacattagccagtgccatatctgagaagaaatgaaaatttgatcacaaatattccatttttaacattcttttttcttcttcttctccttctctttttttttttttttttttgagacagagtctcactgtgtcacccaggctggagtgcagcggcgtgctcttggctcactgcaacctccgcctcccaggctcaaccgattttcctgcttcagcctccccagtagctgggattacaggtgtgcgccaccatgcccagctaatttttgtattttcagtagagatggggtttcactatgttgaccaggctggtctcgaactcctgacctcaagtgatcctcccacctccgtcttccaaattgctgggatcgcaagcatgagccaccgcacctggccaacattctttttttcaataactctcttctcttaggatgatattcttgcttctgttgttagcaatttaaaaagccaaacaaatggtttttgtattaaagttaaataagacatagtaatgttgacatacctgcaatttaaacatatttagaaaattaaacaatattcttttgtattttgtgttgcttctgaataagtttttgaaatattcacttaaactcttttgtcaaattatgtctaagtagttacaatatgggaaactttttcactgactcagtcctaactaaatttatatacctttttttcttacagaatggagtcaataatacctatttatttgaaatggatataattttatatatttttgatttatgatataaaattaacttcaaatattatgctgttagcacatctatgaaatgattgaagtgaccaattttgttactttgcattttcaaatattgtctttttaatattttcattacttttattgtgctaacattttgttttcctaaattaaatgaatacatttggaaaatatcatcagatgtgatttaagactggtgatttcagaatttgccaaactgtttattttagcaccatgctcatttgtgttataatgataataaagggactagtgattggctgcttctatttgttggccatactttaagtactgcttagtgctaagcagtgtgtggggtgctgtgaccacagacatgagaaagagattgtatctgatttcaaggaccacatgctgtaatataggcacaaaacattaccataaattatgaaccatttctgctttcagaataagaatctttgtaccctccttctcatatgccatttgatttcagaaaccaatcccctttgcccttatcctgtgtgaactggataaattcatctcctagggaatggtaataactataagtatgaacctgtggtcagaaatatccaagtgaaaatctcatcttcattagttagttactaactgtagtagttattgctatataacaaaccaccctaaaatatcttcaaacagcagttattttttaattggtcatgtggttatgtgtatgcagattggctggaacttgactgatctaggctgggctcatctgggtgctctgcttcaagctgaagcagctgggcctgttctgtttctcactgcaggtctgtgggtcagctgggtggctctgctccacatttgctcattctagggcatgggccaaaaggacagcagttactcaggagaaacacttcccaaagtcaaggggcttgatcatgtgatttgctttggctaataacatgtgggtgtaattgatagcatgccagttccaacctagatgcacttctaccatgggaggtgggaagtgttttatcctgtgtaattgctgtccttttggcccatgccctagaatgagcaaatgtggagcagagtcacccagctgacccacagacctgcagtgagaaactctggaacaatagggtaaagatacgaatgtggaaaaaggtgaagaattgtggtcagcaagctaatctaccacagtagttgtgtgaccttgaacaagtcattcatcatttcaaaacttctattttgttacttgtaaaatggaggtaatgattgaaaatattatatcatagattatttacggaaattaaataacctatgcagagctcttaacataagtgtctgaacgtagtaagcagataattttaactattggtgagacttgaattctaacaacaggatcatatttgttgggtgacctcagatattggacttacaattaaagctttaattcttggtacactgtagaccatctgctccaggggtattcaatcttttggcttccctgagctacgttggaagaagaagaattgttttgggccacacatcaaatacactaacactaatgatagttgatgagcttaaaatgtctcaaaaaatctcataatgttgtaagaaagtttatgaatttgtgttgggctgcattcaaagccgtcctgggctgcatgtggcccatgggccatgggttaggcaagcttggtctactgggtaaagtatgttggtcccctactgagagtgtacatgcaacattgtaagggtccagatgtaaatcaactgctcttattccctataggcatatttaaggcagaataccacggccaattacccatcctcatttttccaactagtggtatcgtggatgctaagtcatcaatggttattaaagtagatttctgtgcagaccagccaagaattgtagatgaagaggcaatgtgagtatatactgtggttctaaaaattataatacagatctcaatgctttcccgtttaaccctgcagatgtgactttgattgtatgttagctcctttgttcttccattcagcgttgttcattgagtctctactatttgccaagcagtaggtttttaagaaatgggaagaactagaggatagcatatgggtacacataacaggatcttctattttgaatttcattgaggtgagagagtggaccagggaagggctccactaacaaggtgatagttgaatcaaatacttactggtgagtagtaattagccaggcaaagagcagtgatgtgatttggggtgtgtgtgtgtgcgtgtgtgtgtgtgtgtgtaggggtggtgggagttagtgatgggagtagcatagaggagggatttcaggcagagcaagtaacatactggaaatcctagaggcaaaaagacagtgttgcacaccaaggcatctttggcaatgtagaattaaaaagatggaggtggggagtgacaggagacaagaccagaaaaaccaaatggaatgtctagtttgaagggctttgtagtccaacatttttgtgcggtatgtcttaattcattgctagaatgtgcagtcaatataatgagccatcaccagtatttttaacaaacgacttaaaaatatcagaatgcatctgtggagtgtgtgtgtgtgtgtgtgtgtgtgtgtgtgtgttccggcactggaatataaaatactttttttactgaaggtcacagccataaatatgtgataaacaggtgtgaaccctgataggagcttgggttttattgtgaaggctatgaagtcttaggagggttttaggatgagagtgtcatgattagtttgtattttagaaaggtcctcctagtggcagtgtgcaaaacagaccagggagtacaaatgtggagtgagaatcttgactagaaattacagtaaagcaagaggaaaatgataaaggtctgagataaggtcaactgagaagactgatagaagtgtgcaaattggagataggttgtagaagtagatttgactagatttggtgactgattgtagcaaaggaagataaaaggtggaacagggttatgggagaggatcttaaattcagttttgatatgttggaatggttttacttttcagattcctggtggagctggctgcagcttattaaattatcttgagtcccagaaagaaatttgatttagatgtacaagttgaatgttccttactcaaaatacttgagatcagaagtgttttagatttcaattttgtttggattttggaatatttgcattatacttactagtttagtaaccctaatctaaaaatctgaaatccgacatgctctaataagcattgcctttgagttttatatcagcattcaaaaagtttgggattttggagcattatggatttcatattaggaatactcagcctgtatagggttgaagatcatcagtgtataagtggtagaagaaacagaagtgttgagaataactttgagaaggagagtagaatgagaaacagtaagagaaaaaacactactattcatgttaactatttatcaagtttaaaaaaggtcccagtcttagaagagtgagaaggtggggcctgagtgagttaaaagaaaaccttgaaattatggtgtcaaggaagctaagggaggagcaattcaatgcccaatgttataggatatagtgtaagataagggttaggtgatagttgtggagtagtcagttatctgtggtatctgatgggcctaaattgaaagattgcatttatgccagagtggaataaaatgaaagagcagttcccaaagagaattgaaattcatttgagaagtgaagttaatggggaaatgtttatttcagcaaagaagtgggatttttgtttcgttttggttttgagatggggtctcttcctgtcaccttgactggaatgcagtggtgcaatcacggcttactgcagccatgacctcccatgctccagcaattcccctacctcagcctccagagtagctggaccttaaggtgtgtgtcaccatccctggctatttaaatttttgttgttgttgttgtagagatagggtctcactgtgtggcctaggctcgtcttgaactcctggactcaagcaattctccctccttggctgcccacagtgctaggattacaggtgtgagatcacacccaggcagcagtgggttttactgaggtacgttagattgtaaggaattgaggtgtaaggatggggatgagataagctgttggacttgggagatgagaagaattagaaaagaatttcagaatttgagagctagaggtaaccatacaaatcatttaaataattggcaatatgaatatgccattgagttttttctgggttcaattcatgagattgttttacaactttactgtttcctgaagacagtgaattaggctgcacatatgccattccattttgtagattcagatatacagaagaacctgataacctctggtatgtacgtgaaaggaactactcttaggctactgaattttaatgataatgtgattctataaagtttctgtttgtcgaaatgtgtgggagaaaaacaaagtatatagaattctaattaaaatatgtatgtatgtgcatatcttattatcctgtagagtgattttgcaaggtcaacctgagatgctcttgagtatcaaagctcatgtggttgagcagattattgaattattaagcatgagtagtgacagaaggctggaatgcatacactttggtcctgttttcttcggatcatcaaaaattaaacatgcacgtgtatacaataatagcccagagcccataaattgggtggccatcatacaagatgatgccgtgggagaagaattggtaagtaagtggtgcgacagggatatcagatattatgacttaaaagagattgtgttaaatctaataataaccaacaagctttttaattattcaaaatatcttttaacatgggcagatagatttgattttatgtgtatccaatagcaacctcaaaaaattcagaaattaagctaacatttatagtaatatatatctgaagtaaaccagacaagtgcttcttatagatcagtggctaattgaaggtatttctgttctcatcaattttttaatcctttttcaaattgtatgatgtgccttggtcaaatttatgtgtaaatgttactttaaagatagatatttgctatttcctagattctggaatttcaataattattttgtaacctcctcaaaaatttttttgtgttttgccttaatactcttttatatctgactttatattacagggtacagatattcaacaaagaacagatattgctttaaataatctcacctacataagaaaaataaagaacatagatactactatcattatctcctgtcttcctaatgaagggactttacaaccttatcaaaagactgtaattacattttgtttcaccccaaagtaagcaaaaattaatttcattgtaatgttaaatattaatggaaagtatattaaccacactttaatcagattcactttaatactataatagtaaaacttgccagaaggcacaagtcagatttttcttgtcatggttctagatgtttctaacatggttagtaatatttctaataattctaaatatggttctaaatacttcatgtaaagttaaaaatatccctagaccttgtggaaatggggtggtggaagtgcaagttttgagttgttttggagtgtggccccaaattgtttgtgcagtcaagaccttgttgtccccacgaatagtcaggtgcatgcagcatgtcgtaggtccctccaaagaggatgcaatacttctggcagggcagaattattgctgactatcctaagtattaaacctatagcaccttccagggatcagtcaaacttgtttgctgaaattcatacagacttttagcacttaagccagtgtacatttttcataattccatgaactttgttttgttattaaatttgaagagcatgctgttttaaatatataatagcaatttcagtgacaccttgataagttgtaatatgtgtgaactgattcaattgcaagaatattttcccttgtttgtgagagggtaatgtttaatgtacttcttgtttgtggaacagggttgcctgttgaagattgagcttgctttaatttaaagaggttaataaatcaagtaattgttctatatgtaaatccacaattgccttattaatgataccttcatacaagtagtttctttggtgaatctgtaagattctgtttaatacacaatctttgaaatttgaaatattctattcttttttcatggcagcatgttaacttgagagtctagcatagaatcataggtatatgtatgatttgaagtcttagttaaatgtgttctgaccacactatttgtattcatatttaatattacatgtcagtattttgtaaatgtagttgagtttgcactactagagagctgacctctaggtaaggcaggtaaaaatagccaatgagcagacctatgacataaaccatctctgcctttactcctatttcccttcttcctagccttcctttccttttctcctcaaacaaaatttaactgttagcaattcgtgttctccaaattacttgtccacaacaagagcatggctggcaatatgcacttagtacattggggaagacaaatttgtaacaaatgttttttattatgcccaagagtaagatggactattgtaaagaattaatcagagtccttagttagagatgaattttgtctggaagaaaattctttgcagagaaagtggcatttgagctagaccttgatgacttggtatatttaaattactcttgtcttgacgatgttggcacgaactcatttttctcagctttatactctgtagccttcttttggcaaatctctctggctgtgcagtaaatttggataatggattacagttgtattttcattccttaacattcatttgcttgcatagatttaaagattggattgatatttcctcttacaaggtgataaagtatatcaactttgctttaaaaataactcattgtgatttttttacaggctaatggctgttggtaaaaaggatattggaccttcatacagacaggactatgctctctttttgagatttgagtccgtaggaagtaaagatggatttttgagagatgatgactataaaaccatcaaaagtaagtgtgaaattaacaaaattatcaaatccgtagccatttaaattgtttaaaaatttgaacatgaatatctgtagagacaatctaataaaatatataattattgaatagaaaaaaaagcaaacatgttcaagagaccttaaagtgtcatctgtggcatgttaagaagtcaacttcacaatcatttacataataattttccaggttggaagttaggttataattttaaatgatgttagataaacatgatgatctagggtttaaggaataagaaaaaaaaacccggatttgttttctatgtatgcctaggttttttctcagggattggtatggggacaaatgaccctttccatctctactaatccttcagctctcttagaatctacaaataggaacagtaaaaaacaagatctagagatctagttagtagggtacaggacagtgttattggatactgataattgcacatgttttgcaggccacatgtcaatatgccttatatgttttatattctcaggttatattaggttggttatagtgaggaaaaaaatggaatgggacttggagttcagcttagcaagacagatcaaagagaaaatagagaattaggaaggttaggaatcaaatccaggaaaatgaactataccaaggagggattagatcaccatcctggatatttatgcaaatcgagtgtgtcagtataagtgatattgagcaggatttaactgtattccttgggcataaatggattgttctgttactatttatattgtgttttgtgatattgagctacgtctgctgatcctagacagcaatgagaattccacatttgtacaaagtttacaggttaatccagttttgaatagccagggatggagttactaggtttgccttaaagataatttagtctaagattggctactaagagcattagtgaaaaaatgcaaactctttttctttggttctagttacactgctctctctctgcaaaattgttcttctgttatcatctttctggtttcccaaaaacttcatgtttatatttttgcccagcttctattccattgtccattattctaattattctttttcatgtgcacttatatctgttggtctgtctcccacaatgactgagtgaaaagcctctaattctatgaaattcagctttcagcttacattgggtctgcacatgggaatctgattgtgttggagaaaaacatacaaccttgttgagaggtttcactttgtatctgtaatcactaatcccaagtgagttctttaagctgtttggcattccctattgcattcacccattcattcactcttacacaatctgagatgaatatcacacaccttttattctctcctcaagtctccactctttcctccttcgtcttcacttgtaagcttgaacacagagtggtctagtagacatttccataagaatatctactagttatctcaacttaacatgtcccaaacagaactcctgatttttccacaaccggctcctccttcagtctcttgtttcaagaaatggcaattccatcattttggttgctaaggcaaaaaacttagagtcatcctttatcacttcttcatttccctattctgtgtccaatatatcagcaaatcttcttaagcctaccctcaaaaatatatctaaaaatctgacaatttttctccatttttctactcttctcctccagccatttgttctttaaaggcgtttgaacatgacagacaagttcctgccctagcgtatttgtgcttgctgttctctctgcctggaataaacttttcctagattttcacatttttttccagactccctttatatcttggctcaagtatctccctatcagagaagcctttttggacatctctacataaaacagaatccccaagaccttgtactctgtctcaacctgtcttacctttacccataatacttattttctatgaaatgctgtgtaaacatataacattatttggttgattattgtcaatgtcacctcactagaatgtaaagtccgtaagagcaggaatgttgtctcttttattcactgctgtatccgcaaggcgtgacacagagaagacactcaataattgtgttgaatgaaaagattgaatgagctacccaatttgcattaggtatttcagacaacaaatagactaagcaaatatattctggattccccaaacactttttatgttcaacagctattattgcttttacaggtgaacgatttcagaaagtggaattagcactgacaggcacaggacttcctgttttactacagtttgatccaggaccagttcttaattttaaaccttgtttcatgggtgaacgttcagaaattcagtgcatcataaaaaatcaatgcgaattacttcctgtgacgtaccactttaaaaaaactgcaaattttgaaattgatcctgaaaagggcaagattactggagggggtatggtggtaagataatttttctttgcgtttacatggcagctaacattttaaggtgtgctaaaatgctatgcggaggattagaaacaacatgtgttctaccagtgtttataaattgtttctcttctgcagcctagttatgaagatttttgtattggtactcatatagaatccataatgatttgttaagtgcctgtcatgtgccagtgaaagcatttggcactagggaatttaaagaaatgcaaaacatagttacttcctctaaaatattagacatatacacaggtaggtatggcttaaggagaatataaaacatgttaaagttgtaacaaggtgatatagaaactcaaataacagaatgtttacttctaaccagatagaaaggtctccataggagagtaatgtatgagccagacattgaagcttgagtagaattttgaagtttgaaactggtgatatttaccaggcctagaacttgtactgctggtacaaagcagaaaaagagaatgccaaggcatacctgtgagcactaggtcagcttctggttgtcaggagctgtttttctcttaattgctgcacaggtaactctttcccatatcctctaaaccatgggttaaaagacgatggtccacaggtcaaatatggcctgatgcctgttttggtaattagtgtttttggaatatagccactcttatttgttcacctattgtctaaggctactttcatacaaaaagacagagttggctgggcgtggtggctcacacctgtaatcccagtactttgggaggccgaggcaggtggatcacaagtcaagagatcaagaccatcctggccgacatggtgaaaccccgtctctactaaaaatatgaaaattagccgggcgtggtggcacatgcctctagtcccagctactcaggaggctgaggcaggagaatcgcttgaacccaggaggcagaggttgcagtgagccgagatcacagcactgcactccagcctggtgacagagtgagactccatctcaaaaaaaaaaaaaaaaaaaaagacttaagtggttgtgagaaaacctatgcctcatggagcctaaagtgttcactgtctggcaatttacagaaagggtttgctgaaccctgccttaaatatagcaaacatgagtgctttcagtttctcctcagtttcttatgttatcatatttcttccactgcagtgatgcagttcataaagttattgaaggaagctttcttccaattgcaattaagaactattgtatacatgtttatatacatgcagctcctatttatatcttactgcttcattagtatgactctctccctccaaatttggatagatgttatcagttttcaaagaatagcaacaaatgttagccactttatactaaatgttttctttttaactgctttctagatttcctgtagtccaagtctcttaaacctaccgactcaattatttttctccagtaacatatgcatctttcaaaacatatctaatagctaactccccaatattatttttaaccctctacatttatgaatttttccaacactaataattttcaaattagtaaaaatgcgaatgtaagaagtatagtagacactggagaattgtggcctgcacagactggtcaaatggcctttgactatttagaagtgtgataagattattctttttaaataataactttattgatatgtaattcacataccataaaattcacacattgaagtatacaattcagtgatattaatatgttcagagattgcacacatcagcactaattccacaacgttctcttcaccccaaaaagaaactccatgtccattaacagtcattccccttctcctcattcatcagcctctggcaagtattaatctattctctctgtcagtaggttttccagtttgggtcattttctataaatattatatttatataaggcattttgtgtatggcttctttcatttagcgtaatattttcaaggttcatgcacattgtaatatgtattagtgcttcatttttatagccaaattatattttttgtatggatataccaccttttgtttatccggtcatcaattgagggacatttgggttgtttccaccttttggctgtaatgaatgatgctgctataaacattcatgtacaactttttgtgtggacagatttttaatactgttgaaatacacctaagagtggaattgttggggtcatatgaaaactctatgtttaactttttaagaaactgtcatactattttccaaagtgactataccattttatattcctaccagcaataaatgaacattccaatttacccataccctccaccacacttgttaatgtacttctttttttattatagccatcccaatgggtacaaagtggcatgtccttatggttttcatttaaatatccccagtaactaatgatgatgaatatcttttcatgtacttattgtccatttgtatattttctttggagaaatatttatgcatatctatgataggcagaataatggccccctaaaatatctctatcctaatctctagaaattatgaacatgtgatgttctatggcaaagcagaattcaggtttcacttgaaattaagactgttaatcaacccaccttaaaataggaaaattagcctggattttccaggtgaaccctatatactctcaggttccttaaaagtggaaatggaggacagaaaatgtgtcagtgtcaaagtaatggaagactttactgtccattgatttctggctctgaaggtggaagggggtggggtgcataagttgaggaatgggatggcttctggaatctggaaaaggcaagaaagcagattctctgctagagtttccagaaataagcagtcctgctgacaccttgattttcatcctgtgttaggcttctgacaagtgtaagataagaaattgagttatttttgtcaacaagatttttggtaattttttattgccaaaatagaaaactaatagaatacattttactatttttttaattgggctgtcttttttttatggaattgcaagagttctttatatattctcaatacaagtcctttgacagatacagaaatcacaaatattgtattccatcctgtggattgtcttcccactttcttgatagttacctttgaaggataaaagtaatacttttgactaagttcaatttatctatttttttcttttgtctcttgtgcatttagtatcatatctaagtagtcatatactgtctgaggtcattaagttttgtttccatgtttttctctaagaattttagctcaaactgttaaatctatttgttggtcgggcgcggtggctcacgcctgtaatcccagcactttgggaggccgaggcggctggatcatgaggtcaggagttcgagaccagcctgaccaatgtggtgaaaccctgtctctactaaaaatacaaatattagctgggtgtggtgtcacgtgcctgtaatcccagctactcaggaggctaaggcaggagaatcacttgaacccaggaggcggaggttgcgcacgcttgtaatcccagctactcaggaggctaaggcaggagaatcacttgaacccaggaggcggaggttgcagtgagccaagatcgtgccactgcactccagcctgggtgacagagtgagactccgtctcaaaaaaaaaaaaaaaaaaaaaaactatttgttattttttgtaaatggcatgatttagaggttgaaatgtattctttttcatagagatgtcaggttatcacagaatattgtcacatatataaaaaaaccaattgaatgtgaatataaggatttctagactaaaaattctattttgcatatctgtatttatcctatgtcagtactacaatatattaattactgtagctttttttttctttttttcgagacaagatacttcaccatgttggccaggctggtctcgagctgctgatctcaagtgatctgcccgcctcagcctcccaaagtgctgggattacaggtgtgagccactgcgcccggcctgtaattactgcagctttatggtattttttgaatttgggaaatatgagccttctaatttttttctttttaaagaaaatttttgcctaatgtgggatgcttgcaaatacatatgaactttaacattagcttgctaatttctgaaaaaaaaaaaaaaaaaaaaaaaaaaaggacagctggaattttgaaaagaattgtgttgaatttgtaagtctatttagggaatattgccattttaacaatattaaatcctgtgatccagaagattgtatgcctttacacttatttatgtcttctttaataccttttaataatatttgtagtattcaatgtacaagtcttgcaattattttaaaaatttatttctaaatattttatccttatttgatgctatgtaaatgaaatagaattcttagttttatttctggattattcattgctagtgcatataagtgcatttgttttctgcatattgaccttgtattctgcaaatttgctgaactcatttattagttctggtagttttttggtggattctttgggatacaagaacatgtcacctgtgaatggaggtcactttacatctttctttctaatctggattcattttattaacttattttcttacctacttgtcctagctagaacctctagtacaatattaaatagcaatggcaaaaggggtatcttgtcttgctcctgatctgaggggaaagcatttagtctcttatcaagtttcatgttagctgtaagtttttcattgactgcctttataaacttgagggagttcccttctattcctagtttgttgcatgtttctattatggaagtgtattttgtcaaccactatttctgtgtctattaaaatgataatgtgattttgtcctttattctattaagagtgtgcattacattgacatatggatattaaacttgaaatcatacttgtacatagtatataatcttttctacgttttgctggcttcagtttgatcgtatttagttgaggatttttgcatatatattcataagggacataagaatgcagatttttaaaaaatgtttttgattttggcatcagaataaaaccggtgccacagaatgaattgagaatacactcttcttttaaattttttgtaaatgcttgtgaaggattggcactaattcttctttaaacggttggtagaatttaccaccaaagccattttgtcctgggattttgtcagaaagtttttggctattaattcaatccctttatttgttgtggggctattcatattattcattttttcttgggtcagtttcagtagtttatgtctttctctttataagaatttgcccatgtcatttaggttatctggtttgttggtattcagttgttgatcacataatcttatacccctttttactggtgtaaagttggtagtgatgtcctctcttttattcctgattttagcaaagttagtcatctctttttttgcttattaagtctagttaaaattttttcagtgttgttaatcatttcaaagatatagtttcaggactgttgattttttcctaacattttctattatctttattatttattactacttttgtgtttattattcctttccttatactcactttgaacttactttgttctgttttcaaatttcctaaggtggatggttagaatattgattaaagtcttttttaaaaaatacttttgtttataaccataaatttctgtcttgtcactgctttttctgcatttcatatgttttggtatgttgtgttttagtttttcttcatcccaaaataatgttgaattccccttgtggttttattctttaatctattggttatttagacatgtattgcttaatttccaaaatgcatgaatttttcacattttcttctcttattgattttaattcattgcattttggttggaaaacatactgcacagatttcaatccttttaaattattgaggcttatttcacagactaacatagtctatatttgaaatgtttcattcaaagtgcgaatgtgtactttggaaaaatgtgcattctactgtagttgggtaaaatgttctacaggtatattttgggtctaattggcttatgatgtttttcagttctctgttctttgttgatcacatgcttagtttttctaatcattattggaagtgggatatcaaagtctcccactattgtagttgaattgcctatttcttccctcacttttgtcagttttttgatgctattaggtgcatatatggttataatatgcattcctgatgtcttgacccttttatcattataaaatgctcttttttcaatgtagaactttttctatcaatatctattttgtcttatattagtatgggcaccctgctctcttttggatattgtttgcatatgacatattattttgccatcctttcactgtcaacctatttgtatctttgtatacaatgtgtacctcttgtgggaaatatgtagattatgtgtttttgcctactccaccaatctctgctttttgactgcacaatttaatccatttatgtgtatccatttatctattgatgaacacttaggttgattgcatattttggctatagaatgatgctgcaattaacatgagagtgaagatatctcttcaacatgctgatttcattccccttggataaataaaatgtggtgtgtgtgtgtgtgtgtgtgtgtgtgtgtgtgtgtgtgtgtgtgtatgtgtatgaatactatacagccttaaaaaaataaggaaatcttgtcatttgcgaaacatggatgaacttggaggatgttatgctaagtgaaataagacatactcagaaagacaaatactgcatggctacacttatatgtggaatcaaagttgaactcatagaagcagatagtagaattgtggttgccaggggcagtggatggcgaataaggagatgtcaatcacagaatacaaaatttcagttagacagaatgaataagttctgagagtctattgtacagaatggtggctatggttaataaaagggtataaatattttcaacacaaaacagtaaggatatattatttagctttatttaattgtttcaaaattacatcaaaattacatattaaatactatatatttactatatatttgtatacaaacaatttctatttattagttgtaccttaatagagctgggggaaagaaatgtaaagaaaatccatttacttttttcaaaaattttaattttaatttcaaattctggggtacatgtgcaggatgtgcaggtttattacataggtaaatgtgtgccaatccatttatatgtaatgtaactactagtaacataggatttgcatttgctatttttctatttgttttctataattacatatcctcctaattttctattatttcattattgctttattttgtactaaatagatattttgtaatataccattttaattttgtcattatttattttacgaaactttaaaaacatttaattttcttagtgactgccctttgggttacgtttaacatctttaacataaaacagtctcattcacattaatgtcaacttaatttgtatagtatacaaaaacttttgctccaatagaattatggttcttgtctcctctttgtgctattcttgtcatacaaataatatgtgtttattctttaaaagctcatccatactctaatacttatttctgtatgcattgctttttaaatcagataggagcaggaaagcattgcaaacaaaagtacgtttatgctgttatatttatctatgtaggtagttacatttgcctgtgctcttaatttccttgtctgaatttgagttactatcaagtgtccttttacttcattgtgaagaattccctttatatttttgtgatgaaaatgtactaatgatacattctcttcatttatatttatctggaaatgtcttaatttatacttcagttttgaatgatagttttgctagttatagaattttgcatgtacagtctttttccttcaatattggaacacacctctccactgcctttttgccttcagtgtttccaatgagaagttagctgttcatttctaaagaatccttctcatgtgatgattatctttcttcttgtagtttttcaagattctctgtcattggtttctgatagtttgactttgttgtgtttaggtgtggatctatttgatttaccctgcttgggttttgttgagtttctttgatatgtagattgtctttaatcaagtttttgaacttttcatctattatttcttcaaatattttttctgaccttttctttctctcttctcctttttagactcccatcatacatatgtgactatgcttgatgatgtccccaaagtctctgagactctgttctttattcttcatccttatgtatctctcttcaatgtgaataatttcaaatgtcttgtcttcaatttcattggttagtttttctgccagttcaaatctgctattgagtcccttaagtaaatttaaaattttagttacgttactcttcaattccagaacatttatttgttcttttttataatttccacactttattgaaattgtgtattttgtgagacattgttcacatacttcctttaattcttttgacctgtttcccttcagttctttgaaaatatttacaatagttaacttactatgtttgtctaataagttcaccatttggatttccatagggacattatctatgaactacagctttcctaggtattggccatactttcctgattatttgggtgtctcgtatttttttcatgttgaaaactgggcattgtacataatataacttggcaactatggaaatcattgcattatttattgttgcttttttgttgttgttttgtttatttagtgattctctagactaattctgtgaaagctttttgtttattgtgtgcagccaataaagtctctactcagttaatttagtgttcagctaatgattggatagaggttcccttaaattccttgaatcaataagtctcacagcctatatcaagagcctctgtataagtaagtatgttggggcatgtcttcaatattctgtcaagtagtttacaactctttctagactttaattcttccttgtaaagagcctcaaattcagccatagatgagacatgagaacttaattaaatcttttctgggaatatacacagtcctgcagatgtgtgtcacaatctaggttcccaggaatatttcagagcttttcaaataccatctgaatatcttgttctcaagtgatttttaaacttttctatttgtgcatttattatgaataaccttcttttagccttaaatggtaatgccacctcaagttactgagaagttaaaaaagtgctgcatatatgcatacacagagtaatatatacctatatatttgacagaaccctggagagagaattgtgcacacagagtgagctctgaatcatgtgagacaaaacaaatatgtacatctctctggtagtgaggcgtttggagtgttccaaactcattcttttccctcttttggctactaggctaatggttttcacacacagttgcaaggctgttgtttttcaaggagaccacaaagctgaattttaaagaatgggattacatcaagtaaaaatggcacagtcttctattccttcagagattcaaccttttttctttaagtaaatactccttggatttttgtgagcctttaggtaatcttcaaatatctgaaaggactacattttgacaatttttattgccagtgttctctttcctcttctggagaagtaggtttttggaagtccttaatccaccattctgaatttgctttggtactatgtttaatttttcttaaaattatttaagaaaaataattttttaaataattttttaaataatttcattacttaaagttactaatatttaagaaatattagctgctaatatttaagaaatattagctgctaatatttaagaaatattagctgctaatatttaagaaatattagctgctaatatttaagaaatattagctgctaatatttaagaaatattagctgctaatatttaagaaaaataaaaaattttaataatttttattaaaaaattatttaagaaaagtaatgaatattttaaaagtttgtcagtgctgtatatttctgaagtactttcatattaccattatgagctagctttccttgaaattttattaactggttttttttttagatttgctgttaactttttttctaccaatttattattggttacttttcatcttttttttttaggatgtgatgtgttcatttgttccacatcaacttggagtcttcaaagtgaagcagatgatagagattattggtttagtggcagaagaagatttgcaatctttgtcggtaaaatctttccatcacgtatatttagctttcaacagcatctgtaaagcttccaccaagaaagttgtgatgaaatttgatcctggtatgctattgtgtagtgcccacctggctttgttgttactgttgttaatttaagattattttaatatactaattgcttaattacacacgcacatatatgtgaaagaagtgcttttagcatttcccaacgaccgagctgcaactatcaggtctaaagacatatatatatgtatatatataaaataatgtggtctgacccaggagttctcatcttttaacatgcatcaaaatcacctaaaaggcctgttaaaacacatgtcattggcttacatcccagcaatgattattaagcttgtctgtgttacggcccaaagacacatttttacaatgttcccagtagatgctgacactgccattactgccattctgaggattgcgctttgagtagcactggtttattgatgtatacagtttatttaatattttcctggtttttatattttattcttcttagttttgttgttgagggagtttataatataaactttttgactattctatggatttacttgttgctactgttttatctaattcctcattatcttttatatgttgaaccatatgaagttgctgatattcaactgttttggaccaacaaaaaatttagtttcatatgggtaaacctaaatccttcaagttatcatattttatatttttatatatgcatttttattattcatattttattattttgctaaaattgtgtaggtcttttttattaatgatttgtattttccaaatgtgtttaggagttgagcatttaagttagaatcaattgtctagtgtattaattaattcatggttattgtttttaaagttgaaattaaaaataccatctataaacttatattcaattctataaaaggtatattgccttcgatccgtaatcccacgggaaagtttgtggtcaaagacttggcaaaacgcaagaattatgcacctgtagcaatgcttcaatcagccatgacacgcactcacaatcatcgctcatgtgaagagccagtgaaggatatgctattagcctttcccaatgaccgagctgcaactatcaggtctaaagaccatcataaacatttcaggtaacatgaaatattaaaaccctgaaatttggaaaagcttaatggacaacacgacatgcagaagtttcatcagatcctgctgtataacactaatgattacaataataataataataataataataataaaactgcaattatcttttcattttttttacatggagtgacatggttgttgaatgccactgtgtttgttttcggttagaacctcttttcacctcaatatgtacttgcctggaagtgaatggtatataaaatgttcttcaaatatgctattgacaagtatagaagaataatacaaataatcatctttggaaatgtaacaggtcctcagagtagtaatgtttattaagtatggttgaaagcttgagtttatttaagctaaaaaataaaattgtgtaaaacaatcatggttatcatcatcatcatcatcctcctcatcatcatcatctttgtttgacccccttcaaaggcacatttttaataatcttccacaaagtgaacttaaacctccccaattaggatgataaaaagtgttcaacctcagtttatatttatccaaatctcaaataaattactaattttccaatggttagtgagaagtgaaccaggcatcccgacatgcttatctgggccctgtgcccaggaatagtttttacacatttgagaccggaataagtttttttatttttttctgcctgcttgtatgctactagtaaagtatctaaactttataatggctttgggctttctgcacttgtctttttagctttggttagtcattaagctcacttaattctgcagacattttcttgcaataccatttgatttttaggacataattgttttattgtctatgataggaaaagtccaggtttttctatagtctatcttattattttacaaattccatccaaattagcctttttaaaaattattacttgacaagtaccataaaacacagaaacataaaaaccactcagactccattttaaataattgccatattatagaaaagaaaattctgttttttcctctggctcattctgttcactcccaccctgcagaggtggcttctagcaataattttttatgtacttttttcaactctttcttaaggttatacacatctatatagagatatatctatgtatctacatatgtatatatgtatatatctatatatgtatatagagatataatgtgttaatttaatattaatattttgtttctgtctctctgtattaatcaaatgatctaaaaatagcagaattttaaaaataaggccaagtatttactatttatcccctgaccataattatttttctcaatgaacactttttcatattaatagttaaggcagtatttagtccttatgttttctggccagcaattagtaactttaagtaatgaaataagttttatagtgtatttacttgttgataattgtaatttctatttcattttaatgcattttaccttttcagtttttgagaataaaataagggagggatttttgtctagtttttatttgctgcagtatgccttgtgcttagaacagtgtcaggcatagagtaggcacttggtaaatattttttgaataaataaatgaggaaaaatattttatttccatagtaatttttgtcccctgttctttgcatattttaaaaaacttatcctccttaagctgcagagattacatttctagatgtttttctaaggagctgataaggatttagatatgttaatagtcagctctttctcatttaaggcatttacaccactacttctttccttatccttctctccttgttagaggtatcaggacttcaaatatatgtaggaattatttctaggttctaaaggtggttaagtgtctcagatcttgaaggaaaatttaaatatcaaaaatcgtctttgagcaacaaagcatttgtttcctgtcttgttttttcactctcttaaagaaattaacacagttaaagctgtattactgtaaacattgaggaattgttgaagacaagaagaaaaattaattttcatttgactttgtgactaataccttcatacttatgttttttttcttttttttcattatactttaagttctagggtacatgtgcacaacgtgcaggtttgttacatatgtatacatgcgccatgttggtgtgctgcacccattaactcgtcatttatattaggtatatctcctaatgctatccctcccccctccccccatacttacgttttaattactgagggtgaatatcctaatgattaagaacatttgctgaagattgaggtagaccaaagccagaaggtgtgaatacttgcacattttttttaattgaaaatatatggtgggtaaaaaggaagagcataaacccagttgagtgaatattagatataaagtaattcgcagttcttttatgaattgtttcctctatataggcttattgttgatggttatttcataagttgtgaagtttaaaggaggtagcatgtttagcaaaaagattcattattgtacatttttttttctgactttgatcatgatgatctaaaaacagttaacttttaggaaacactagtcagatacagatctagtttcttggagtcttgtctgtaatctagcagtgtccaaattgcctaactgactaattcttcaaagatggatttagaataggcaccattacatcccagtgaccttacaacggattttttttattagattaagaaaaaataggcttcactctagttctacattcaatcatgtcttgatatagaatagcatatgaggggaaggactagaatctgttctatttgccattccacatccaacacctgatatagaaattggctaggaggctgtcagtaaatactgattgaacaaatgcatatataaaaatattaacatgacttgcttatattgcaggccaattttcacaaaagttccaagatttaactatgtgaatcatgattttgcatatactacatttgaaaaacagcaaaagaaattacatgaaaactattatgcaatgtatcttaaatatttaagaagtgtgcgcttgcagaagaaacaagcagagaggtaatgttcagttcctcaaaaaatatgcaacagatcatggtgtctacagagtcagaatttttttttaactccttggtttctttttattttagatgttgtaaactacatttcaatacgtgataaaagcaaaacactgagctgctttaactacaattatttcttttgttaccttttaactcggaattgtcttagatgggtttccccagaagcagatcttgagacagggattccagtgcctatgatttatggagtgtgtgctctcgggagaaacctgtacagaatgagggaagcagaatagggaaggagtgagagctgaggaaaaatgtgtttcaaataaagttgacactcagggtctcttgagactaaattttaccacaaagttgttgctggcttgagccaaaggggcttgtcttttgtgttccatatcagtcattggctgtccttgggtgtggcaggcatgagcataatttcctcgatgagatgtttgagaagggagtctcctcagcagaggacaattttatgtggattagtgcaccagtctggttaagtggatatgagtgaggcagcagcaatatgcactatgggaaaggcttgaatttacagatgcattttttgaatgacttgacctcaattactgattattattattattaattttatagggagcgcatgtattcatatgatgatacagacataggcttagagccaggatcaggtctaaagtcaccctcactctcagaagcggaaatagaagaggagctgtcttcagcagcaaattcaattagagcgaatcgattgttaaccaccaggggtatagcatctcaggaggaagagtctgtgagaagaaaggcacgtgcaatgttttacatttggttattccacgagaattcttaaaatagcttttgctaataatgaataattctggaaaaatatgattttttacaggttctcaaaggacttaaatcagaaccatccactccacaagaaaaacatgattgcagcttaatgttgacaccaaagcaaattcatcaagtaattgttggtgagaatacacaaaaacctactacagcctttatttttttataaaaaaaagatttcttaaagtgtaatttatatttcataaaatttaaagtatgcaagtatcaactttggaaatataagaagtcctcagagtagtcatagttattaagtatgactgagagaattaactttagtaaatttaaagttatataaccaccttcgcaatttaattttagaatgctgccatcactctcatgcccatatgcagttactctctatttctttctttctttctttcttttttgagacagagtctcactctgttgcttaggctggagtgcagtggcatgatctcggttcactacaacttccacctcccgggttcaagcgattctcctgactcagtctctcaagtagctgggattacaggtgcagcaccaccacatccagctaagtttttgtatttttaattgagatggggtttcaccatgttggccaggctggtcttgaacttctgacctcaagtgacccaccagccttggtctccccaaatgctgtgattacagagtgtgagccaccgcaccccgcccagttactatttctaccccttgcctcagacaaccattaatcaactttctatacagttgcctattctgaaaataaatggaatcatacaatatctagcctttcatatattgtttcttacacttagcataatgtttttgaggttcacccacgtggtaggtagtatcaatattttggtcctttttctattgaaacagcaccccattttatgagtataccacactttgtttatcaattccccagttgatggacatttagttgttttcagtttgaggctatgatcaataatgctgctatgaacattcacataaaattctctgatttctaggagtggaattgctgggttgtacaataaatttatatctaacttaaaaaaaaaccctctaaaatgttttccaaagtgattgcacaaagttgtaatcctatcagcaatgtataagggttacaagttcttcaacattctcaccagcactgttactttctgtctttttgattatagacctactagtgagtatgaaatgttatctcattgtggatttgatactcatttccctaaatgaataagatgttgaatatattttcatgtacttacttagagaaatgtctatgtatgtcatatatagtctttggagaaatgccttttaaattctttacccatttatttatttatttatttattgcgacggagtctcgctctgtcgcccaggctggagtgcagtggtgtgatctcagctcacttcaagctctgcctcccgggttcatgccattcttctgcctcaacctcccgagtagctgggactacaggcatccgccaccacacctggctaattttttgtatttttagtagagacggggtttcactgtgttagccaagatggtctccatctcctgacctcgtgatccgcccgcctcggcctcccaaagtgctgggattacaggtgtaagccaccgtgcccggcctctttgcccaattttttattcaaatatttgctttcttattatagaaaatgttctgtgtatgtgtttatctgtagcataatgtagatatgcctgcaacttggattcttagcttagttctctctggaattgtgtttgtgtgcttcaagaacaccatgtgtgctatagagtaggaaggctctgtactgagaccaaactgggtttggttctgcaacctactagtgcagtgacattagggtttacctctatgggtctcagtttcttcatctgtgaaatgggaagtgataatattgcctaccccatagtataattgtgtgaaccaagtgccttacacataataagtgtttagaaagttttagtgaaaacacttcatccctaagatgagtatgctgcattagaaaatgcttaaagtctaattgtaattcctttatccattcagtcattttataagtgttaattgaatgaccaccatatactagacacagttctgggttctggagatacagcaatgaagaaaacagactgagcccctgctctcatagagattacatttggctggggtgggagggagataataaacctttccttatataatacataattggtatacaaggtatgaagaaacataaaccaggttaagtagatcgagaataatagaatgttttcatggagagtcttttttaccaggtggttagcatctctgagaagtatatttgagcagagacagatacctgtgtgaggtaaagacatgaggcatctgggctgactgtgagttaggagaacaagtgaaaactcctttttaaccttgaagaagtgctatacaatatacccttctaggtctgttttcaccaagtgattgaaggacagttatgattaaagaagtagtggctataatggtctgaagtgggagttctcatttcattctaaccacagttaaggtggccatgagggagatgtggacaaaggatgattgattgggctgattctctctctaggggggaattcagcatataaaacatggagaatggtgggagagaaggaatgtaaaggggcacaaaatttttggagtgataaatgttcagtctttattgtggtgattgtttcacaggtgtatacatatacgaacactaatgaaattctatactttaaatatgttcagtttacttactatatgccagttttaactaattaagctgttaaaggcagggcaaaacttaaaattattaaaattgctttgatataaaatcctgggcattttaaggggaaaacttaagcaatgggtcatgggaaatttaccagtttccgtaaattatagataagtgaacaaaatacttgtactagtgggaatagaggaggtgttgaagtgttgcaaattaaggtgctaagataagttgtagtgaatggttcttatttagtcatataatttttcatataattagaatatatttatattgaattgtagccaataatgtccaaacatttaatcatggtcatctagaaaaaaaatgcttacttaataattcctgctattattgtaaatattttttaaaatttcatttttatacaaattggttgatcaaaatatattttgaaaacttaaaaagtaaatgaagtcatttgccatctttaaacttaacaaaatacttttcattttttttcagggccttctgtccttaactttggtaatatttgtgtgaactctccaaatactcatctacttcatgttattaatatgctacctatgcatgttttgctccagttagatactgatttagaagaacttcagaagaccaaccaattttcatacgtgattctacctacatccagtacttatatttcaatggtatttgactctcccaccattggaaaattttggaagtagggattatttttgaatttctgcttgttagaatcaaagtgtacttctgtagaatatgtatttattttcctgaataattgtattgtatattatatttgttctccaaacatagaagctatatgtgcatcaatttttagatatatagattgatagtttagtagcaatctaattatctttcataattaaagtattacgtgctaagaattgtggatgttaatcaatgctatgtgcattttacgtgtagctgaattctataatcacaaataactattatcagttaaatttggatgcttttgctgcattacaggtctttcacctttacagtgaacaatgtacccagtggacacatcctagtggtggcagttgtccagccagtaacacttgagctatcttctaatgagctagtattgagaccacgaggcttcttcatgaaaacatgttttcgggggacagttagattgtataatcgtcagaattgttgtgctcagtttcaatggcaacccgtaaacacaggaagagggatagcattttctatttgtccagctaaaggtaacagtttattgtttgtttgatttagacatttattttttcatgtattcatgtattctggtattaattatttattgagtgtgtactgtgtactggtgccaagagtatagaagtaaatcagatactgtcatcaggggtatttatttttacagatataatatgatttggaaatatggaacccttgttagggttctccagagaaacagaccaacagggagagagagagacagagagagagagataaagagagagacattttaaggaactggttctggctcacaggttgtgtggttgtgtggcctggcaagtttgaaatttgcagggcagggtggtagactggagatacagggaagagttgatggtggagtcttgagtccaaaggcattctggaggcagaatttattattcctcctgggacatcagtcttttctgttaaggctttcaaataattggatgagacccacccgcattatgaaaggtaatctgcatgttaattaactgattgtgataattattatactatatatgcatatcaaatcattatgttgtacaccttgaatgtatacagtctttgtcaattaactgtttcaaaaagcctactgatttaagtgttaattacgtctaaaaaaacactttcacaacaacatctggactggagtttaaccaaataactgagccctacagcctggagcagttgacagataaaattgatcatcacagatacttatggacaaaataaattttgtttagttttagttagataatgatgataatctgtgattcagaatgacatatttttctagtatgaattcttttagaaagatctagaaattacttatagccaatatttaatacaactcataaaatccaattaataaaattaagaactttaaataagatgatttttaattaatagaagacaatctcagatataccatttttgacgtgccctgtatttgtgaagcatcctcttaaccttgtttctgccattccctggagtctataattccacatagtatacctgctgtaacatgaacaatcgtaactgctaaactgtgacttatttagtagcctgtcaaatttggcaaacatccttgtgatgtgctgtgaggacctcatgatggcacaagctatcatttaggaaataagatagcaattaagaagttgaatgatcaatacggtatctttgttttatgtacatgttgtgcctttccagctagatgaaaaggctggatctttgtatcaatagtgacccatttggtgctttataacagccgaagtccaattttgcatgaatggaaagtaaaacagactttggataatcgtagctgctcactagctattttaacttaagcaaagtactctgtgaatacaagtttcctcatctgtaaaatggagagatgactacatctcaaagattaattgtgtgagaaacttctctaatgcctggcaaagagtaggtgccaaataaatgggtagccattttattacgaaaattttctaaatctgtttggaattttttcctgaaacgatcctcagagtaataacctatcctgcacctttccatccatcctcattagaaaacccttgctccctgtttccttccatctttcctccctcctttcatctttcctccctcctttgttctctttctagttcccttccccttctctctccctccctctttaagtctaatttagcaacagtaattatttagggtctaaatagaaatatactatacttcatatttcagacgagtcctggtttgtagaaatcttgccttaaacatattttcttgtgaatatcagtcatttccaaatcagtattttacatagctctaaaagtgcttgtaacagggagtgttataaaaacaatcttaagtattaaattaaattcacttaattttagtgtggatgtgtagatagagattttgacaaatttaacaagtggaagagtaggacagtcctttcattaggtttggagatcactgacacagctatttaatcttcttattaatgtggattgatttaacaccattctacatcataatttgttaagtatctgaaatatactttcatcaacatttcacagattcacttgaccgagctctttataaattttaatactgaaaatactggatcctgcctcaatctattgaaatgctgagagagtaattagagaagaaagaacatatttctgtacatttaagatattttagataaaccttcttcagtttgtttgaacaggtatcaaacagtggttgttgtattatcagcattccagctacaggtgctgaccaaccatctgatattgtgctaagagtgttaaaaagctcactagcctatacttctccttgtattaatatttctatattctaactagggaggaatgggctgggcttgccttatggctgctatggaaatgcaatgatgatacttaatttttgtaaaagagaagtggaattatgatattataagctggagtaccagttatgcttcttgtggtctttagaactcttatttttacaggagaggtttttacatttaattttattttctttggttgctcatgacacctcttataatttttaaacaaacaattaccaaggtacaaacacacaaagatatttaatttcaagtaaaatttttgtgtaggtaatgccattagtacttaagttctttttaagaatacaaaaatataatcctcaaatctatctcatatagcattgaaaaaagtgtttgtaatttgtagcatatacagttttgcttatgttcctttcctcagaatatttatataatgattactcaatttcatattgtttttaccattttataaacagaaagtgactttttaccaagctatttttcttgtgctgtatcagttttgcatcctggacaatacatttaatcatatgcctctctctatatttttataaactgaaatgaataattccaaattaaaatttatattgtctttgtccttcttccctgaggcatgataggttttgtgtttgtgtttgatagtggatattgtaaggggagaatataagagtggattgatattttcttttttattatttttgagacaaagtttcactgttgttgcccaggctggagtgcaatggcgtcatctcagctcactgcaacctccacctcccgggttcaagcgattctcctgcctcaatcctcccgagtagctgggattataggcatgtgccactacgcccggctaattttgtattttttagtagcgatggggtttctccatgttggtcaggctggtctcggactcctgacctcaggtgatccgcctgcctcggcctctcaaagtgctgggattacaggcatgaggctccgtgcctggccaagagtggactgatattttctaagacagaattcaattctaatttgactttttctgtgggtatttttcatgcttctgcttgttttgttttgtttttgtctgttatctttatccttactaaaaccttgaatcacacaatccatgaacttgtttttgatcaattcactcccactctctttctcacttctctcactgcttggttgtatgcagtaccagctctaccagtcccagccttgctcaatccagctgaaggggagaaaatctaatttattttttcaatcctcataaatttttaactgagatactctctcgaaacaaaagtcagaataacaaaagaaaaaccagcagaaatttattgatgcatgctgtactgatcacataggagaggcctcagttcaaaagtatctcacaaggcagtggcttagaggtcttatttaaatagtattttaacaaagagcaataaatcttagcatagtaagacaaaggagaatgcagttccagtcttttaaaaggcagaaaaatataagaaggtagattttaccatggcagccgtaaggcaagcccagcccattcctccctagttagaatagagaaatattaatacaaggaaaagtatagggtattgagctttttaaaccttagcacagtatcagatggttggtcagaacctatagctggaatgccgataatacaacaaccactgtttgatacctgttcaaacaaactgaagaaggtttatctagaatatcttaaatgtacacctaaaatctgctcccagatttctctggtgcctgctgatgtcttctctggggcaataagcaagtgatgtctccagtaaggaaggatttacatcccaacatcaggcaaacagaggctgaggcccagtgttctcctgtgtttttaatttaacaatcttaatatattggggagaaatactttgttttcctttacagccatccagtttctttcccatacccctgatatacttaatattcctgaagaaaaaatatataactgtgctcattggagggagaaaattcttctcaagctgacctgtcaatatggatgtataattctttcactgctttcaactcttctcagggcactaagatggctttatttataggactgaatcttctttgcagaaattacttcccatcacaatcttccccaaaccccaaagaacaggaaaaagctgttccgtaacctgacttttacatattccccaggatttgtctttctgcagaattcctgatcatctttcatgtcacaattcacatgccacctccatataatgaagtttcctctagctttttggctaatttatttttttttaccctttatttctgctcctattatgcatttgttatgtcatcaacaattatttgtttttatatgtctcttattttggcaggcattgctaaatccatatctgatgttggttcctcttcccaacaggaccctcattttgtttagggcaacaatgttctcatctgaaaaaactcttccgcaaacctcttttgctatggacataaattttctttagcttcaccctcctcctatgtacttgaaactgtttccccaagtattttttacgtgtattatcatacttatttatttggacaataagacgtttaatatcacaaacatatatgcgtgtatatatatgtttgtgattttacatatatttatatatataaaattgctctctttgtctttccagcttatttaaaacaaaattacataaagaaatagctataaaaagatattgttgagattgtaacataaatatacaataaatataacattagtaccacacaaaggaggaaaaggggagtaaagttatgtaagagtaacagttctataaacagcgtaaaggaggaaataattacacaaattaaaatgtcagtggaaaatacttacttagtaccaaagaacatagtaaaggtggaataaagaataaaaatacatgagccaaacataaaacaaaatataaaagagcagatataaattcaaatatgtcaattctagcactaaatatgaaaatattaaacaagtatcaaataaaaaggcaaggactgcctactagatattaaaacaacagcaaaaactgaaatatctaccacaaacaatctacaaaagtagcttaaatccagagaaacaggataaaagtaagaggataaaaaacttgcaaacaggaaacataagaaagctggagtgatgatataacaattagacaaaatatacatttttaaaaacttttattttaggttcaggggtacatgtgcaggtttgttacataggaaaatctgcctgtcacatggatttgatgtacagattgacactcagttaataagtgtagtacccaacaagtagttttcaatcctcaccctcctcccaacctccatcctcaagtagtacgcaaagtctgttgtccccttctttgtgtccatgtgtattctatgtttagctcctagttataaatgagaacatgtagtattgattttctgtttctgcatcagtttgcttaggataatggcttccagctacaatcaaggttgccgcaaaggccatgatcacattcttttttatggctgtgtagtattccatggtatatatgtaccacattttctttatccagtctagtgttgatgggtgtttaggttgatttcatgtgtttgctatggttaatagtgacagacacatgcgtgtgtcattatggtagaatgatgtatattcctttggctatatacccaataatgggattgctgggtcaaatggtatttcttttttaaattattggagaaataccaaactggtttccacagtggctgaactaatttaaactccaaccagcagtgcataagtgttctgttttctttgtaacctcaacagcattggttattatttgactttttagtagtagccattctgactggtgtgagatggtatctcatcgtggttttgatttacatttctctaatgattagtgatgttgagaatttttatatgcttgttggctgcatgaatgtcttattttgagaaatgtctgttcatatcctttgcccattttttaatattagacttttgtcagatacgtagtttgaaaatatattttcccattctgtaggttgtatttttactctgttgatagttaattttgctgtatagaagctctttagtttaattaggtctcatttgtcaattttcatttttgttgcaattgcttttggtgtcttcatcatgaaatctttgccagggcttatctccataatgctatttcttaggttattttccaggatttttagttttaggctttacattttaatctgtaaggcatcttgagttgatttttgtatgttgtgtaaggaaagggtctaacttcaattttctgcatatggctagccaattatcctagcactatttgttgaatagggagtcctttccctattgcttgtctttgtcaattttgtcaaagatcagatcattgtagatgtgtggctttatttctggactctctagtctgttccattggtctatgtatctgtttttctaccagtaccaagctgtcttcattactgtattcttgtagtatagtttgaagttggataatgtgatgcctccaagtttgttctttttggttaggattgtcttggctatttgggctctttttatggttccatatgaattttaaaatagtattctaattttgtgaagaatgtcagtggtagtgtgataggaatggcattgaatctgtacattgctttggtcattttaacagtattgattctttcaattcatgagcacagaatatttttctatttgtttgtgtcatcattgatttccttcactaacgttttgtaattctcattgtggagatctttcacctccctggttaactgtatttccaggtgttttattccttttgaggctattgtgattgggatcacgttcctgatttggctctcagcttagacattgttgttgtatagaaaagctactgatttttatacattgattgtggatcctgaagctttgctgaagttgtttatccaatctaggtgtatttgggcagagactatggggctttctaggtatagaatcatatcatctaaaaacagagatagtttgactttatctcttcctctttggatgtcttttatttatttctcttgcttgattgctctggctaggacttctagcactacactgaatagaagttgtgggaatagaaattcttgttttgatccaattttaaagataaatacttccagctctttcctgttcagcatgatgttggctgtgggtttatcatagatggctcttattattttgatcttattattttgagatgtgtttcttcaatgcctagtttattgagggcttttaaacatgaagggatgtggaattatattgaaagccttttctgcatctattgagattattatgttttatattgttagttatatttatgtgatggatcacatttattgatttgtgtatgttgaaccaacctgtgtctcttgggataaagcctacttgaacatgatggattagctttctgatgtgctgttggatatggcttgctagtaatttgctaagaatctttgcatttatgtccatcaaggatattggcctgaagttttcttttttgttgtatgtctgccaggttttggtattagaatgatcctgaccttgttgaatgagttagggaggagtcactccccctcaattttttggaatagtttcagtaagaatggtgccagctctcttttatacatctggtagaatttggctgtaaatctttttggttctgggctttttctggttggtagggtttctactactgattaaatttcagaactcaatactggtctgttcagggtttcactttctttctggttcaataatgggatgttgtatgtttccaggaatttatctatttcttgtaggccttctatttttgtgtacagaagtgtttgtaatataagtttttttttgtatttctgtggggtatgtgttaatgtcccctttatcattttggattgcatccatttggatcttctctttttttctttcttactctagctaatggtccatcaatcttatttattccttcaaataaccagttcatggatttgtttatattttgtatggttttccatgtctcaatttcattcacttcagctgtgattttggttatttctggtcttctgttagctttggggttggtttgctgtttttctagttcctctagttatgatgtttggttgttaatttgagacctttctaagttttcaatgtgggtgtttagcactataaaatttctgcttaatactgtattagctgtgtcctagagagtctgctatgttgtatttttttctcattagttataaagaaatttttgatttctccttaatttcattttttacccaaaagtcattcaggagcaggttaatttccatttaattatatggttttgagcaaccttcttagtattgatttctatttttattgtgctgtggtctgatggtgttttgtttgattttgttttaatttactgataatttttctatggccaattgtatggtcagttttagagtatatgccatgtgcagatgagaggaatgtatactctgatgtttgggagtggagagttctgtatatgtctgttaggtccatttggttaggtttttgagtttaggacccgaatatctttgttagttttctgcctcagtggtctgtctgataatgtcagtgggatgttgatgtctcccattattagtgtgtttatctaagtctctttgtaggtctcaaagaacctgttttataaatctgggtgctcctgttttgggtacatatacaaaggcttatctcagcactcctgggctgtgtgctgtaactctgggagctggtagtgggccccaggtttgttctctggcccctcaagattaggaacatccgtgctggagggactgaagtgttcctggtctgctggccacaacattcctattgggggtgctgtcaaaagcacctcatcggggccagggtggtgggatgcacttgtactagcagtggtggtgtagtggggtgcacatggacactaatgccagcaggggaggagaggggagatctgcctgcacacatgtcctggcaaagcagtggaacaagttgtgggtgagtacatgccagcaaagtggcaggggaaggctgtgatggggggagagtgcaggtgggctggtacatttcagtggaagctggtctgctatagttccttgatggtcaggcacagtctgacagtgaaggagctatgataagggcccccaggaagcaccctggttgggcatccaaggctgtggtgcaagcaggcatggccagactagggctactggaaatgacagtagacaggaagttgctcagatcagactagtcctgtcctatgagcaagacagccctgctctgcccaagtctaatagttacccaaaggctaaattattctagaggatcactgtaagccttggagtgtggggatcccaagttgtgctcaactgtggcagtccccatgccaaaccctcggggctctacacagcctggagtcctgccccttcctcctaagcggctctccctgccatcattagcttatttaatccccacaatgtgattctctcagttaaatacaattgttatctccattttacatgtaattaaactgagctacagagcaattaaggaaattgcccatggtctcaggtagtaagtgccggttctgaaatttgaactaggaagaccttagaatttgtgctcttttggggttgctcttcttgaggagtatctttgtggtgttctctgtatttcctgaatttgaatgttggcctgtcttgctaggttggggaagttctcttggataacatcctgaagtgtgttttccaacttcgttccattctccccgtcgctttcaggtacaccaatcaaatgtaggtttggtcttttcacatagtcccatatttcttggaggctttgttcgttccttttcattcttttttctctaatcttgtgttcgtactttattttattaagttgatcttcaaactctgatatcctttcttctgcttgatggattgtgctgttggtacttgtgtatgcttcacaaagttctcgtgctgtgtttttcagctccatcaggtcatttatgttcttctctaaactggttattctagttaacagttcctctaaccttttatcaaggttcttagcttccttgcattgggttagaccatgctcctttagctcagaggagtttgttattatccaccttctgaagcctacttctgtcaattggtcaaactcattctccatccagttttgttcccttgctggcgaggagttgtgatactttggaggagaagaggcattctggtttttgaaattttcagcctttttgcactgattttttctcatcttcgtggatttatgtacctttggtttttgccattggtgacctttggatggagtttttgtgtggacgtcctttttgttgatgttggtgctattgctttctgtttgttagttttccttctaacaggcccctcttctgcaggtctgctggagtttgctgggggtccactccagaccctgtttgcctgggtatcaccagcggaggctgcagaacagcaaaattgctgcctgctccttcctctggcagctttgtcccagaggggcacccgccagaagccagcctaagccctcccgcatgaggtgtctgttgacccctgctgggaggtgtcttccagtcagcaggcacgagggtcagagacccacttgaggaggcagtctgtcccttagcagagctcgagcactgtgctgggagatctgctgctctcttcagaggcggcaggcaggaaagtttaagtctgctgaagctgtgcccacagctgcctctttccccaggtgctctgtcccagggagatgggaattttatctataagcccctgactggggctgctgctgcatttccttcagagatgctcggcccagagaggaagaatctagagaggcagtccagctacagcagctttgcagtgctgctgtgagctctgcccagtctaaactttctggaggcttattttacactgtgaggggaaaacagcctcctcaagcctcagtaatggcagacgcccctcccccactaagagccagtgtcccaggtcaacttcatactgctgtgctggcagtgagaatttcaagccaatggatcttagcttgctgggctctgtgggggtggaatctgctgagtgagaccacttggctccctggcgtcagcccctttccaggggagtaaaccgttctgtctcactggcattccaggtgccactggggtatgaaaaaaaactcctgcagctagcttggtgtctgcccaaatggccacccagttttgtgcttgaaacctagggctctggtggcataggcacctgagggaatctcctggtctgtgggttgcgaataccatggggaaagtgtagtgtctgggctggaacgcaccatccctcacggcaaggtccatcacggcttcccttggctaggggagggagtttcccgaccacttgtgcttcccaggtgaggtgacaccccaccctgcttcggcttgccttctgtgggctgcacccactgtctaaccagtcccaatgagatgaactgggtacctcagttgggaatgcagaaatcacccaccttctccattgatctcgctgggagctacagaccagagctgttcctattcggccatcttgcctgggaattcaaatttgtgctcttttaaccaccatgatatatgatacctttttacattgagaaaggccacatggtaaggaatgttaatatgggaagctagcaggagctcactggtctttgaaggcattgtcaacctattaagacagatctggaatacctatccttgggattttaattgcataagataaactcttacctacctaatccactgaagcaggactttttgttatttacattcaaatgtaatcttgatggaccctgattaagctgatggcacttccataaccagttctcttctttttataaattaatgtgcctaacagagtgttggcattcaagagtattaaaaatatctgatattaggtgctttccaggcatcatacactatgttactccccatacatatgttgttatctccctatatggccactgcaaaactaagagggaggtaggcagtatatagtttttaagatttagaaaacttccattccatgacagtcaacctgttccaaggcaaagttttcttgtgatggtaattgatttctttcattccgtatcctgtgcctttgaatctcaggggcttctgcctttccgaaggaagaacatctaagttattgtttccattaagtaatattttcctttctccaaaggaaatgatgaatctaaacagataaaacagctcactccaaatgtacctgataccacatgagttctcaatgtatttgaattatagcaatgtgttaattaccgatagctaaatcagaagctacatctctagggatgtatgtatttcaaaaaacttctgtggtaatgataattcttccttctgaaagctgaatgaatgatgctgacaagtagtattccagaatgtcagaaaacatgtggtgtgggcaatttggttaggaaccacaaatgattttctactgtctatatgtaaatttatctctaatcatagagtgtttgcttcattgttaaatattctattgttttccaaatattggcatattttttcatatattttatttgcctattaaaattgaaaaataaggcaggcattttctattttaatcaaaccctataggtcaatactcatttgataatatctcacttagcatttttctgtttttggagtttaattttaatagtttatttaatgcaatcacatttttaccttaactcttattttggatattaacaaaaagaaatacaattaaaatgtggaaaatgtcttattttctctctacattttccgtaggcactgttgaagcatattcctcactggaatgtgaagtaacttggcagcagggcttcagttctccagaagaaggagaatttattcttcatgtctttcaaggaaacgcgttgaagctaaaatgtgttgcacatgtaattattttccttgaacatggtttttgttttgagggctatgaatttgttgggtatacactggtgtatatagttacctatatctagaattaactgtaaaacccaagactttcatgcaacagtactagtttttttgttagagcctctataaatatgtaatatcatcatgggagccattgaaatgaaattattttattaagagacacaaaaagtattttcagagaatatacttgatggattaaaaatgtgagtagagggaaagctgtaatatgcaattttaacctttttctggtacagtccagagggccttaaattcatgactcaatcaccaagcatgattttacatgtgtaccaaatttcccactcaatgttcttagaaatattaaagaagccaaatgctcttttactaaaccccatctatatttctaggacatgatgatactcttacatatttcagctgtggaggagtttttagcctcaagagatgagaaattcatctacttttagtgatggcaagtgacagaactcagtatggtttttcttctaagcctaaaataagctgggtcctactacttttcattatgtgtaaattagttttattttttaaaaactttctattgaagtataacatgcatatgtatatgtatatgtggagaaacatgaagtgattaaataaaatattcatttgtttgtcattcatatacgaaggcctgattggtctgtttactcttctgttagttttgtttgaaaatttattattccaattacctggataatattcttcaaataaatgtaattatagagtatattaaaacctatgacaataacaaataatatttcatatgtgaagacaatagggtctgatataaagaacacataatgagaagttggaaaacttggattctagttcccctttggctactgcttgctttcctgaaaaatcgaagaggtggatgataccaacatttccaaaaatcagtctatgttgcactagttctgtgaggtgctttgtgtgagatgaggagggggagtcctgaccttaagtaattctgtgaatccccatttttcgataagcaaagtgctcattatcagtatgttaagccccatgagtagacttctagtagaaacatgcctgaataatttcatttgacaccttcttttccatacttaggtgagccttcaactctttccttttgcactgcacatggtaacaccttgtacatagttgtttagatactgtctaagatccctttcagtgattaatctacacaattcttagtcatgggtctactttcttaatagaattatcttattccttttgccttacctagtttgggagtatattttaaatattccattcattttcctttctcttaagcactccacaaaatctggtaacactttttattttaaaagtcactatgaagctgaaaaaaattgtgtcatgtcttaaagtgaaaaatatattttttatagcttcattaccttctcttctttccccatgaggagaattgactttacttccttgttcatagttaggagttttttcaactgtaaagagaccacacaagattgacacattaaaaactgcatatgtttgttgaaatatatttatacatgttttgtggagctggcgaatgttatgtaatcattgtatgacttagacaaaatacttaatcacccgaaattttggtttcttccactgtaaaatgtgatagtaccatccattcattcatttaacatttatttattgagcccctacactgtactaggccccatataggctctgtgtatttaaagatggataacataagcatagtctagcttccctctgagcactttctggactagtagaccatagtggaaatgtaagtaaaaattaatcatatatctggttaatactgggtacacaataatattattattactattatccccattatttatgattaccaccagtatctagatattttacctaaaaatatctaaatatctaaattctaaatatctaaatatttagttactattacagccaaaatatctaaataaaatatctcctgtgatgttattaccccatcttaactagattatcacagatttagtttaaattttggaaaataaaattattataccttgggtactttttcatcaaaactagcatataaagtcctgatttgtgatttattttgcatgttagaacatactgaataaagaatataggagtattataatttttattttcttttagtatttatatctttggttaatatatattcaaaattagaatatttttgtgaccaaaacaattaaacaaagtattttatttaccattaattcaattgtgttttttctttcctcctctcgttattagcttggtcgcaccaaggttttacttttgcagccaaggatactctttagtaattgccctcaaggtttaacaacttggaggaaagccattcttcaaaatgtaggacaaaaccatgcttatttcaaggtaacataggatgttggtaatttcttatttggatcagatgacatggtcataatgctgtgaagttaatactttattcttcacttttgctaatttttagatacttcacattaaatttacctgagtatagttcatctagtttgtcctcttaatttcttgtaagaacaatttttctcactaccttccttagcctccctgtttcttctcttttcccttttattctttctgttatttggttttattgaaaaaatagatgtttatgttttaaaatatacattattaattaatgttacactccatatttagttatatgattttccttttcatttcagtctgtaatcagggccatgatggtagcacctgggaactagatcaaggccattctggagagagtatgtttatggttgttgctcctgatttaaatggaaagaggagcaaagtggtgatttttttttttaaattgaaaaatgtagtaagaccggcttcccctcccagtaatagtaatagagtttagcatttgagattttccattcaagctttacattaatgtgtttttttctgcccaaattaagtctttagcaaaactgaaaaatgaggatgatcttttctactctgcttctttagaattaattcttacctacatagtctatttgttcctttagtcccaaaaacctcttggccatttttcctttaaattattctagcttaaagcatggtaaataggtttaaattggcctatgaaaatccatagaataaataattgataagttacttagaagttttctgaagatcaaaatgatatcttagacattaggctttctgtcaaggaaataaacaagagattacttcatcatcctacctcctcactaacattattttgagtttttaggatcagggaaagacagactctcaaaagtagtatctagaatgttgtcatcttctcgaacagaaatatcatctttataaattttgctgtcttgaaagcactccagataataaacttcagcatcctatttgaattggaagttgtcactaccaaaggttctgttttcttggatagggttgcagtttcttgttttagtccaaactatttgtacctttggtattttcaaacactattacaaaatcattttatgtcctgtgcctggagatcttctctctaggtagtggcatggaggctttcctatgaaagctttgaaactataattttaaagaataatgtatcatttctgcaaattttcaattacaggtttgtagtcagagtcttttgcctatcattaatattattccatcgcaaggaatagttccatttgggggaataactgttctcaatatctcctgtaaacccactgtggcagaaaagtttgatacaagagcaaaggtatgtccatacatatgagtttttgcaccttacatatgtctatgtgggtttgttggttgtttaacttatctataatggtaggtataatgctacaaaatggagtacacatgtttattattagaaaacttgttttaattctttcttctattgggaatgggatttaaagttatgacattaaagagcaattttcaaaaagtatattatttttctagaaattaagttagctttaaagaagtagagtttttggagatttaaaaaagcacttagctttatcatctaatgaaaaattggatagcagaacttggagaggatttgcagaaaatatttttgatgaagttggtaatggaaatttctactaagttgaaatggataccttccatcaatatgaggcactttcttatgaaattgaaatgatagttgtcatttctgagttttgacgaacctagatagccacagagaagagggttgcttttttcaaagcattagttaggtagattaggaaaaaaataatcaattttgcaatgctaattctaaagagtcttaataatatgaattatatgtaatttctatatgattttaacatctatattttagagcacacataaaatgttttactgctttatgttctcggaattatgtaaatgaaaaatattaccctgggccaggtgtggtggctcacgcctgtaatcccagcactttgggaggctgaggcaggcagatcacaaggtcaggagatcgagaccatcttggctaacatggtgaaaccccatctctactaaaaatacaaaaaattagccgggcatggtggtgggcacctgtagtcccagctactcgggaggctgaggcaggagaatggcatgaacctgggaggcggagcttgcagtgagctgagatcacatcactgcactccagcctgggcaacagagcgagactccgtctcaaaaaaaaaaagaaagaaaaatattaccctgatattaggcacttctgtaagtgataaataaaatatgtaagacaggtatgtgtaaaatttaattgtaaaactcaaagactagagtgttcttggtcaatcttatgatcaactgtttgtatttactcacattaaaaataatatatacactgttatcagatcaaaatgaataactttaagtatatcttacatgttatccctgaatagaccataacaatacatgagtaaataataggtaacttaatataataaaaactgatttccccaacccttgaacaaatcacttaagaatgatatcttattttcataaataaatgtgttgaaaatgtttataaattatatattatgatatgttatctgagacttgggtagaatacttttaaacacaatatctgggaaaaataaaaaaaatggccaccaaaaatgtaggttttactaaacttaattctcactatattttagaggattatgctgggttttttttctaatcttacctttattaacattatagtataatgagactcatttattcattcattcaacattcacattatgcactaatctcttgtaaatgttaaggatgcaatgatgaacaagataaccagggtctttgatgtcaaagagcctacaatctggtgggtaatataaacaactcaataaataattaaaatacactatcataagtattgtgatgaagaaatgttgcaggctaaggaagtacacaggagagatacacaacccagtcttaaattatcagagacagctccctaggggaaggtatatctaaaagacacctgaagttaagaataagttaagaataagccagattaaaaggatggaagcggggtgtaaggggagaggaggaaaggttattcaaggctagcatgtgttaaggcttgtgtgagagagagagctgcaatgcagacataagaaacttaaagattaacatgactagattatactaccaaatggatgatagtgggaaaaaatgtacttatatgacccgtgtaagttttagatcatacagggccttatcaacattaagaaatccaggcttcattttaagaggtaggagttttaactacggggatttcacaatgagatttgcattttttagagatcactttggtggtagagcagtaagctgggaccagaaagatggaatgcagagttattagtctggtgaagaggtccaggcaagagaaactggtgagaaactgataaatatatggggattggtgattgaaaaggggtcccatgtaaataaaatgggtatgtcaagagtgaggcagatggtggcaacatttagagagaaagagatcagagtgtgagtaacaccctattagaggaaaacgtttgcttgaattggaggcatcttttgattgtagagatgtctagtaaagaggcagccacatatatatactggtctgaaggctaacgattcatcatagagatgaaagagaatgtttctactgttgctctatgggtccagatgtgtgtaagtgaaccaaatatataattgagaagttggaatgataaaagttgaaagaaattgaataaaggaaaatatagaggagaaaggtgaattggggttgattgggagaatattacatacacatcacaggcttcaaagtctcttcgatatgtgacatccaggaactgttctctctgaaaatgagtgagaacgcaagggagagagggagttgtaaaaatgagacagatgaatgaatttatggtttcagaggttgtgcatttatgaggagtgatgttgtccagggtgtagtttaagtctctagagatgaaaatgtcaagagaccagtggtcttgggtggtgaataagctatgacagccaggagttttggatgaataaggaatgattgggaggtgagtaaaaggcagccatagggagttgggacttgtgtatggggtttattaatgaagaacacatcaatttgtaattttctctgaagcattaagttatgcttcttttgattttagtcaaatatgttttttatgtattatatactctgaataaaatgtggcaatcatatagcattatgaatatagctactttaataaggctatctagctggcatattgattttcccagtaattctgaaaaatggtattttgtggtttctttgcatataaacagtatcagtgattgtggaagagtgaaatacactcgctttactttcttagatataatatacatttaaatttaaatctagaccttgactctttcctgtgcttatacagacagggtttccaaggaattataggtttacacttctgagactttgcttgagcaactatatgctcagatactctatagctcttattttgtaggaattatacaactaaattcttaatttgctattttaattttcttgaaagcaataaaatgttcaggcagcccttagtttagctgctgctgctttcaagtttgtgatctcatgaaaaagacaaaatacttggcctctgcaagagtcagtttcctcagtttaaaattaggagtattaacagtcgttatctaatagaatactgagcactaaaaaggatttcactgtacttgacccatatacacagcaatttttagttagtctcattactattatggttgttgtgcatatttgtatctttctaggggaagatatatactgcaaccattctcctgttgttttttaaaaattttgaataatgctttgaaattagataaataaaaattgtactgcaaggagtggcaataaagtttagtcaaataggtagaactctgctttcaaattcacaaaccatcagctaatcacatttatggtggttctaaggggtcaaacactcacttaggagtatcaattctgcaaaacaagaaatgtgatgacaattaccagaaaaaatcttgtgcatttataatatgttactattatttaaatgaaaaaagttatatacatgccaggtaatacttcagcaacttatgattatattttaatgtggtttctacaaagtttttatttctcctaaataaggtttctattcgtcatgcgaatgttatagaccttaggattggtggatctgctgaaattgctgatgtagaaatcaatcctgtgagtatgttacttatttgtgtgatgaaactctgagtgtggtgatttttatttgttatgtgtttctagttagcccatttatgttaaaaatattttccaatgtataatttttaaaaattactatatacaaagttaaaaattaataaaaattaatatatgtcatataaatgtaagtgttgaaacagaatattgaatgaaggtttaagaatttaccactgaatgtaaggatcagaacactaccagtaccattaaaatcatcttcattatggtcctgtcccttataagagataaccacttgcctaaaatgacaccacataaatatgaatatgaatgctttcattgttgattatttagtttgtttgtttttgagctttataacaaagatgtactatttgtagcctttggtgagttacttttacttaaatattgtgttttcaacattcacctaaattgtgtgtaatggtatgttaatcattgtcatactgcataatagttatttgtgtagacatactataatttacatgatcattcagttgttcatcccaataggtatttctgggttttttttaaacacaaaaactgtagctgtgaacatttatatgcttatcttctgaggtacacatacaagaggttctctcggaatggagttattgagacatagagttatgagtgtgtttaacttcacaagactattcctaaaatgtcctaatttccattgcttcaaattctattattctacaagttatattgtcagatttaaattttgccaatctattgagtataaaatgatacctcactgtggtattgattttcattttctgaactagaatcacatttatttttgcattattgtatgtaccctgaaaaaattttgttctataattgatagagtgcacacacacagacaaacacatacaccacttttttgttgttgttcttgccagcgctttagtgtttagatctggacttacctattcaaagaaactttccttgattcttcaaagtagggccccctcattgtgacatttataaggtattacagaaatcttataccctgggaacatcaccatcagagcagttgtcatattattttggggctatttgtacttttgttttttctcccactagtactgttaacatctaccaccatactggtgtggagctaaattgagcagaaattgatgataaagaggtcagcttgctgcctcaggtagggggctcactgctagtctgcatttaaatggcatcaccaaaattccagtgtatggctttaacttatacttttataacctttctttattcagtggtgaaggcataagtccaggtagactgacaaatactaagttagcttgtccaaggctgtggtgattcctggaggttaaactctgtagtatccagagtgttttttgcattactatggcatccttccttgaaaaatattagataatattgagtcttttatcactttcttttctcatcctaaagtcattttgggcatgctttgcatgttatggtacaactgaataatttataggactttaatatattttatcaatattcccttatagcattttagacatagctgactttaaaaaataatattcacacatcactagatatttttagctatacatttattaactatacagtaatggctaaggcattgactatgtgtcttaataacaattaggacattttactcaaatgagcacatatacaatgctcatttgcatatatgctcatttgaatgggataacaagagtgattatttttacatatacaaaacatcaaactttcattttccattttggattttacaaattttacatatacaactgcgttgacattttaaatgaaacaaatagccagtctactttcatacggaattctcctcaatattaggatgctgttgtctcgatctcctttaaatgttgtatgtaattctatcactaagaaactccatggtattttagtaactctactacaaggaggaattctaaagagttttgtgatataagcacatgccttgtgtgtgagctacagctcagatacacttaataaacattccttgtttatttaaggtagatgttggataggtgctagggatacaaaaatgaatcacgctaaggtccagtagaagagacagataagtaaataaatacataaataagttatgtgatatcataatataagtaaataaaagaaacagagttggtcctgagcacagcatgattaattgtggtttatccatctggggtttgaaggatgtgtaatattttattaggcaattgcaagttacagaaaggctttcctgatagaaggggcaccaaaagggtgaagacacagaagggtgaagcatcaggtgttggttggaaataccaagtcatacagcttgctgaaatattaagttatcacttaatagagtggagctagttgaagctggaacatgaggcagcagaagaccatggtgaactttatgagccctgctaatgagcttggacatggtcctgtagattgtgagaaaccatcaaattttaaaacaagaagcgatatgatcaaattcttaattagtttaaatatggcttcattatgaaggggagagtttgagaaaagtaaaaatctagaaactaaatgaaaagtgatgatttactaatttcatacagttacaatatggacaagaggtgaagaaaggggaagaattaataggatttattaacttattacatgtaggaggcatagaggaggtgggggagaggaaggaaaatgtgacaaatttttatagggttctgctttgtagttaataatttccttgataaatataatattgcaagttttagtttacattttcataaactattctattttctaattatttttattttttaaattttaggatgtatttaatttcagtggcgcctatattggtggtacccagattattccatttgtaataaaaaacaaaggtataacacgtgccagagtggagtttaatctaaaagactttccggatttttcaatggatcttaaagacaaatcaggtatatattttgtatataatggtattactgtaaaaggaaaacagttttaaattgccctgtggtataatttctaaaactaattcaatcaagggaagttcttcttaaatgtttttaatgaccactgcatgtttttcttacactctgtaactcatcatggttttatttgtagaaatacatcattattaatatcaaaacactttggtaatacatgaaacgtaaccgttcttattagtgtgttaaatatgctaagttaagtatgttatatataagtatatgccttaaatgaacataaaattatgaatcgcttgttttaattgctcaataattttagataaatgtctttggggagctatctctatatgtttactcatgtattagatatcttgatgttaaattagatttaaacaaaatacgcatttttgtaagtttactccataggttgtcaaaataagacctatgagccaaatatgagccatcacctgtttttataaataaggttttattagaacacgcacagacccatttgtttgtataatgcttatggctgcttttatgctatactggcagagttgaaaagctgtgataggaaccatatgtctcacaaagcttaaaatatttactatctggattcttacagaaggtttcctaatcattggtttagtcatttattattcattaaatatttgttgaatcccaattacaggcaagatagtagcgtttgagtccatacaaataagtaagacatcttacatatcctcaaaaagtgaaaagtaagtatatcagtgaggtaatggatatgcatttgtattacttacggactctttgagacatcaaaggagatctgactcttccctgatcaattttcactggaaagggagtctcctagctgttccgggacctaagatttagttaattacttgaccttgccctttattcctatttatattcatctgagtatgactataacatgcttcttgaactttggagttattttttaatgagtttactgtcactgttttgccaattgaatgtatatttgttccatgtatagatatcaattttgctaattagaatcttggtatttagaacaattctttactgagcatcttcacatagccctgcacaaatattttagaaattgatttttgattgttatgaatatgtgtactttttcacctcttacagaagaatttaaagaccctgcagttccttatatatattctttggaattagaggaaaatacatctctggaatgtagcataacattttctcccaaagaagtaagttcagttttctattcctcatattactgcagttatgggtattccgaaccaaaaacctattaaagatcacccaagatctatctgtggagggtttttctttctgacttgtaagcatgcctgggtataccttaattcagtaaaacgattgctggagggtttggctcatgctgcagagtgcctcaagaggagtggagggcatgtacaggggacctatgattgtgtggtctttgttatactatctagaaaattcaagatattacacattttgaaggagaggaaagttatattccaggcagttggtgctttgtacttatatttgagtggtgtatgctctgtgaaccactacctgaaattgtcaaagacatattgtgaagatttaagaggagttgctatgatattggctccttttatattgtaccccttgatgtttagtgatttaaaaacaagagcaaacaaacagacaaaaaacctattctgaaatgtgcccagaaggaagggagaccactggtcaggtttcaggagccaactctagcaggcttttgcttcacagattctctaacagaagtgcccaacgagagagcttctctctacgcatgatatgaaagtgcatatagccctataatcccagcactttgggaggccgatgccagcggatcacctgaggtcaggagtttgagaccagcctgaccaacatggcaaaaccccatctctactaaaagtacaaaaattagtgtggtggcaggcgcctgtaatcccagctactcaggaggctgaggcaggagagtcgcttgaacctgggaggcagaggttgcaatgagccaagatcgcgccattgcactccagcctgggcaacaagagcgagatttcgtctcaaaaaaccaaccaaccaaccaacaaacaaacaaaaaactgcatattagtgtatccttccaagcaagaatcaaacttctatgtggcaatcagagtataagattcttatgtcaaaacttttttttaatacaccaacataactaaattgattctgctcaataggtatagattagaattaagagaaaataactaatacacaataaaattgtattgaatgctactaaatgctatctttaataatctaatttttggtaatgttatttttactgagattaaattttatttcaggaaaaatgtaagctgttatttggctttcagatggaaaaaataaagtttgaggatgagtttgaatattagaaaatgataaagattaattttgctattttgaagttcagtacttcagttgagataagataatgttgaatagaaaaacatatttgtcttgttcctgaaagcatgtatcttacacctttaaatataaggttagcaacagttatcttttttaaaaaatttcctttattaggttgaggaagtttccttttatagtttattgagtattttgattttgaaagacctggattttgttaattttattatccactttgatggtcacgtttttgtcctttattatattaatatagtatattatattgattgatttttttaatgttaaaccaaccttgcattgtggaataaatctcactagatcataagatataattctttttatatattgctgaatccaattccctagtactttgatgaaggcttttgcatctatacttgtaaggaacattggtctgtagtttgttagccttattgtttttttttttcttctgatacctttgttttgaatatcaggctaatattggcttcttagaatgaattatagagtggtgtctccacttctattttggcagaatttgtgaaggactgaattaattatttaaattagtcttataattcatcattgaagtcatctagtcctcagcatttttttttaaaaaatattaattttaaactaggtattgaaggaacacacctcaaaataataagagccatctatgacaaacccacagccaacatcatactgaatgggcaaaagctggaagtgtgacccttgacaaccagcaaagacaaggatgctctctctcactactcctattcaacttagtattataagtcctggccagagcaatcaggcaagagaaaaaaataaagggcatctaaataggaagtcaaattatccctgttttcagacgacatgattctatatatagaaaatcacatagtctcagcccaaaagctccttaagctgataaacaactttagcaaagctggaggatacaaagtcagggtacaaatcactagcatttctttctttttcttttttttttttttttttttttttagatggagcctcactctgtcacccaggttggagtgcagtggtgcgatctcagctcactgcaacctccacctccccgattcaagtgattctcctacctcagcttcccgagtagctgggagtacaggcatgtgccaccacacccggctaatttttgtatatttttttagtagagatggggttttgctatattagccaggctggtctcgaattcctgacctcaggtaatctgcccaccatggcgtcccaaaatgctgggattacaggcgtgagccactgcaccagaccaaaaaccactagaatttttatacaccaacgaccaagccaagagccaaatcaggaaggcaatttaattcacaattgctacaaaagaataaaatatctaagaatattgctaaccagggaggtatatttcttcccaaaagaagggaaatgtgtattcatgtccatacaaagacttttatgtgaatgctcatagcagcattattcacaatagcttaaaagtagaaacaacccaaatgtccatcacctgataaatggatgaacacaatgtggtatatccatactctataatattatttggcagtataaaggaacaaattgctaatatgtcctgctagatgaataaaccacaaaaatgttattttaagtgaatgcaactagataaaagagagtacattttttatgattccatttatgtgagatttccaaaagagacaatctatagagtagatcagtggttacctggagttaggcaaattgtcatgaagaagctcttggggttgatggaaacattctaaaacttaattacggtgatgattgcacaattctgtaaatttactaaaaaccattgaattgtacccttttggtgaaatatatctcaatacagctgttagaactgtaaaaaaattattaatgtaatctgtttgctgttataggtctgtatttataaaatgttctgtttcttcttgagaaatttcatttaagttacctaatttattgatatatatgtgttaatggttttttttttatttctgtaaggtaggtaataatttagttcgttctttcattccagattttataaaattgagccatctctctttttatcttggtcagcatatctaaagttttgtctgttttgatattttcaagatccaacttttggtatttctgatttgctgtattatttttgattctttatttcattcatttccactttatctttattattcatttttttctgtttgatttgatcttctattcttatttttaagtgtgaaatgttagggcattgatttgagatatttcactttttaaatataggttttatggctacatactttcctctaaatactgttttacatttaccccaaaagttttgatatgttttattttcagttttactcttcaaaatattttgcaatttcccacataatttatttttcacctattagttatttggtgtgtctcgtttaatttccacatatttgtgcatttacctagtttatcttattgatttctaatataattcccttatagttagagaacacacattagttcatttaaatcactttaaatttattgcagcttgtttcatgacactctatgtaggttatttaactatgttgcagtaagtctaaaacaactaatgattacatctggatgtgtatgtgtatgtttgtgtgtgtgcacatgtgtgcaatggtgaaatgaggggaatgctcattattttaaaaataaactttgtaagattattttttcaaatttgtattcttattattatgatttttaaaaaccctctaaataaaaagaaactaagtaattcttttctcacaagttagtattctgataaattaaggtatgtcattcacctatataatgtttatatctcacatgtacatagaagtatgcagacatacacacacacatacacacacacacacaatttcaacaagaaaaaacctaaatgttctgcagtaatttatagatttttaaaaattattttaaggccaagtttatgtatttttctaataagtctatattgtgattttatattttcatataattgaaatgtatataaaacattttacttaaggatcattgaaaattagaaaaatctatcatgcaatttaagtatcttacatgacttttttggagaatgtattatatataatatatttagacaatagttcaccaacactgtcagcaatttaaaaagttctaagtatttcttaatgtttaggattctagaaattgatcataaaattaaaattaattatatatatttaaatttctgtgaagtgccacactttgcttagattctgaatcattctacgttaactgggtattttaaaaagaagatttacttagtgtattggagtgtaattcacttcaacaatgagaagaacatatcaactcctgcagagacagcacaccctttgagaatttattctataaatctgtgccagtaaggcagattgattatctggtttccagtcatttcaaatgtcctccactatatttattgctaggtgtaagttgtccatctttgtgcatgtgtcaaaatgtaaatagcaaattgatgctctcttggttgacctatgtagcaggaaaatgtgaaatcaacaatacatgattgatttattgttagttgtaaaccttcctttcctacactgcaccaggtttgagcacaacctgaagtgctagtagtcaaatgcagttgtatttggcattttcaaatggatttgtttattttctgtaagtcactcaagctcctccttttcttgtgggctactaacgtgtcttcttggtcaatatatggaattgtacttcctatatggtagtcagtacctacatatggctatttgaattaaagcttaaatttattaaaattaagcccaacagaaatgttgtttctttatcacaatacctacatttctcattctgtagattcacacgtggctattgtacaatgcagagcattttcttcatgacagagtttcactggacagcactagtatagatctttccctattattactcctatttttcctgctgctatgacccaggttctgccctgaagcataggctggttcatcttcagtgccttagttactctgcagctctttgcaactttcatctttgttgctctgtattttccctgcagtttttgaatgtgagggagaattgttcatgctttttatttttcccactagccttgatctgcgatttaaggatatgcagaaccttgggtaaacctttcataacgattattctagatttacaatcattcttacgggaagctaagaataattcctcaaggattaaaggaaaggacatttgaatgacacctgctccttttcaattcataaacatgtctgtctaccaacactggactgggtactgaaatctgacttcattagaatatccttttcaatttgaggtattcctgtctttgaatgacaacatctgggaaatcacttaaaatatcacacatcacaaaacgttcaaagttttctttcctcattgaatacctcagtgattttataatgatagggctcgtcttttctttcaatgtgtcatttagtttctgtgtaaaagataagtcttgtattcttgcagttttgttgaagggagaagacttccatgggcaaaggaatcatggaacctcctaatttggcattctgtgtaattatagacctactttggataaaaacatattttatgcaaattgtgtgtgaagatgtcagttaagagaagacaagtccagtatgacttttcacctatacctacttgataatcagagaaggcagggattaacccttagccttgtgaattcaccacacagttttagaaaaattgtatgtttcaggagggagaaaggcttcatacttaaaaaagacagttaagggctgagatgagtacattgaattatctcgataattaccaacagtcattatcattgacagtcaccaacagtcatcaacaaagacagcatcagacattttaaaatagagccctcagtctggtcctgtgttaaacctgtcccataacttcagctttccactcctatcatccctaactttgggacccagcactagactcgaagacagacagtgaagactcaagccccagtaactgtcgattcaattcatcatgactcagattcctctttatttcagtcattctccaaaattggagcatcctgtgaatagcttctcttccctgtcagctctgattcccctcacacttagcttcccttccctttttctctgccctctagtgtccctacgcttctataagtcctctgtatttttctgggcttcctttttcttcatgatttcttctcattgggaacctggctatctcaatagcactgttttttaaaatagcatttcctatgaatcttgctgtgggtctagaagtgatcctttctggaggccttgttccctggggtgatttttctagagggtccttatctgttaaaaatgcctgcttctggctgggtatggtggctcatgcctgtaatcctagcactttgggaggtcgaggtgggaagattacctgaggtcaggagttccagactagcctggccaacatggtgaaaccctgtctctactaaaaatacaaaaaatagccgggcatggtgatgctcacctgtaatctcagctactagggaggctgaggcaggagaatcgcttgaacccaggaggaggaggctgcagtgagccgagatcacaccactgcactccagcctgagtgacagagtgagactctgtctcaaaagaataaataaataaataaataaaataaataattttaaaaagcctgcttctttgaactttgtattgtgtggctttgccagttcccctctgtgaaatctctggtgagtggtctcttgtgaatagtcatctccagacatgctcctggtcaccgccagctagactcatagtatatccggtaccctactcatctcattttctgagtgatttcagtatccaaatggaggtttatccagaaccctggcctcacacttcctttttcttcacatttctgttgatgtggaagaaactaagtgacacattgaaagaaaagatgggtcctatcattataattttccttttcttcacatttccagtcccctcagcttctgttaaagactaatgtccatccagcaatcagatgaagatgacagtttgcgaaacatactctttggcagtatttgactttaaaatatgagtccatattattaatatataaaaaagccttaaaaataaaataatagcctaaaataatagtaatattataatatgtatgatattaataatcaaattaagaaaaaaagcagatgaaccagaagtggaaaaataaaaatgagacacaaaatataaccagctgctgatgattaaatgctaagattccagggaaataagatcaagcaaagttgttgttgttttttcttatctatgaaatatcaaaacaggttgtatttgaacatgaaatactacatctttatgcaatttattccttgatgtctgcaagctagtgccactgcagaaatagattatcatgggaatgaattgcttgctgttttgaccaaagagttgaaacctcaggaaaataacatatgagcagtattttaggcttctataatttggttataagaatggactgtacataagattctatgacagaaaatggaattggcagtggtacagccagttaaagttaaataaaaatagaaacccaagtgttttgcctattagggcaatatgaatgactagagctgaacatatgcactttataatattcagctcctcattttatttaaaactgtttagattgtcagcactgagtttatgagtatagcacagtactagatatatgtacctctgaacccatcaatgcttgttgtcatgaccttggaggttttggcatgtgagaagtactattattcttcccttttcacatttaaaatattcacattcttgcctgttttctacctcccacctctagaagtttaccaaggtaccatggaataacagggtcgaccatcttaatattttttaaacataaataatgtaaggttttggtaaaaaaaaatcaacacaaagtttaaaaacgtcattagaaaaaatgaatttttattttaaattatctgtaatgtaacttgaaatgcaataagaattttctcatacatatgtaaatattttagcagtgatattacttccgtagcattttcagctttagtatagatcaattttatttttatcaatttaaatttctaataaattatgtaatttataattttattttcaaaattgagatttggatcttgagccataagaatggtattctctttgaattaacccttttttatatggttgatagtaatgtccataatctcatcttttattttagttattcatgtctcctctcatttgtttactgtcagactagtttaaagttttgtcgtttttttttttttgagatggagtctcgctctgttgcccaggctggagtgcagtggcatgatctcggctcactgcaagctccgcctcccgggttcacaccattctgccacctcagcctcccgagtagctgggactacaggcacccgccaccatgcctggctaatttttttgtatttttagtagagatggggtttcactgtgttaaccaggatggtctcgatctcctgacctcgtgatccaaccatcttggcctcccaaagtgttttgtcatttttataatatttttaaacaaccaactttttgtttattgattgttatgatttctctgttgatattctcgtttcgtgtatacattattttcatgacattcttttgttcttttctatggtttcctttagttctatgaacgtatttaagacagtggctttaaagtctttttctaataagtcctatggctgggatttcttcataatcttttgttttgttttgttggttattgaatactggacatttgaatattataatttggtaactctgtacatcagattatcctcctttctctgggtttactcttcttgcttattgaaggctgtagtcatccatttgtttattgacttttcaaaactattattgcaaagaatacattctttgctatgcatggtcactgaagtgtctgttcctttagctggtgttgagtagtgttttgagatatatttccttgaatgccaggaactaaaataatcagacacataaacaaaaacacctatcatagtctttttggatagagtgtcctgaggcacttcttcagcagttagcgaggttgtttacaacaatttcttagtttttacttaccacttgcacttagcctagagtcagacaaagatgaaagtttaacatcttctcaggtattttctgagcacatgtcctactctgagtgtccttgatgctttctaaattctccagggcacttttaaatgccttaatttctccaaaagctctcctacttttatttccagactttaggtagcgtttgcatgtctcaaccataatattctgtcaggtggctttgggttttttgtttatcttacaatattttttaacaatttcactgcttttctgccttgagtgagttcaaagataggcaaaacatgccaagcacattgcatcagtccttcatgtacccccaggaaggttagaagagataaacacagtaatttctgaatgaagtctgttttgtttcatcaaaaaccaggtatctttgtttaagttccttgtagattgtgggtattagaactttgtcagatgggtagattgcaaaaattttctcccatattgtaggttgcctgttcactctgatgctagtttatttgctgtgcagaagctctctaatttaattagattccatttatcaattttggcttttgttgcaatcgcttttggtgttttagtcatgaaggctttgcccatgcctgtgtcccgaatggttttgcctaggttttcttctagggtttttatggtttttggttttacatttaagtttttaatccatcaaaagatatgaacagacacttaagacatttatgtggccagcaagcattaaaaaaacatcatcatcactggtcagtagagaaatgcaaatcagaattacaatgagatactatctgatgccagtcagaatggcaattattaaaaagtcaggaaacaatagatgccggtgaggctgtggagaaataggaatgcttttacactgttggtgggagtgtaaattagttcaaccattgtagaagacagtgtgacgatttctcaaggatctagaaccagaaataccatttgacccagcaattccattactgggcatatacccaaaggattataaatctttctactataaagacacatgcacacgtatgtttattgcagcactatttacaatagcaaagactcggaacaacccaaatgcccatgaatgatagactggataaagaaaacgtgacacatatacaccatggaatactatgcagccataaaaaaggatgagagcatgccctttgcagggacacggatgaagctggaagccgtcatcctcagcaaactaacacaggaacagaaaacaagcaccacatgttctcactcataagtgggagttgaacaatgagaacacatggacacagggagggggacaacacacagtggggcctgttggtggttggagggcatggggagggagaacattaggacaaatacctaatgcatgcggggcttaaaacctagatgacgggttgttaggtgcagcaaaccaccatggcacaagtatacctacgtaacaaatctgcacattctgcacatgtatcctggaacttaaaataaaaaattaaattaagttaaaaaaataaagaaaacaggtcccagggtcttgcactggggaatgaagtctgctagcctcaagacaactgctgagtcagagggagtggcacaagggcaagtaaaagtgccacaaagctttcctactatttttaagttgtctttttttttttgattcagtgttcacttgattgctgtaaacttttgacttttttccagttctgacaacacggttcctgacagtttttatgtgtttttcacgtttctgtggggccatggacatttggagctgcctgtttaccatttggctgaagccaacctttttagttttgatacagcccccaaacatgaagatcgactctttcttttctctttgatgcagactctgtgttttcatctagactggaccacatattctttttttgaaaatgaggggctagcactatataattgcaaatatattttgtagctctgagtgttaattgttttatgattcacctgcctgggtgccgatattgtcagtccatttcgggttttgaatccagatgtataaaaatcacagccaaggaattcgctttaactttttaaaaaatgtgcataaactaaaagtctctttcggatatatgaacaattaacaaatgtatacaattgggcaaaaaataacaaaatcaatatagagaacagttgcatcaccttctgtacattttcttgtgtgtattactataggctgtgaagggtactaggtgaatgagggggaggtatcgatggttaatgggtacaaaaacatagttaaaaagaatgaatcaagacctagtattcatcccctcctccacctctagtccatggcaaacactaatctgaatttgactccataattttgccttttatagaatgtcatataagtgaaatcataaggtattcataaggtaatcatgaggttttcagtctgacttctctcacttagcataataaatttgaaattcatccacattattgtatgcaacagtagttcattcttttattgttgaaaagtaagtttgttattcattcaccatttggagagcatttggattattttcagtttttggcaataatgaataagttgtatgaataagtttcacttctcttgggtaaacacctaaatttgggagtcctgagctttatgtgaaatatatagttaactttctaataatgaagaaacttgtttttcaaagtaactataaaattttgcgttctcatcagcaatgtatgtgttttacgtgttcacatgttatttttgtttaagcagttgtgataggtgtgaagtgatatctcatatggtttcaatttgcatttccttagtatgaaacatctttccatgtgctaatgtgtaatttgtatagcttcttttctgaagtgtcttttcaaatatttcaccaacttttttcattagttcattttcttaaattgaactttgagtattctttatgtactttggatacaagatagattttttgtgagaaatgggtttttgacttatacttttattttcttaataatgtcttttaaaataacagattaaacaattgatactgtacaatttaattgcttttcaatagatagtttaatagatggttgcttttgtatttaagaatctttgcttacccaaggattacaaggattttttttcctataatttcttcctaaatatttaccactttggattttatatttaaaatctggttcattttgaatgaataagaattattttaaaaatttatttttatttttttgaattatttttgaactcattaaaaatgaaccatcttttttttaaaaatgtagttcaatgtcgcaagataattttattttttaaaactgctttttaaaaactgctgtttggctaaataaatagtatcccatatttcgcaaagcaaaaattaacaagtataatgtattttttttgtatcaggtgacagtagttgaattcatcattcaagttcagattaatttctttgagtcttcaaagctctacactaaatatttgtccagttctccttcgaatccaaaaacagtaccacttatccgaccatgttacgttcaagctactggtatgtaatataaaataatcaattggtgtgggtaggccaaagatttacacttaagtgtctaaaagataaaaaatagaatatgccatttgtttttcataaatggaaatattagaaaataaaattttaagaggattcctttgtgtgtcacttaaattgagtctatgagatttgagtgttgacaaacagcgcagatataatctctggcaagcaacttgctaaaaaaaagagaatagaatgaaaatcaggccaatttagtacattattatgtggtcaattttaaataattaagacaaaatataaattattaaaatattacaaaatgcatttaacataaaataaaataataagaattttgtttaagaacatatctctattccaaagggatgggttactaaaagactgagtacatgaaaagaagaagtattttagaaatttgaaagttttgctgaatatttatctactcattttcttcaaatattaaaagataaaaactgatgtactctgcaaattacatttttgcaagttggctttgctttcaattatatatgtatatttttcatgaaaagaaaagaagtctatattttgtttttatagttctgatattaagttaaatcgtcattaattctaaaatagtagggagtatcatatcagttaataattgcatttggtaactagtaagagaggtctcacgaaaatagcatgcagatgataaaaatatttcactctcatttaaaatccagaattaggaattccacagctgatatggaggctcaatgaagttaaagtttttccctttgaattaagaatttcttttggaaagtaatcataatctaatattgcttcctgaattaggtagataagctttcaaaacatttacttgtttgaaaattaaaaattaagatagcattgttaaagaaaattggaaaatgtagaagcaaaaatatctgaaattcaaatatttaaagtgttcttaatattttgatatcttttttgttctatacatcccttttgttaatgtatttttttaatatgcttgtgatcttactgcttatgctaagttgaaaccagctctgtttcattttattttttaatttttagtttttgggggcacatagtaggtgtatatctttatggggtacatgagatgttttgatactggcatgcaatgggtaataatcacatcatggaatatggagtatccatcccatcaagcatttattttttgtgttagaaacaattcaatgatactcttttggttatttttaagtatataattaaattattattgactgtagtcaccctgttgtgctagctaatactaagtcttattcattctttctaattatgcttttgtacccatataccatcccctcatcctgcccctcatccacctactacccttcacagcctgtagtaaccatccttctgctctctgtctccatgagttcaatcattttcatttgtagatcccacaaataagtgagaacatgtgatgtttgtctttctgtgcttgccttatttcatttaacataatgacctccagttccattcatattgttgctaatgacaggatctcattctttttatggataaatagtactccattatgtatctgtaccacattttctttatccagtaatctgttgatagaaccttaggatgctttctaatttggctatcgtgaacagtgctgcaacaaacatgtgagtgcagatatctctttgatatactgatttcctttcttttgggtatatgcccaacagtgggattgctggatcttatgccagtcttttttttttttttttttttttttgaggaaacttcaaacttttctccatagtggttctactaatttacattcgcatcaacgaacagtatacaagggttccttcccttttctccgtatcctcaccagcatttgtttttgcctatcttttggacaaaagccattttaactgaggggagatgatatctcatgtagttttgatttgcatttctctgatgatcaatgatgttgagcacattttcatgtgtctgtttgccatttgtatgttttcttctgagaaatgtctattcttttgctcaattttaaatcggattattagattttttctcatagagttgtctgaggtccttacatattctggttattaacccatttgaagtttgaagtttcctcaaaaaatacaaataaagctagcatatgatccagcaatcccactgctgggcatataccgaaaagaaaggaaatcagtgtatcaaagagatatctgcacttccatgtttgttgcagcactgttcatgatagcccaattaggaagcaacctaaggttccatcaacagattactggataaagaaaatgtggtacaaatacacccttgtcagatgggtagtttgcaaatattttatcccattcgggtattgtctcttcactttgtggattgtttactttgctgcacagaagctttttaaatttgatgtgatatcgtttgtccagttttgctttggttgactgtgcttatgagtattattcaagaaatttttgcctggaccaatgtcctggaaagtttccccaatatttccttgtagaagtttcatagtttgaggtcttggatttaagtctttaattactttttattttatttttgtatatggtgagagatagtggtgtagtttcattcttctgcatatggatatccagttttcctgtgccatttattgaagtaagtcttttccccattgtgttttcttggcttttttgttgaaaatgagttcacagtaggtgtgtggatttgtttctggtttgtctatttcattgcgtttgtctatgtgtctgtttttctgccagtaccgtctgttttgattattatagctaggtagtataaagtcaggtaatgttattcctctagttttgaacttttgcctaagatagtggatcttttgtggttccatataaattttaggattgatttttcaatttctgtgaagaatgtcattggtattttgatagggattagattgactctgtagattgctttgggtaatatggatatttttacaatagtgactcttccaaaccgagaacgtgaaatatcatccctttttttggcgtcctcttcaatttctttcattaatgtttcataattttcattgtagagttctttcacttctttgatgaagttaatttctaggtacttaattttatttatggctattgtaaatgggaatacttttaaaattgctttttcatgctgtttgctattggcatatagaaatctactggtttttctgtcgattttgtatcttgtaactctactgaatttgtcatttataatattttttgatgtagtctgtagatttttccaaatacaaaataatgttgctctgcaaacaaggttatttttacctcctcctttccaatttgtatgcctttatttctttctcttgtttgattgctctggctaggatttccagtactatgttgagtaacagtggagaaagtgagtatccttgtcatgtttcatatcttagaggaaggctttcagtttgatactatctgtgggtctgtcatgtatgacttttattacgttgaggaattgtccttctatctccagttttttgagggcttttatcatgaaaggatgttgaattttatcaagtgttctttcagcattaatggaaatgatcacatggtttttgtccttcattctgttgatatgatgtatcacattgattgatttacatatattattccattcttgcatcccagggataaatcccacttggtcatgatgaatgatcattttaatatattgctgaatttgatttgctagtattttgttgaagatttttgcatcaatattcatcagcgatattggcctgtcctatcttttttttttttttaaatgcgtcattgtctggttttggtatcagaggaatactggcctcatagaatgaatttggaagtattccattgtcttctgtttttcagaatagtttgaggaggattggtattagttctttaaatgtttggtggaatacaacagtgatgataccaggttttccttactaggagactttttattatgtcttgaatctcatcacttattattggtctgttgaagtttggaatttccccctggttctgcggtagtgctcctcacacgggggcaccagttgtgggggggtctgtcccttgcagacccctgacccagcgacagatgaatgaagtacaccgacacacagatattctgctttgccagtccagctgaatgtctgagcctcttagagactccagcagagtcctgtaaacagttaagactgtggcctcaatcagtcagtgagatttgcatttatttagtaaagattaagaggtcctgagtaaacatcactagagggtaaagattcaaggccaggttcctcggcctaaagcaaacacgatttgcaggtaataaacttctgccgacctcctcccccgagtaggaggcagttaagcacctgtggtaggacaaaggttagtcttaggcgcatataagtaaacagtttggtaagataaactccacacattcctttgtatttgcaccctaatctttctggctcctgcaaagagaccctggctgccttcagccaagcaatgtgaagctatgcaaactctcaggccttccaagagaggttgtcgctattactataactatctttaatatttttcccacccgcctgactgaaccccaacatggtgcaatcttggtgcattgtatgtgtctaggaatttatcaatttctcctagatttttccaatttattggtatatagttgctcatagtagccactaatgaccctttgaatttctgcagtatcagttgtaataagcctttttaaaaatctctgattttatttatttggatcttctctcttgttttttagttagtctggctaaaggtttgtcaattttgtttaactcttcaaaacaacaacttttcatttcattgatcttttgtactctcttcatttcattttttaaaatttctgctcagatcttatttctttttttctactaattctggtttgttcttgtttttatagttttttaagatgcatcattaggttatttgaagattttcctcttttctgatatagacacttatagctataaactttccttttagtattgctgttgctgtatcccataggtttggatatgttatgttttctttctgtgaatttgtatagtttccaaaattcctcttattattgatttcttgttttgttcaattgtagtcagagaagatgcttgatataatttcaaattttgaatgttttaagacttgttttgggacctgacgtatgattcttcgttgagaatgatccacgtgctgagaagaagaatatatattctgtagccattggatgaaatgttctgtatatatctattagatccttttggtctatagtgtagattaagtcaaatgcttctttttggattttctgtttgggagatctgtccaatgctgaaagtggagtgttgaagactctagctattattgcattcagatctatttgtttctttaggtctaataatatttgctttgtatatctgagtgctccagtgttgggttcatatacatttataatcgttatatcttcttgctgaattgactcctttatcattatatagtgaccttctttgtctcttcttatagtttttgccttgaaacctattttgtctgataaaagtgtagctactcctgctcttttttggtttctgttggaatgaaatatcttttccatcactttgttttcagtctatgtgggtctttatattaatagatgaattgtgttgcttataggcagcaggtcactgggtcttgtacttttatccattcagccagtccatttacatttgatgttattattgttaagtaaggacttacttcttgaattttgttatttcttttctgcttgttttgtggtctttgttttcttctttgtttccttcctgtcttcctcttagggatggtgattttctttggtgatataatttagtctctcactttttatgtttagtgtatctgttgtatttttttggtttgaggttaccatgaggtttgcaaatagtatctgataacctttccttttaagctaataacaaggtaacactatttgcatgaaaaacaaataaaaaagcaaaaagaaaactaatgaaaactttatgccttaacttcatccctctgctttttaactttttgttgtctctatttatatcttatggtactatgtcttgaaaaggtgttgtaattattatttttgattggatcatcatttagtctatgtaagagtattttacacaccatagttacagtgctataatatttgttttttgtgtgtcctttttttaatttttctcttttttgagatggtgtcttgctttgttgcccaggctggagtgcagtggcatgatcttggccctgcaaccctcaacctcctgggttcaagtgattctcctgcctcagccttccgagtagctgggactacaggcatgcaccaccatgcctggctaattttttgtgtttttatttttttaattgtttatttactcattttactatactttaagttctgggatacatgtgcagaatgtgcaggtttgttacataggtatacatgtgccatggtggtttgctgcacccatcaacccatcatctaggttttaagccccaaatgcattaggtatttgttctaatgctatccctcccctttccccccaccccccgacaggccacgatgtgtgatgttcccctccctgtgtccgtgtgttctcactgttcaactctcactaatgagtgagaacatgcggtgtttggctttctgttcctgtgttagtttgctgaggatgatggtttccagcttcatccatgtcactgcaaagaacatgaacttattttttatggctgcatagtattccatggtgtatatgtgccacattttctttatccagtatatcattgatgggcatttgggttggttccaaaaaatatggaacacttcatgaatttgcatgtcatccttttgcaggggccatgctaatcttctctgtatcattccaattttagtatatgtgcctctgacgtgagcacttgtctgtgtccttcttattcccggtgagttttgtaccttcagatgacttcttactgccaattaacaccatttgctttctgattgaagtactccacgcattccttgtaggacaattctggtgttgatcaaatcccttagcttttgtttgtctgagaaagtcttcatttctccttcatgtttgaaggataattttgccagacatactattctaggctaaaagttttttttcttcagtactttaaatatttcatatcactccaacctggcctgtaaggttttcactgaaagatctgctgctagacatgttggagctcctatgtatcttatttgtttcttctcttttgtctgcttttaggattctttctttatccttgatcttggaattttgattattaaatcccttgaggtagtcttctttggcttaaatctgcttggtgttctataacttggatatctatatatctttctctaaatttgggaagttctttgttattatccttttgaagcaactttctacccctgtctctgtctgttgcctctttaagggcagtaactcttagatttgtccttctgaggctattttccagatcctgtaagcatgcttaattttttttatttttatttttattttatctcctctgactgtgtatttttaaatagactgtctttgagctcactggttctttattctgcttgatcagttctcccattagaactctgatgcaaattgcatttttcagctccagaatttctggttgatttttaaaaattatttccgtctctttgttaatcttatctatagaattgtgaattccttttctttattatcttgaatgtctttgagtttcctcaaaataactattttgaatcctctttctgtacagtcacatgtttctgattctccaggattggtcccttgtgtcttatgtagttcatttgatgaggccatgttttcctgggtggtcctgatacttgtagatgtttgtctgtgtctgggcattcaagagttatgtagttattgtagtgttcacattctgagattgtttgtacgtgtccttcttgggtaggttttccagatatttgaaaggacttgggttttgtgatctaagctgtgtctgctttagggggcaccccaagcccaataacactgtgattcttgcagaatcagagagggaccaccttgatgattttggacaagatccagaagaagtctctgaattatcaggcagagacttgatcttttcattactttctcccaaatgaacagagtctctctctctgttctgagacacatggagttgggagtggagtgatacaagtacttctgtggccaccaccactaggactatgctgtgtcagacctgaagcacagcactcagtttcacccaatgcctcctatagccactccctggctaccacctatgttcactcaaggccctagggctgtacaatcagatggtggcaaaaccaaccagtcttgtgtcttttccttcaggacagcaaattcccccaggccccgggtgggtccagaggtgttgtcctggagccagggactagagtcaaaaaccttacatgtttctctgatgttctattatactgcagctgagctagcacacagaccacaagatgcagttctccccactctttcttccccattccaaaggcagaggaacctcatcatgtggccactgccaccacaggcccacagggagtgctgccagactactgctgatgtttccttaaggcacaagggctcttcagtcagcttgtggtgaatgctgcctgtcctgggactcagccttcagagtagtgggctccccccggcccagggcatgtctagaaatgtcacccaagagccaagttctggaattgggaatcccaagagcccgcttggtgctctcccccactgttgctgacctggtacctaaggcgcaagacaaagtccccattacttttccctctgcttttctcaccctatagccaccacagctcttaatgtgctgagtctcacctgaagccatcaagtctcagagtttcacccaaggcccttgatgtagaacttgggagtcactgctgattattcaggacccataggctcttaacaggtgatgaatactgccaggactgagttctccccttcaaggcagagggtgtacttctggcccacggtgtttctagaaatgtcatgtgaaagctagggtctggaaaaggagcttatgaccctgactggtgccctatcctgctgcagctgagctcttatccaaaatgtaagacaaagtccttcctgcttttgcctctcttctcctcaagtgtaaaagagagggatctctttgcagctgtgtgctctgcagccttgagttagaggatgtgtgatgccagcacttacttagctcccccagctggtgtcttattaggtcacgtgcctccccagaacactggctctgggcccagctcggccattaggacttacctaggaattgctgtccatgtgggctagactgcctttcaattttatctagggttccacagcactttattttgaggtggcgaggcttgtgggaactcagttttcgactactgggatcagtgattcacttctggctagggctggtttaaacactccctccatgggtagatgtcagttgtgtttgatccagtttgactttctgctctaatagggcagtaccgtactgccactgccgggtatttggaacaggtgatgtcagtgattcatgactgttttacctacttcttcagcctctttcagtgttatgaagttgaaaccaggtgctgttagtggtcacttgatttttggttcttatgaagttgctttttttgtgtagatacttgttaaatggtgacctttgcagggaggaccttctgtttcaacattttgctgcactcattctctctctgtttaatcttaatagaatgttttacttggatattgtagttccttattaattatttaaattaaccctgagagctagtgcaaaaaaaattcatcccgtaagtatctcttctaggtgacctaaacgtcatcataagcatttaggttgtttcttccttttaccttcttgttaatataaatattgtggtagtgaaaattttttgtataatactttttttcttatttagaattttttggagagattctcaaaatggattttattatttctaaagtgcatacatgttaaaggttctagatgaatgttgtcacagaacatttctaaagggttgtaccgttttactccctccttggtgtaaaatcttattaatgttgacttaaagaaattggctatcttgactggtaatttctgctcacacctataatcctagcactttgggaggctaaggctagagggtcccttgaagctagaaattcgagaccaacctgggtagcacagtgagaccctgtctctaaataaaaatgaaaaaaaaaaaagtagttgaatgtggtgacgcatatctgtagacccagctactcaggaggctggggcgcgagtatctcttgaacctagtggtgagctatgatcctgctactgcactccagcctgggtgataaagtaagatggtgtctataaaaaaaaagaatttgtatatctttctctgtgattaaaaatatattatttcaatgttcagtttgattgctcatgaggatgagaatttcctacctttgcttttaattgtatatttttatgtaacttgtctgttcatatacttcacctttaagtaaagtacctttgctttttaagtttttgtatttgtctggtacatttgggtgagctgtttatattatttttatatttaatgtgaatgtcttccaagatttgttatttgcctttagtattattcattttccgatagatctctttgttaaatttatggaaaatctctcttgttcatgacgtctaacattgcttgaaaatttagaatgtctttgtcagctagagggttgataaatatgtaatactttattagacattttgtacttccaaaaagtacatatgtaacgcatttacagatatttttgtccttccacaaaaatttgagatgtaaaatcagacttacttgtattatataacttaaccaaaaccaaagttcactaatgattcaaatgatacaagaaaaattaggcaaagatgtagcatttcttcttcaagaagatgagatctgtcagacacatcttccaaattgttcttttctcccgccctaggattccttttagttttgaattaacaggtgcgtttttaaatttttattgtgtatatttaagatgtacaacatgatgttttgatatacatatacatagtgaaatgatttctatagtcaagcaaattaacatatccgtcatatccatcatcccacacagttacattttttggtggcaaaattacttaaaatctgctctcttaggaaatttccagtacacaatataatataattaacattagtcctcatgctgtttattagatcagtttgaatgacatttctataaaccttgttcccaaagaatgccatttttgtttgatgctccttatttttgtactcttaatagttacatagatacaaaatgcctatatgataaatttctactccttgtcatccatgctccataaattcataaattctatgtatttttgataagctctctaggcagatatgtcaaaggccttcttcttataagtccactgtgaacaccatttcaatgttaacaaaaaactctgatcaagtccatcattaactccaagggagttaattttttgagaattttcatgtctgaaagtatcatttttcctcccacatttgaatgatataattcgattgaatatataattttgtattcaaataatttttcttcaaaattttgaaactatggttattgtcttctatcttctcttgtatttagaaatctgttatttttcttctatatccattatatgctactcagtgtttcctctttgaagcttttagaaacgtctcttttctcctggtgttccattattttatactggtgactttcatgtgaatctgtcatcatatatatatatgattatatatatgtgattatatatatatgattatatatatatgattatatatatgattatatatatgtgattatatatatatgattatatatatacacataaatatatatttaggggatacaaatgcagatgtcttacatgcatatgttgcatggtggtgaagtctaggctttaagggtacccatcatccaaatagtgagcactgtagccagtaggtaagttttcaaccctcgccatctcacaccatcccaccttttgtaatctccaatgtctattactccatggggtatgtccatgtgtctccatcgtttacctcccacttaaaagtaagaacatgcagtatttgactctgtttctgagtgattgcattgaggataatggcttccactttcatccatgttgctgcaaaatacatgatttcattcttttttatggctgagtactattccatggtgtgcgtgtatgtgtgtgtgtgtgtgcatgcatgtgtgcatatgtgtgtatcacattttctttatccaacatgtgcaggtgtctttctgatgtcatgatttctttctttttgggtttatgcccagtagtgggatggctagatcaaatggtagtgcaatttttagttctttgggaaatctccacactatttccataaatgttgtactaacttatattcccatcaacagtatataagtgttcactttttttccatagcctcactaacatctgttgtttttttagtttttaatagtagcctttctgactagtgtaagatagtatctcattgtggttttaatttgcacctcgctgataattagtgatgttgaaatgtttttcatgtttgttggctgcatgtttgtctttttttgagaagtttctgttcatgtcctttgcccactttttaatggggttatttgttttgttcttcttgatttgttaagttctttacagattctggatattagtcctttgtcagatgcatagttaatattttctcccattttgtatgttgtctgtttattctttctcttgtttattttgctgttcagaggctttgtagttacaataagtcccatttgtccatttttatttttgttgtttttggttttgaggacttggttatgaattctttgcctgggtccatgtctggaagagcttcttctatgttttcttgtaggatcattatagattatggttttatatttaggtctttaatccatttttaattaatttttgtatatggtgagaggtatgggtccagtttcattattctgatatgaattttaggattgttttttctaattctgcgaaaaatgacattggtactttgatagaaattgtgttgaatctctagattgctttgggcagtatggccatttgatgataattgattcttctaatctgtaagcattaaatgttttcccatttgttgtgtcatctgtgttttctttcatcagtgttttgtagctctccttatagatatcttttacttccttggttagtattttatttatttttaagctatcgtaaatgagattgctgtcattatttgatcctcagctagattattgtttgtatatagaaacactactgatttttgtatattaattttgtatgctgaatctttacagaattcatttatcaaatctcagaggtttttagtagagtctttaaaggatgtcagattttatcaatgagcagggatagtttgacttcctctttttcagtttgggtgccttttatttatttatttatttctcttgcttcattgctttggtaaggactccagtactatgtggaataggagtgtgaaagctggcatccttgtcttgttccagttcttacaggaaatagttttaggatgattggtataattctttgtatgtttggtagaattcagctatgaatacactggtcctgggctcttttgggtggtagatttcttttttaaattactgattcaatgtctttactcattattggtctgttcaggagttttattttttcctggttcaatcttagagattgtatgtttccaggaatttgtccatttcctctagattttctagtttgtgagtgtacagttgctcataatagtctctgatgatcttttgcatgtctgtcatattagttgtaatgtatctgttttcatatctgattgtgtctatttgaatcttctcccttctttgttagtctggctggtataatagcttatccgttttttaaacactttctgagaaccagcttttctttttgttaatcctttttgttgttttttagtttctatttcatttagctctgctctgatctttatttcttttcttctgctaattttggctttggtttgttcttgttttcctagttccttaaggtgtaaaattaggttatttgtgatctttcttcttttttgatttaggcacttaatgctgcaaacttccctcttagcaatgcttttgctataacccacaggttttgatcttcactattgtgttccatttttgtgttctttcaaatggggaactcatgtcctttagttctacaaagcattcataaattatttcctgaaaattttcaatcatcgttttctatattctcagattactattggttggattttatactttatggattatgtcatatatgtgtatatatatgcgtatatatatttatttattatcttaggcagtctctcttattgccattttcctcatctttttattgaatttcccaatatttttcttacttgacttttctaaatcttaaaatcttattttggcagttttaaattagcaagagttcttagtatttactaattatttatttatagcctgttatttttggaaaataataccttttatttctaattataatatgatttcattgacttttttctgttgactacattttcactacttttactgaattatttcttcctttatgtctctctttcatgttgaatagttctttaatatctattgacccttgcctgtttgctcatgtttattaatacctctcaaaaggctggctttatcattaaatattatatcactgtctggcaatcaggatactaatgaatgttttaattttaggaagtatgtctgggaaattagtctgtgatctttaatcttaggtggtttggtttcttcagaaaatgattctataaaaatttgtgataggcagagtataacttatttgttttaatgaaataaggctctctaaatggtgaagtaatatgccagaacaatgctttgtttttaaagttatagtcaacatattattttcactggttattcctagatgccaatttgtaaatggaaatacaatattacatgtgccacttttttatatatctgtggtaacattgtctcttttaggatttcacatgacaggttttgggagtaacacaaggatgaacactatccataactttctcctatcccacatgtcctggccccctgtcaaatcatccattaattccagtggcataataaaaacacgtgtaagatacatacatttttaggatcagaaattgttttattttatttactttttttttcaaaagctggtgataccctttagttttcattaagaattacaaatgtcttagaggtaagtttcaagaagtataggttttttccagtagattataatatcttctctaatgcagtgagtatttttacagataccccttttcttaatcttccatagaatagccatttactcccagagttttcttgttttatctaggaaatgttacatactatgccagctaaatattttctctgtattccaataaattttccttctgcatttctgctcacttctgtgttgttcaaactctagtgtggagatcattttagctctgtttacttttttcttagctcaatttcatcttttttattatctcaaggataattttcctattttacttataattcattaccattaaaaaaattccacaaaagggaactttgttaattcaataaaccaagatattttagaaatgtttttaaatgttattttattttctggttgggaatataaaaatatatagaaacaaatcttattttcttattgtttagtgttttaaagtatactaaaaagtacctatgggcttatatctgttgacattttatcagtatatttatgttcctctcacagcattgcaatcaccattgaacttatctagtactaagtttgtatttgaaatccctttacatgagatgaatcctaataacaaggtcacaaaaactcaggtatgtataaagaagtgatacagtttacaattcttttcatgattatgaattctagtttgttaagttgattattcataagcatgagtgatatgaactattccctatgattaatttctccccaattgtttatgctcttcggagcaagaataccggcattttttagaaaacttacagataaaatttctcaggagtaattttcaaaatatacaaatacatatacagctatttataaatacatatacgcatataattaataagaatattaaaataagtttaatataattaaattattccattctccttatacaaatggaagctatgatttaaattaatatgaaatatattccatagataaaagaaaatatgctaggaggcaataataaatctgaataataataataataataaagtagcttctctattgagttactattttttcttaaaggatatctctgcctctcttctaattaggaaggaaaacagacatgcataaaaaagaagctcagcacacattatagaaatttgtatttgcactgcccctttttgtcttatatattgctatacctgtaaccaattttgaacctttatagcattgaagaaaaattatatggagagaatatttagccttgcattaataaaaaaatagcagagtgctatataaaattatagttagagatcaataaaggatctactgaaattaaaatgtgactgtttagagtatcaaaagtcaagaaaactactttgaatagaacttcaaggatacaaagaccttatgtgtggggctagaaaggcaactttaattaactgaatttaatggatttcagataaaaacaataccttcataaatgtgagattattttatatcattgaaattttattcaatcgatgtaagcaaagaagatctagacaccaatagcattctctcttttgaggagaaagagggacattggccccatggagaaaaaaaaaacgtgactctaatcttctacttaaacttcccatgaatgatatttgcagtcataatatataagatatatggtacagagaagacgtaatatgtttatggaaggttaatttgactaaaggtttaaggattttggaataaagaaataaaattcattttacatagtgggtaattaaaggatattgtctaaagtacagagaaaaagaaaaacaagagatatatatattttgcttaaaattaccaagttgactaatggaagaattttaaaattttaaaaaatatgaatatccaaaataggaaaaaaataggaagtggagctgagtcttcatttttcctagtgggcagtcaaaagacaatatctgaagctgataaaccataaaatactcatgctgcaggcagataatggccccaaagatgcttaagtattaatctccaaaatttgtgaatacatgaccttatatcacaaaagatactttgctgacgtaattatggtaaaggactcggagaagggaggattttcctgaattatctaggtggccccaatctaataacatgagtggttaaaagcagagaaccttttctaactgtgctcagagggagatgtgatgacagaagggtcagagtgatgcagtgttcaacttagaggaagaaggccaccaactgaggaatgcagctggcctctagaaactagaaaaggcaatgaaatgggctcttccctagagctttcagaaaggaacacagttcctgctaacacgttgatcttagccaaatgatatttgcgttggacttctaatctacagaactgtgatatataacaatatatttgtgttttcttaagtccctatgtttgtggtaatctgttatggcagcaacagaaaactaacataagccatattggcgtcacatttagataaaaactcaaatcacaattggctaaaattggttgcttctgggaagcagaacttttgatgaagaggaatttggtgggacaactgcttttaaacaagcattttgaactttctgtgtaagctgcatacatatatcattttgacaaaaatataaagaaaaaataacactaaacatactgaacaaattaaccaatatttctttatagataactgtatcatttcatttctcagaattataagatatagaagatagatagtattttggaagtataataacttttcctcattttaaaatgacaaaaattaagcttcaaatggctggtatgattttgtgctcatttcctgtattgaaacatgttgttttctttagaatgtgtaaattaaccttttatagttaggatataccaatattagagctaaatagatgcttgagtacttcaaggcttgggaaaaaaattggctcgttgtttatcctatatgttttaaatcaatcatgctttagaaagaaatgaggtatgtattttgttgtgctgataattgtatggctcattctatagtcttcaaatatttgaagagtaaagttaatgaaaaaacctggttgatagttttattttaatagcaggttacattggaaagatgagtctgcatgcaagtcaggcccataatgttcagatttactaaaatgtttcaaagctagtgcagagaatttctgatagctttcacccaactttacctaacattaccttacactaccatagggcatttttttaaaatgagaaattaacattagtacaacattattgactaaacaacagactctattcagaaatcaatggtttttcactaatgtccatttactgtcccagggtccaaccaggatagcacattgcatttagtctcatccaacctgtgacaggctcgcaatcttgcttattttttattatcttcacgattttaaatagtatttgtccagcattttttgaaaatgtcttttaatttgagattggtgtttttcacctgattagactgagtttttattttccatgggttttggagaagaatgttaccgaggtgaaataatttttttatcacatcatataaaggaatacatgatatgaaaataactaattactggtgatgtctgctaggtttctccactgtgaagttactatttttcacttcccatactctatcctttggaagtgtgtgatcaattttagcctacaatcaagtggtaggaggttaagctctacttatatattacatgtattacttggaaattttctttaaaaaagattatttcctctccctatttatttattttattacataatatgttagcatgaacacacatatatttatttttatactttcagttataatttaatattacattttttattttgttgctaaaattgtttctgctttggccattataagctcttctacgttggtcctttgacaggctcccatcattgtgattttgaagtattttcttagtggtactaccaaatgttccaggctcatcttttattttacttgctccagctctaaaatcaacatttctccaagatcccctagtactttttattgtagaatgatatttagaaaccaaggtctaagtactgtgtataagagttgctactgcattgtcacaggttctaggccctttcaacaatagagtcaggaaatatgtgtatatatactaatccacatagacacatatacctataattatttatatatgtgtccctctctctctatatatatatatccatacatccatctaacaccagctcagactgatatctctaatctagcaccacaatgtccattcccatctttctctcttactcatttttgactaatttctctgacagtgagaaatctgcctctcattttttacacttcatttacttattttttaatcctaacttcaaataaagaagtttcagaatttctaacctgtggcctattaaaattgctgacacgtttatcacctagagtacattattcatacacaattcttactctttagccttgtagctttcagtcaaaaacacagtttttcaaagttactgacgtcaatttctccctaccctaactacattcaatgaggttatttcacacatttgtaagacagtgtatcaacattccaagatggattacagactgtgatgcactgtattacagctgggttgcttgtttttgatttacatacatttaagtttacataagatctttgggttttgaaaaatgcatggaataatgtgtctaccacttcaatgccatagagaacagtttcatcagactaaaaacccctttgtttgtctaatatcattttaaagcattttatctatgattaatcatttgaatttatacataggctcatcaaattgagatggtaatacaactaaactttagattgcatgctataattttaaactttttttgtctttttgtgtgtgtgagcagaatcttgttttatataatattaccaaacaccatgtgacatggactttggatcttagtaatactggcaaacttttcaaagacggcacattcaagttcagtgtactgaatgggattctacgaccaaatgaaaagtataatgtttccataagtttctgtccaagtaagatattttctcctatatttgtagttatactttcaatttacccttcatatatgaaattgttttattatgtatacagaaatttagattatttgttatttcttttaatttgaataattataaataatacaattttattaatctcatttttgaatgttacattatttaattgacaaagttggtatatattcaaggtgtacaatgtgaggatttgatgtatgtatacattgtgtaatgattgccacaatgaaattacttaacatatccatcatcacccatgttgtacattagatccccagaaacttgttcatcttataactgaaagtttgtaccctttgatcaacgtctccccatttcccccactcccaagcccctagaagacaatgccctacactctgcttccatgagtttgactttttagatttcatatgagtgagattatacagtaattgtctttcagtgtctgacttattttacttacaataatgtcctctaggttcaatcattttttttttttggaaagggcaggattttcttcttttgtatgaacgaataatagtctattgtgtacatacatcacaatttctttatccactcatccatcaatggacacttttataatctggctattgtgaatattgctgcaataaacataggagtgcagatatctgagatactgatttcatttcctttgagattactggatcatatggtagttctatttttaattttttgaggaacgttctcagaattctgcttatcacattcagccactatagtgcaatgtaatctgtttttcattttattagacttataaaatacccaaattccgaggacactaagttttacacatgtggtaatctagataaaatacccacaactggctcagttatcagtagaagttcaggcagggtaagaatctattatagctttaaagcttattagagagttcattgaagtgtgctctctctctctcaataatattctattagcactgtgttgcattaagttgatgttctactatatctattagcatggcattgtataatcattttagctttgtgtgtgagaaacatctcatagcatattatgattagtaggcttaaaaatgtttaatctttttattacctctctttaaatctctgaaaatatgatagaaaataccaactattctttgcattctgaaatttgtttagtaaaaataattgttttattatgtatttctctagtttcatctccatttcttccatattctggtttgaaagaaatagcacaaaggctattccagctgaacctaccatccatttttctgttcagaacttctcctttatgtgcctgtcgacatttatactcagataaaatggactggactggtccatctagaaggaaataaaaaacatttccatttgacttttctttcaatatgcgctgggccctagcagtcatatctgtcgtttcttttattaggctcccaactttactctttgttgttgttgttgttgttgttgttgttgttgttgttgttggagatggagtctcgccctgtcgcccaggctggagtgcagtggtgcgatctcagctcactgcaacatttacttcccaggttcaaacgattattctgcctcaggctcccgagtagctgggactagaggcgcactccaccatgcctggctaatacaacctaactcttaagaatcaaacatgcttaaaatgcctttataaattacatctcagatgagagagaaaacactctcagcttaaaaagggtatgattgaatctccaatagtctgaagttatacaaagaatccccttctctatcaccctagaaccctttaagaggtctgaaattctgaaataatctcaaagtaggcctttcaaaatccagaattcaataaatcttaaaaccttccctaactctgaaattattttttctccccaaaacaaatttaaccatatcaaatttatgaaatgaaaccattatttccctatagatttgtaatgttttaaatacatacattctcttatagcttattttatcagctcaaagtatacataatttatttaaatttttcacatagtctttccagtactcatttgtcattattagtagggagcccattatttttctattcctcctctcctttcttctccagctgcctccctttttccaagaacactagactacttacttgatcaggtaaagggcttatttgattaagtaatggccttcagtacagagagcactagtatggctgatgatttcaatgagttcattgcttttgcttctagcactaagtgccacttttgaacatggtcttgcatcacccagtgcactgtcattttctgctctgaagatacccttgatggccccaatctttgctaaggggcactggtgtcccatttgagggttctaagatatcagcttgaaatcacaatcactgggtcactcttttctctctatcacacactattcttggagatttcgatgtgaaagggtattgatcactctctgtgatggaaactgtccccagaaactagctttcagcttcccgtgttgagccctgctctctaacacaaactatcttttctcttattaagctatggcatgggaatttcctgtcctttcctaccaggtaaaattggccagtcaaccctggtagtatttcttaaacttaaaaatttgggatacagcacattcctttcatctcaggacctccttttctcagtagtcccctgggatccttatggcaatgatctatcctcatcttcatactgcatattttaaaggcctgggaagcttctattaaaacacagaaaatacttttttaaatgttcaattgcactgctttcccagggcatatttattttctccaaattatgaaaatctacattaaagagacttgctccatttctagtcaagctgtactttaaaatagttttctttcaacagcacctcattacatgtcttaagttcttcagcaagctaaatcttgtttctgggtagtttattctgtcccattaagttgtaacatcatcgtacattttgaaatttagtaatagttcagctatgtaaattttttgtgtgttttaactaatttaaaatacccttaaaatttgtttttcattagatcgtcctgggacatacacagcagatattcctatgcttttaaattatattccagtttgctataaaatattacatcttactggggaagtaaaatcaccagagttattgtttgaccctccatttatatttttcactcctgttcctttggatataacaactgtaatggatatcaacattttacctcaaaactatttcaggtaaatactcaatgtgaatttaccacattttctttatgtgcttttttgtttgtttctgtgttatataagaattatataagaatggcttgtttctatagttggaaagaactattaaaatatttaaccatacattaaaatttaacaaaaaaaccaaaaaatctttcttaattatctcacagttagtcattgaattttcttgtaaattttcttttgctgtgtctctcttcatgaagtaataagcaagcctaaaaattcaatatattagttttctagtgctatgtgaaaaattatcacaaacgtggtgccttaaaacatgcatttgatatctcaaacgacatgaatttgtttattatcttgcagtttctctgacttagtagtccagctgtcttagctgcatcctctgctgagtgtctcaataagcagaagtcaaggtgttggctgcagtggcactttcacttgaggctcagtcttcctccaagctctcaagttgttgacagaattgatttcatggtccttatagaactaaagcatcatttttttgcctagggacactctcagtccaccctcaagtcctagccatgtggtcacatcctcacaacatggtgtacaactaattcaaggccaaaagtataccatctctcagacttctctgcttctgactttcaaaccctcttttgtgatctcaactgattatgtcagacccatccatgataatttccctcttgctttattcaaagtcaattaatcagagaccttaattacacctgaaaagtctataaatatatatagtgggaggctatgttgtttattgtagaatgtttagcagcatccatagcctctatccaatagtgttcctccccatgatatgacagaaaatatgtatctctacacatggctacttgtctcctggggagcaaaatcaccctcagctgaaaagcaccaaagtgaaatgataggaagagatataacagcataaccaaaataaagctgggtagcagtattaatttcaaatgcaataacctctataggtaaagtgtgtttttaagatataaaagtcatcaaataattataaaagattaaattcacctgaaagccaactgaattctaaaattctatgtataattaaaatagtcttaaaatgtgtcacctccaaattaaaattgggaaaatatgactagtccttcataactctaggatattaaaacatgtttcagaagtgttgatgagtccagagacaagatatttgaacaatatttgtaacaagcttcattcatttaacatgtataaattgcacgttacaattagagaatacacatttttaaatcaatcatgagacatttatagaaattgacaatgtatgattctatagttataattcaagtctcaaaaatttttaaagggttgacataatatagactatgttctccaaaaataaatataataaactaaaagtcaataaagaaaagataacaagatccaccatgagttagaaaatgttaaaaaaattctacagagtgaaagaagaaattatactgaatttcacaaataaataataattaaaatactagattccaaatcttgaaaacattcactgaggatcaggagtgtataatacaatcaagtactataaacaccatgtggacattagagctgaaaactaaacgtaaaacagctactgggacttctactacttcctttagaaaaagaattaggccggcatcattgtttactttatctgttttattaaataaacatcaaaatttcagtgattgaagaaaaaaccttaataaagtacagcaaaattatccatacatggaaatatataaccttaaatactgatattaggaaagaaaaaaatgattggaaattttaaacattcagctttataagtaagattacaaataatagcctcttagactaacttatggggtgtagaaggtgagataaaattatacacagtagaaattaaaggaatataaaaatatatacaaaacagaaactcagtggaaccaagtttcttctttgaaagaggaatacaatggatactaatacagtgaagttgacaaggaacaaaacagagaagggacagttaaataatattagaaataaggaagcataaccataaatccaaagaaaaaaatgagataatcaaaatactataaagaggtctattctaatacatgtgaaaacttaaatatgaaagttgtagaagtatataatttactaaaaatatactgggaataagtagaaagcctttgggttaatacttgaaacttcacgagaaaacatcctctgatgattttacagtcaagttttactgaactttcaggaaacagatatatcaaactatagaataataataatgcggcctaatttgttttatgatctcagaaatttctattatgaagtcaggaaatgacagtatagaaaagctgaattattggctaaactgtgttatgagaacatacatataattatccttaaagaatctaccagcactttgggaggccgaggcgggcggatcacgaggtcacaagatcgagaccattttggctaacatggtgaaaccccatctctactaaaaatattaaaaataattagccgggcatggtggcacatgcctgtaatgccagctacttgggaggctgaggccggagaatctcttgaacctgggcggcagaggttgcagtgagccgaaattgcgccactgcactccagcctgggcaacagagcaagactccatctcaaaaaaaaaaaaaaaaaaaagaatcaaacaacgtgtatgtaagatagatcatgaccaacttgtttgtattccagtatttcaaggcttgtctatcatcaaaaaatctaaaatgtcattaaagagaataatgatatgatcattttcatagactgagaataaaggtatgtgatataatttttaaatcattcatggaaaaactctcaacaaacagtaataaaatagatattctttaattgtttaaggttcctatcataagcctagagcaaatattattgaaactggaatatacatgaattaccttttaacaagagaaaagtcaacaatgcttattatcactgcttccctaaagcattttaatagagaacctagcacatggcagggggataagaaaaacaaaatgtataaggattaggaaataaaactcaaaactgtcattatctgtatattagattattttttcatatagaaaattcaaagaatctacaaggagattttttaaaactgggaagatcacttatcaaaataggcaaatataacttaaatacttaaaattcaatataatttcagcatataatatatagagcacacaactttaaattactacttataataacatcaaaaattaaaagataatagattaaaagataatagataaatataatagataaagatatgaatgagctgtatagaactgtataaagaaaattataaaactcaagttaaatacgcctgtattcaaataaataaataataaactcaaataaatacaccgatattcatggattggaatattcgatgctgtaaaaaaagttttccacaaataaatttacatatttcatgtgacttcaataaaaattcaactaaagttttcatggagattgaaaagtaaaattttaattttatatggaagggtcaaggatcaagaacagctaagctccccaagaggaagaagaataagatgggaagtgctttccatagggaacctcaagactacaccaatatgatagtggtacaggggtagataaaatgaccaaggaataaaatagccttaaaaaagtttcatagatgaatagttattggatttatgatgaagatgttattgaagttctttggagatagaaagttattattcagtaaatgatggaatgattgaatatctgtatgaaatattccaaattgtattgtatctctgcttcacacaattcacaaaaattcattacaaatgtattaaaagcttaaatatgaaaggccaaatgtagaaactaagtattaaaaacatttaagtattaatatatacaaatatatatagttgtattaaaaacaaataagtattaaaaacatttaagtctcatgtccttttaacatttcaaaagcaatcatgtcttcctgacagtctcccaaagtcttaactcattccagcattaactcaaaagtccaagtccaaagtctcatctgagacaaggtaagtcccttccacatatgagcctgtaaaatctaagacaagatagtcacttccaagatacaatgagggtacaagcacagggtaaatgtccatattccaaataggagaaattggccaaaacaaaggggccacaggccccatgcaagtctgaaacctagcatggcagtcaaatcttaaagctccaaaatgatctcctttgactctatgtctcacatccaaggcatgctgatgcaaagggtgggctcccacacccttggccagctctgtccctatggctctggagggtacagctgttgtggctgccttcacaagctgatgttgagtgcaggcaacttttctaggcacatggtgcaagctgttggtggttctacctttctggggtctgcaggatggtggccctcttatagctcaactaggcagtgttccagtggagactctgtgtggcacatacaaccctacatttcccttctgcactgctctagcagaggttctccatgaggactctgcccctgtagcagactttggcctggacatccaggtgtttccatacatcctctgaaatctaggcagaggttcccaaagctcaactcttgtcttctgtgcacctgcaggcccaacacgatgtggaagccaccaaggcttggggtttgcattttctgaagcaatgagctgagctgtaccttggccccttttagccacagctagagctggagcgtctgggacacagggtaccaagccctgaagcttcacagagcagcagggctctgggcacagcccaaaaagccatttttccctcctaggcctctggccctgtgatgggaggggctgttatgaagatctatgacatgccctgcagacattttccccattgtcttggctcctcattatttatgcaaatgtctgcagctggcttgaattcctcttcagaaaaatgctgtcttcttttctaccacatggtcaggctgcaaattttcgaaacctttatgctcttattccctttgaaacattagttccaatttcaaaccatctcttcgtgtatgcatacaactgaatgctttcagaataagcctggttaaaacttgaatgctttgctgcttagaaatttatttgaccagataccctaaattatctccatcaagttcaaatttccacagatctctagggcaagggcgacatgccaccagtctctttgctaaagcatagcatgagtgacttttactccagctcccaataagttcctcatctctatctgagaccacttcagcctggacttcattgtccacatcactatcatcattttggtcaaaaccattcaacaagactctagaaagttccaaattttcactcatcttcctgtcttcttctgagccctccaaactgtttcaaactctgccagttacccagttccaaagtcacttccacattctcaggtatcttacagcaatgccccactaccttagtaccaattctattattttttatttctttttcagattgttatctgttggcatgtagaaatgctactgattttttatgtttattttgtaccctgcaactttactgaattgatcagttctaatagttttcttgcagagtctttttcaaatataagctcatataatctacaaacaaggatattgtacttcttcctttccaacttggatgccctttatatctttctcttgtctgattgctctatctagaaattccattactatgttgaatgacagtagtgaaagtgagcatccttgttgtgttctaaatcttagaagacatttttcagtttttctctattctatgtgatattagctgttggtctgtcatacatcacttttatcatgctgaggtatgtttctcctgtccccagtgttttgagggtttttgtcctgaaggggtaatgaaatttatcaacttggtgttctactccgctgtggctgtgctggtacctcaggtgcaagacaaagtctcctttactttttcttctgcttttcacaagcagaacaagttttgccccatagccaccacagctagtaatgtgctgaatctcacctgaagccagcaagtctcagagggtcacccaaggccctcaatgtagtacctgggtattgctgctggttattcagggtccaagggggctcttcagttaacaggtgatgaatgctgccaggactgagtacttacagactccatggggctcgctcaaaatgtcatttactttgttaggtaatgttcaacatcatcaaaactttgggatttgcagttcctttaagaccttatcttataaatagacactaacctttgttgtttaaacgggaaatagtagtggcttcaattaaattgtgctagaaagcagttttaaatcaataatcattttctaatatatgaattaatctcttaatttttcaactttggaattaatgtataaaggtatcaatttaaaagctacttcaactcaaaagttgagtcttgctaaatatggtataatgaaatgaatatgagaggtactgaagaaataatgtaatgcagtgtccaagttatacatatgtaataaaatcaacagcattaatcacttatgcaaagataagttaattagctaagtaataactgaattattttcaaactggatttataaattactttccatgtttttattcaaggtagcgtataggtttaactaatacaattttagatctttattttttcttattagctaaatagttctcatactgattaaaatagcaaggatatataatttccatttgatgatacctcttatctgccatagatatgtaagtttttacatatataagtaaacaaagtaatatgattaaatatttattggtcactaaaaataataagtagtaattcaattttaaagtgaatactattaatacatatttttatattaaaaataaacagtttggaatggctataaaaagtataaatgtataattaagtatgtcaacattaagtggaatttttgaatggtaatgattgaaaaacattcataatatatgtatatatgcgcttaatagtatccaaattttcaaatatctacctacatgtatatgcatctgttattattattcagtctatatgcattaagtttgtacctattaaagtgataacttttggtaaattttcatcagaatacatttaaaaacagtaatttctatcatgatggtgattaagaaatattgtgtttaatcaggtgtcacatgtctttttaatccttatagaacaaaaggaatatttgatcatctcaagtggttcttagttatcatccatcttatattgtgatcagaaaataagagatgatacaaagatatctttaataattaggcacatgattacaaatatttcttattttaattttcttgaggattcaaaaaaatgaaatatacatttaaagccaatgactggcaggtattttgagctaatgaaacattttttttattttaaacagaaattcaactctatgtgtccagattcccacagtaaggcttcttgatggtgaagagattcaccctctttctgtgaaatttccaaaaggcagagtcatcccaggctctcacagtggaattaataataagctcacttgccacctcagtttcaagtcatctaaacctgtgtcattttttaccaatcttcttttctgtgatgacagaaaaaactggtaagatatctaaatgtacattattttgtatctgacattaaagaataacatatttatattttacaccatggtaaaatgttaaaaagagagggatctaatataataaccttggacataaagattatttctaaaattccaaatgtaagtgcgctctcacaaaaagcagcataatagtggctaccaatttatactctggagctagactgcctggggtcaaatccaggctttgttaacattacttctgagactctcagtttcctcatctatgaaatggagctaatagcagaacctatcccatctgtcatcatgaaaagtacagtgagttagtaattattgagcaattggacaggaaataacccaaaggaaatgctaaataagtgtcaactgaaagtgagaaatatcaacataatgatttccctacaatatagctttgttgcatgttactttaacggggtgaggagatttcaaatacatcttggtaaaatgatatttctggatatcttatcttataggaccagaaataccatttttacatcatatcctgaaataacttgactaactaaatggcaagaggttgaagtgtagagctataaagtttgtttaaaaggcttataatgaaaagtaaaattagtgtcagagtatgttctctatgtgctcatttattaacatttagaggcgtcatttgtatatttgtagttaaaggactgattcatgtgtttggcattaggagagggacatctctcttcttaatacatagaaatatcttcttcttaatacatcatatttcacaacatcccatttcaatcatcagcagatttgtgataaattagagctattggaactaatttagaaactttgcaaatcatagatgagcaacaaaagacttttctgtacacccagataaacaaggcactaaggccataagcattccccagagccttaatactggcaaatccttttactggtgactggttaactccttatctggttttctacagtgaatatgatcagatcctcttactcttctctactctccaatgctgtccttgcctttctctctttaggcataccatttctgatctcattgagataaatgaggtcttccagaaaggaattcctcaagagcttccttttcattttagaatttctatgaaataaattatactcatttattattggtaatctattagcatatatttattgtaggcaaaccatgtgtgtactctgcccaagatttaggtaaagaaagggggcaaatccttgatggatgtcagtgtgttaggttttttgccctatgttgaagcctttatttgcatctggtttgttcatatggaagcccatgggcctaattaaaaatataagactgatttcttgatttttttgctttcttttactttgtaagattctttcataatgtggcttctcttgggggccaacatgcttggcttttaattttgttttctttagattttgtcacatttggattggcccaaccagctggaaatctgtgaataatagcaggaataaatattttctgctaatctgtctgctttcccatccacaataatgtgctcccagctcagagattgtacaccctacttgcgtcttacccaaattccccaaaaagtctggggatagaagttttattcaattggtgcaaaagcaattgcagtttttgccattattttcaatgtcagaaaaaccacaattacttttgcatcaacctaaatatatatctgtgtgagaaatggtgatgtgaataaggagtattataaacagtaaaatgaagcatgaggtatggaggctaaagcaacccatattttaatggcatttttggtgttacggtttggtgaattctggcaagacttagctggggatgaaactgaaaaggcagcaggaacagattatgaaagtcgtccatgctctgctttgctatccatgagtgagaaatagggtgagaaccaggagagtgtgatgttatggatatcaagtttgaacaaatacaggaagcataaggtctacagctattaattaatacaagtcaggtactactcataggctagatctcatggaatccgcacaatagtcctgagaagtggggttttttttctttttttttgtttctagattatcatctctgttttatagaagaggaatctaaggctcacagtgtgacctaacttgtccaagctcactcaaacattaaatgggggagccaagaatgtaaaccatattttggtttccaaagattttccacttagtcaccttattttaaataccatttagactataaataattatatagaaatttttataataagcatatgttttcgagggttacactactatatgtcatatatagattttccaaagaataagagatgttttctttctttcttactcttctgcatgtatttctctctctcacacacacacacacacacacacacacacacacacacactagtgaaacttctgtgttccacatatagtaatgatagaattacagtctactcaataagtactgaggcattattaatttattttgctcaatatattaattaatgaggcaaaatctcatgaatcgtctctatggttatagaataaaatcaaacaaatatgaaatgtgactgtgtattcaaagaacgtagttgttgtggttccaatgacatcaggagcaatggacccgcacatttgttattggccggtgttcagaagtgttagtgtctcatacagtttggctgtgtccccacctaaatttcatcttgaattgtagctcttataatccccacatgtcatgggagggacccagtaggaggtaattgaataatgggggtgagttatcctgtgctgttcatgtgatagtgaataagtctcatgagacctgatggttttataaaggacagttcccctgcacgctctctcttgcctgccaccatgtgagatgtgcctttgcttctccttcactttctgccatgattgcgaggcctccccagccatgtggaactgtgagtccattaaacctctttttcttcataaattgccccatgttggtatttcttcagagcagtatgaaaatggactaatacggtaaattggtaccacagagagtggggtgctgctataaagatagccaaaaatgtggaagtgactttggaactgggtaacaggcagaggttggaacagtttggagggctcagaagaagatagaaaaatgtgtgaaaagttggaacttcctagagacttggagggctcagaagacaggaagttgtaggaaagtttggaactttctagagacttgttgaatagcttagaccaaaatgctgattgtgatatggacaacaaagttcaggctgaggtggtctcagatggaggtaaggaacttgttgaggactggagtaaaggtccctcttgccatgcaaagggactgatgggattttgcccctgcgctagagatctgtgaaactttaaacttgagagagacgatttagggtatctggcagaagaaatttctaagtggcaaagtgttcaagaggaagcagagaataaaagtttgaaaaatttgcagcctgatactgcagtagaatagaaaaacccattttctgtggagaagttcaagtcagcagcataaatctgcataactaacaaggagccaaatgttgatcaccaagacaatggggaaaatgtctctagggcatgtcagagatcttcacagcagccctcccatcacaggcctggatgcctaagagggaaaaatggtttcctgagccaggtccagggtacccctgctgtgtgcagcctagggatgagatgccctgtgtcccagctgctccagctatggctaaaaggggtcaaggtatagcttaggccatggcttcagagggtgcaagtcccaagccttggcagcttccatgtggttttgaacctgcaggtgcacagaagtcaagagtcaaggtttgggaaccttcccctagatttcggatgatttatgtaatcacctggatgtccaggcagcagtttgctgcagggtggagcccttatgaagaacctctgctagggcagtgtggaagggaaatgtggaatcagagcccccacacagagtccccactggggcactgcctaggagagctgtgagaagaggcccaccatcctccagaccccagatccaccatcctccagaccccagatccaccatcttccagcccctagatccactgacagcttgcaccatgcacctggaaaagttgcagaccctcaatgccagcccatgaaagcagccagaaggggggctgtaacctgcaatgccacaggggtggagctgctcaagaccatgggaacccatctcttgtatcagtgtgacctggatgtgagacatggagtcaaaggagatcattttggagctttaagatttgcctgccctgctggattttggacttgcatgaggcctgtagcccctttgttttggctaatttctcccacttggaatggctgtatttacccaatacctgtcccccattatatctaggaagtaattaacttgtttctgattttacaagctaagcggtggaagggacttgccttatatcagatgagactttgactgtggaattttgagttaatgctgaaatgagttaagactttgggggactgttgggaaggcatgattggttttaaaatgtgaggacatgagatttgagaggggccatgggtggaatgatgtggtttggctatgtctctacccaaagcttatcttaaattgtagctcccataatccccatatgtcatgggagggacccagtcagaggtaattgaatcaggggggtgggttttttcttgctgttctcatgatagtgaataagtctcacaagacctgatggttttatgaagggcagttctcttgcacacactctcttgcctgccgccatgtgagatgtgttttgcttctcctttgccttccaccatgattgtgaggcctccccagccatgtggaactgtgagtccattaaacctctttttctttaaatattacccagccttgggtatttcttcatacagtatgaaaatggactaatacagtgtcattaacagcaaagctaatattgaagtgtctgctctatgaatttattggcacagaaactcctggaaagtacctgatttagttgtccactcaaagccaataaaaattgattgttttcctaatcatggatgagatatagcatagtagaatgattgaccttttcttaaaaataactaaccacattcttgcttaattttgcaagttgccacatttgaggaactggattatatatatcctctgcctttaaaacaggtacaataaaattttgcacataaagataaattaatgcatttataagtgttttaaataataaaaattagaattcttacatttttcattgaggttttaattaatcaatacattcagactttagagataaaactcatagactttgttgcaaatgtacttaacatttttctgatgagaaatatatttttaaataggcaggtctgatgtttaaaactgagaatatacagctgttaattatattagctcttttcctctattcagtagcattttatcaaccatgttatgggtttataaacaacttttgctgcataataaagcttcttatacttactctcattgacaatcacttaaatggaaattatactatttttagaaagcattcaatacaattagaaagaattgaggaataatgaaggtaattctaaatattgttctgctcagtgcataatttggcatttgggtagagtgtgcttggcaccattgggtcagtccctagtgctttaaaatgtatatttagcatgcctctttcagataccttcctgtttttgaatggataggaaactgcatcacataaaggaggctagcagagaatgaatcagatccagagtcaaatcagtttgaaagcacttattcactcaagttggcaatgctaccttaggaactgtagtgtaaactaatacctgctttttatgtgcctttttgggatatttgatattggatatttaaaataagtatgtagatatatttgaatatatatttaaattaaggcttataataagcaagtaatgtgagttgcgtacctctgagggatactaccaggtagctacaggcaacttttgaggtactcaaagctctccttatggattaagaagaattactaaggatagattcatcttttggagactccattcttaatgcaaaccatttacaatggtccatctcaaattttagcatcatggcaacaaaaggcaggcaatgggaaatcttagtatccatttaattgttcataactgaagtcagtatggtaatattacctcaaaacattatttgtcatggtttggggggatgagttatgcataataccatacacttgtccaccttccttagtgttgtgtgtgtagatagaataagcagtgaggaagggagtagagttcacatgagaccgctctgtgttctgatataatcatctgctctgtattctttgtcctagccctgtgaaaagctgtttgtaatggcaccttcatcctacaaagaacattattttcatggttaatctattcaaacaaaccatagtctctatacaaggtagaatgtttcatttatatttaacaaaaaatataatactggtgtgtcataatacactataaatatacgatgttcataactggaagttattcatcgtttacttgtagccaaatggtggagtttaaaatttgcatagaaatgcaaaagctgagaaactgtcaaggtaatatttaccacatcttcccagattattaaaattatagtactgttaacaccaggtagcagaataaaagagttaaccacagatgtagtttttctaatatccttctttttcttttctctaaccccatcctctttgggatctgtgaagttggttggagaacctctgccttgcttagagatttttcattttaaaggaaattccaatgtcttgtcctctttatctcccttactggttgtgagcaccttcctggttgctgttcttcacagaactcctagaaggtggatgcccatgcagtcaacggctaccttaggacctcctagtacagccctctccatctcatcttcctcagacccacccccactgtggctacccagtttctcacctatttgtaaatctgaactgattactcaataaattacctagccattagttatccataagtgttgctgtctataatttgggcatttcatattagataggtgatatttaaatgtatgctttatgcttacaaagggtgttattagaaatcaaaatgcatttacttcatgttaaaaagaaaagaataatgtgtacaattaaattaaatattttttctgtttaaaaatttctgttcaacttaaaaccaactttattatatcaattcttcatttaaatattttattaaatgtattgaatggttttctcttaatgtccttaattttatgtaatttaattatttaaatctatttaacatttacctttatcctgaacatttttagttttttcaaccaaatagaaaccaatataaaaaatgcttttgtaatacggttttcagaatttcagcagacttaaaattcatcattttaatgcttgaaagttatttaaagatgaatattattataaagaatcttagagaactcattcaagctcttactattttttctctttttttttgagatggagtctcgctctgtcacccaggctggagtgcagtcgtgtgatcttggctcactgcaagttccgcctcccgggttcacgccattctcctgcctcagcttcccgagtacctgggactacaggcgcccgccaccacgcccagctaattttttgtatttttagtagagatggggtttcaccgtgttagccaggatggtctcgatctcctgacctcatgatccacccgcctcggcctcccaaagtgctgggattacaggtgggattacaggcgtgagccaccatgcccggccagctcttagtattttttcttatttttttttttaatttaacaccatgtagacatggtcagtttatttatttatttatttttcttcaatttttattttaatttcaggggtacatgtgcaggatgcgcaggcttgttacatagacaaatgtgtgccatggtggtttgctacacagatcaactcatcacataggtattaagcccattatccattagctattcctgaagctttctctccccctgctccccactgacaggccccagtgtgtgttgttccctagcatgtgtccatgtgttcccatcattcagttcccacttataagtgagaacatgtgtttgttgtttggttttctgttcctgcattagtttgctgagcataacggcttccagctccatccatgtccctgcaaaggacatgatctccttcctttttgtggctgcatagtattccatggtgtatatgtaccacattttctttatccagtctatcgttgatgggcatttgagttgattccatgtctttgctattgtgaatagtgctgcagtgaacatacatgtgcatatgtctttataacagaatgatttatattcctttggatatatacccagtaatgggattgctgcatcaaatggtatttctgcttctagatctttgaggaatcaccacaatggttaaactaatttacatttccaccaacagtgtaaaagtactcctttttctccacaccctcaccagcatctgttgtttcttgactttttaataatcgccattctgactggcgtgagatggtatctcattgcagttttgatttgcatttctctaatgaccagtgatgttgagcttttttttttcatgtttgtgggctgcatgaatgtcttcttttgagaagtgtctgtttatgtcctttgcccattttttaatggggttgtttttttcttgtagatttctttaagttccttgtacactctggatattagtactttgtcagatggacagactgcaaaattttttctgccattctgtaggttgtctgctcattctgatgatagtttattttcaagctcttactttcaaaataaaagtatcatctacttgcattgtggtggttcctactggatgaaaccataactttaaaaaccataatgcatcatcttggtaattagtatcctaacaatatgtataaaaaaagagtgatatgtgacatatacaacatgggttgactaatgaataagaattggctatgagcaaaattgaccaagaagggcatttcatatttatactcgatagaatttcaagtaatgcctgaagaagctgtgctttacaaagggcttcgcagacttacaaggatatgaaatcctcaagtggctactcagtctctcctcacttaaggaaggctgctcaaatggtgtactgaccagcgtgtatctctctgtcctaaaacacaccaaaagcaccaagtgtgtggggttggcaaatgatacagcttgctataatgggtgatcacaactgttagatttttttatgatttggaaattaggataaaaatgagttgattaatttgaaatatgtggaactgaacttgccagatgccttttcatgttagcacttggtgcttagctatgtgaaatgctatcagctacctgcctccttttgtcagttcctacaggatctttctcagctgaagagtgccaccttgactaaggtgacaccctatcaggcaagtctgcctcttttaactgattaagacatgtttagaggactacacatttcagcctgataccagaaactttgaaaggcaatccagagctcccagcctggttgaacaagtcctcactgggcttgcatagctgttctacttcattctgttcttcatttggttccatctccatttcttacacgtgttactccctaataatcctcttaaactccaaactgtctgcttctagaaaactcaacctatgacaattagggattgaatgttatacatgtaggatccccactgatgtctaaagtagttttttttttccagtagctcaaatgtatcacagatgaggatgtcaatttctccatccatccatacactcatattgcagtcttttttacatgctgtatgcttatctttgcatttaagaggctagacataatgagtaagatatttatgtgcaaggtaattatgacaaagggcagaagtaaagagaccaatgaataagctattccaggttgatgctgtgcaaatgtgcagaattagagtggtggttgttagaatgaaaattaaactgtgaatgggaaagaagaagtcattttgatggaataaatattaggacatggtgattgatagcaagtcaaacatcaacaaccctgtgaaataaaagaaaataaaaaggcagcatatatacatgtcaattttgtgctacaccttcacaaatcagtcttcatagctgactctagtttgttttgtgtaatggaatatttattaacttttgttaaaaaataccctatattctactaaaaatatagaccttgcagtgattggtaaaactgcaaaccttctaagtcaatttattgaaacgggcatgcaaattcattatgttttataatttttttaatgcctctctttcctcccatactcaccctctgttattctcttggcaactgttttcctcaggcttattacaatttaaacattttgtttccaaattactaaatctggaagcaaatgttagccccataatcttaatagtattctatgtaactgtgagaatcagtctccaacagcaccaacctaagcttttgtagccagaacatgggtgtttatgaccttttccagtagtttgctgggcatggtactttcctattactactggataagtgtacataaagaagcatcaatggcaggaagttggatttaattcttccatgctgaaatgcaaatagtacttcagaattctactttaaggcttgaagtgacatctgacttccatgaacattaaatgatttttatttcagtcttgcataaactaatgaaatattagcatgatttattttctgctacattcaaactgaagagctgtgatctcattcttttcaattcctgcatgctttttaagctcaaaccatttgccagccactctacatgaaaatacttacattttattacctgttttttgagaaaacatatcaccaaacattactataaattcagataaactctaaagtaaaatgtaattgtattacctcttagagtatataatgacatttgtaaagtcattttaaaagacgtattaaaaattatttatcaaactgactgttttgcaggtacaccctcagctgctttgtaagagtctgcagcctagaaattgggaaccattttcatagattacagaaacagtagttttaccattccgagtctgttactaataatgcagttatattttggatggattttactgacctctcatttgaaaggaacaatacaacacaatatgtgaactttatttttattaagttcacacatctttctattattgcccttatatccaatggggacattataaaagagatcatctaactctggaaaaatcaatgagataagagagtattttatgctgtgttgaatatattgtagttcctaattgatttattttgcccttcccttttgtaccattttcttattgccgggagttcccagctgaggcactcacccatatgcaatcatattccctttgaaagtgatgtcagatcgtctgctaacttcctaatttcctatggtcatttcatcatgtcctagttgatctctaatagctgagcccttgcttaaatgttaatagctaatcttcaagctactaatttataatcaacaaatattctttcggattgtactgctctaactaatgagaatacatatttcatgataggaattcagaccattggccagacagttgggaaaataattttaacaagtatttctatcagaggaagtttaacattacacggagttaatgtccttcaacttttaaggccagttctgaccttgtttttgtgctattctttgtttataaaaaaattagaatcgagccatttcaaagtataactattcctttttaattagttatatatatcctgaaatctcctaagagatataaggagaagagcctgtaaaaagcatggtttggataggtcattcctgtcttataaagtcaataaagtgcactacactattcttggaatgaaaataacaatgatcttactgttttgtgtgacttcatatcatcatgtcggagttttagtgtttggttccatcaggctgcaaatattaacccatatagggtatgtaatagctagtgcctatgctctaagttctgtgaaattaaccttcaagtagataagcatgcaaacagtagaacagctaatgattagaaataatttttctttgttaggcattgctgtacttattgcattacaggtcaaggcgtgatatttagcagttctactctttgaggtaaagacacagccatttaatatgttaatctctttctgattaaagtttagattccttctgtgtatttttagaatataatacatgtatatgccttcataaaaacacaaacataaggtttatacattaataatgtgtatatctgtgcatatgcactagtaagtttgctatgatttggatatggtttgtttggccctgtcaaatcttatgttgaaattttatcccccgtattggagatggggcctaatgcgaattgtttaggtcatggagtggtttcctcatgaatggctaggtgctgtccttcaggtaatgattgagttctcgctctgttagtacccaggatagttcccatgtgagctgattcttaaaaggagcctagcacctcactcctccctctcttccttcctctctcaccatgtgatctgtacacactggctcttctttgcctttcaccatgaatggaaggagcctgaggccctcaccagaagcatatactgtttccatgctttttgtacaccctgcagaaccatgagccatataaatctctttataaattacctaacctcaggtgtttcttatagaaatgcaaacagactaagacaatgtccatgtatttctgtgcacgtgtgtgtgtgtgaacatatatatatacacaaaatataatatttctaagtataaacattttagaagtgataaattttactttttgccccaattccttcctggaaacttcatttgaaacagcattaaaaatctgttatattttcttataaaatcactgaattacaaataaaacacatactgatgtatactgattgatgttaacacaatttaaaattgtgcaaatagaccctaaagagagattttgaaatttcaaaaatgttttacatgaattatagcatcatttccagagaaaaaggcatactaccaatgagatggttcatgtgaaaagaattaatatacacctatagaattgctaaatgaacatatatttctatatttgatgaatatctatggatctctcatgtgatctgaagaagaattctcttcctttatcttactctgctgtggtacaaatcaatggaagacattcatatgtgaaacatacttccttggacttagggggatttagaacctaaagtctattttagggcacgaaattggttcatagcacatattttctagaattattagtgtttataaataacaatttcttgatgggctacagctaacatattatgggttattgcaatgcccagaagagcagctataactttactcccttcctcctcctcattcaagttaaagacactgaaaaacaagtgacaatcacattataataaaaagtatgtccagtctgtttttatctgttagaaataaataaataagtccagactttgcgatatggtttggattagtgtctctgcccaaatctcatgtggaattgtaagccccaatattggaggaggggccctgtgggaggtaattggatcaagggggtagatttcccccttgctgttctcgcagtagtgagttctcacaagatctggttgtttaaaagtgtgtagcatctcccactgccctctcttcctccttctccggccgtgtaagacaggcctgcttcctcttcaccttctgccatcactgtaagtttcttgaggcctccccaggcatgccctcctgtacagcgtgcagaactgtgagtctattaaacctttttcttcataaattgcccaacctcaggtagttctttatagcaatacgagaatgaactaatacacttcgtaactctattactgattaacaacatgacatatgatgtcctcacttgtgatcaagagattcttgtgtctggcaacataatgaatgagctctactcatactcaatgagctctatgtatgttataaatatacataagagcaccaggattaaaattcttttgtcccatcaattgacttaattgacatgaagtaatagctatagcaagtgttagatatttaagacacatatcaatggatttttgtgcatgtgagtaaagttacatatgaaatattttgctaatggttattgaaattgagaaaaattgtaaataggtatggataaaccacatcagaatggttgctcaaggaagtttgttttgtgtaataaatttccctgaaggaaatatagtcatctgaatttattccattgattttaagtctttacctaaatgctatatgaattctgtaagcatctgttttttatggtgatgggggtggtcattggtttcacaatttaaagcatgttcaaaacaccaacccagcatcttttcctctccttcacctgttgttcactttattcaaacctatatacagaaatatcgttccttaatcaaaagcaatgttaccataacctcttcttttaacccttcgtagccactgccagtgttaccaacatataatttttttttctagctgctttgcagaaaaaagtttagtcagataaccatagtaagactagagagacatgtttctataaacctggaggctttcttgctctgtccatttctctgtgaattaaaatcatgctaagtaagattgcttttagaatgtaagatctgccttgaaatagtatcgatgggagcagaactttagtaaagatgataaatataatatcatgatattttttatgatgttgacatgtgtttgacatgccatcacggtattttgtgtgctaatgggaagtgctaaaatattataaatacaaggcaaaatattataaatacaaggccagttatcatggaaatttaacatgaagcttcaaagttttattcctaaaaattgctcagacaaccataaaatctctcagcctcactaatgatgtggaaagaattagtgatgtgtgattagagtattaattattcactagctaatgaccagagagatgaattgtgagacttttcacaccttatttaatgaattgtatgtggtcatcataccattcaatatcaaaatatgaaagactggtgaggaaaaggatgtacacatggtctccacatttcatccacagaatacttattaatttccaaaagagaaatttccagcataggaaaatccgtagacagattagttgttttcaggggctgggggtggggtggagttgcaaatagagagtgactgttaagcggtagagagtttcatttaaggacaatgaaaattttctaaagttagataatggtgatggttgcccaactctgtgattatattttaaaaaaacactgaattgtacatctttaaaagatgaattttatggtatgtaaattacatgtctaatgctgctgtaaaaagaaatgaagacatccggtggacaccaccataaccaaatgaccaaacacagtattacttataacaggaaacacggccaaaaatagtacaagcccatttacattttcattaacattcacatcgtatctttgaccctcttattgccaggaatattcattctgatttttacccagtagaactattttaaatcacatatgcctgaggtagctatttaaatcttataatggaattgaaactcataacatcaaagggccttttcatctcattgttactgtaatactgagtattttttagagcaattcctctgtcagtaaccatttgtgtctgtatgcattggcatagggaattcataaatattaccattgtcccctgatgaagtaacacaaattgctctatttctccagaaatatttttattaaaatataggctattggtactaccaactgtatgtccttttttctgttttaatatattttaatagtaatatcaatgagtgaagtgtccatagtcccatgccatattacttgtataatttctatattatatgctctatgaaaagaatgtggtcaagtcagttttgtatatgtttggctattttttaccatgaggaacatctgaaatcaaatgttatcttctgcaaactaggtttgtaagagaaacaaataaacattatacttatttccacttcattcttggaataaaatttattttcagaattattttcgttaattctttaccattttagaaatatttcaagtgatagtgtttttttggtttgttcatttggtagttgtcttagggaactttgtccacaagctcacttttagatgatgatgcatgggtctgtgcattaaggaaatgttccccccacaaaaaacaagtaatggggtaagagaagtagaagagggaattgatcactccaaataaatgtgacatttaaatcaaaatctcaacagcaacctaatcctgtaggtttctccagaactgaaatgacatcacaatttttgttgtgattggggtgatggagctgagatttgaaacttccatacccacaggtgttggctatgggcctgccccagggtacatcacaggggatatgagtataagggcagagcatccacagaatttattacagtggtctttttttccttctgtagtcatagttaaaacaaaaagtaatatttcttattctatgtggtagtgatgatggtgcctgtatgtaaactatgttatttaatctaaaattattggttaaatatagataattggctaatgaaattttgattgatcactatgtttaacacaagtgcacaatttgtagaagtactgatttatgctatcaaggaaatttaagtttaagaatgatatcatatggtaaaaattacatatagatatgaaatgtaatcctgaataaggctatctgatacatgtgcttaggatccatagcaaagaaagataaggttagtgtttgttaaccaagatgatgttgagtgtgtgtattttacataaaatgttaatatcaatgtttatatcaatgtataaagagaaaaatgtagttcctttcttactggaaaatattgtatgcagaactgaggtggaaatcattcagttgcatgtaatatatgtttaccattaatttacttgataactcattatatttcagctatgaacatttttttactttcatcctattctatatttacttacagttacttgcattaaaacatgggattttggcattttacctcagctagtgaccataaagtactagtagatgatagatggctgattcaacagtgatattttcttggtattctataatgcagatctgaaattaataaggcagtattaaggtgatatagatataaaatatagcccttctattaaaaaatcagttgcacaagaatagaattgtcatataagatagacagcccaaatatagtttaagagtgttttgtggttggtaaacataataagacaatttcacaatgctttcataaaatagagtatgcaggttatagaaggtaatagtactctgtacttgttgaataacttttgcagtatatattgctttcagtcctcagacacatttaaagaaggacaaacagaaaacaaaaggttatctaaataaatgagactgatatataagagatttggagacctggcagtagaaagaatccttgaatgttctaaatttctgaaatctgaacataaaccttagagaaaaaataatgactgtatttaaatatttgaagaactgtaatggggttcagattgtaggttttcttctatgttgggctgggacagatctaaagttacagctctccagatataaaatgggctgtttctgtgttgtgaatgtcatctggtagtgtctccctaatagcatcatccaaggctacataccatttgtcagggactccatagaagaatggagtaaattaactatgagacaccttcaactctaaactttcctgaatctgtgtttttgcacctgcacagttacaagctgtgttctatagcacacttgacagtgaaatttatactatctattaaaatctttagaagtaaaaattttaaaaatcattaacattgagtagatggttaaaaaaacaaagtaagtagaaagaaaaaatgaataaatcatgtcttcatcattaagggcatctgggatacttaaatgcatggcatttactgcatctgaaatttttattgtattgaaatgcaatgttttcactttcaggttttcacttccagttactgcaacagcagaaaactgcattcttactatttacccatatatggcaattcatctggataagcaaaacattattttaaagaatggtaagctatgtatgacttatttatccctaactctcactgtataggttcttggccaacatctagaaataaagtgaatttaaaattatcagttgtttattaaacagctgcctctgatagaagctgtgcttgtcattgagagtagaatctgtatgtctcttaattccaaaagttgacgatctagtttgaatagaatgatttgggcaaaagacaatatagcagaaacatgcaggtgtgacaggaggtgtaaggcagtaaatgtaggtacaggaccataatgctatgccctttattctgtagcagtgggaaccttctgtcattttttgagtatcagtgtttagaaagggaacaattcttgggatgtgtgatgaattaaagtgggacagagtgtggtcattagaccagcctggaattgctgcaggggaaattgtgagagaagctaagaatactaaacaagctagtgagcagggagaaatatgaaaggcaagaaacaggggagtacattagagaaaggagggagagtgggtaacaaaaaaaaatcccatctgtgtagatcgtcaaggtcttaattttcagtgctgaattagaggtcttttgtttgtttttaaccaattttctcatattcttcacttgtttcttcaaatatttacaactctgatgaaacatatttagtcttattctaccttaatttcaggggatgactcttttttcttactattcagaagaaatagaggccattaagcagtaccactctgaacttccaaataccctcttggattggaactggattgtgacaagcaagtcacaagcatgtatcgtgactctttttactggtcacaaagctgggagccagggctctctcttgccttaacttattcctttatctgaatccctttacccaggtaccttctcaatcaagtaaccttgcttatcttttcatttctgtctccctcttagctgctttgagtgagcatctaggaagacagtagaaaggagaaaggagactgtattttcccagtggccagcaggctcattcccaaagagcaaaaagggtagcttcaggccatgcattccttattaattctttccaaatctaacagtaaaataaatcactcaacttcccagggagaaggagaaaagcagcagaggaaattaaacaattagaaaacttcaactgcctttaacaggaaaaaaaattcaggggtaaggaagaagaatttatccattatgctgccataactaaactactgagcacagctaacacttgactattctctttctccatcttcaaactttctctgggtttccacataccatacttcttttggtctcctttaacctctctgactgttccttctgagcatctttcatagattcctccctcttcctctatctgtacttttaaattgtttgtgtcaataggagttctgacccctctcttcttccttccatgacttcagctacaatccatgggctatacctctagccttgtttcctctcagagattcaggaattcagaattcaactgtcttctggataccattctttgtattcccataggcacccccaaaacaacataacccaaactgaagtcatctctctgacatttttttctctatataccccatctctatgtttgtacctatagtccatacaggtgccaaatccggaaacctgagtgccatcattggcaatgtcttctctctcacactccacttccagtcaaccaattcctgtcccttttgctgcctaaatatttatcaaatccattcacttttctccctctccactgccactacaaacattcaagctgccataatacctttccagggttgttgcaggggtttctaaactgttctccttcctcctacaatggtctcccctttcacatagctaccctcagagaatggccacggtgatttttttttttttttttcttggagatggagtctcgctctgtctcctaggctggagtgcagtggcatgatcttggctcactgcaagctccgcctcccaagttcacgccattctcctgcctcagcctcccgagaagctgggactacaggtgcccgccaccatggccggctaatctttttgtatttttagtagagacggggtttcaccgtggtctcaatctcctgacctcgtgatccgcccacctcggcctcccaaagtgctgggattacaggcgtgagccaccgcgcctggccgccacggtgatatttacagactgaaaattcattctttaattcccaggtataaaatctttccatagaatatcattgctaggtggatgaagcctacaagaccacacatgttagcaagtggtttagttgtcatttctggacatttttccctttatgctcaagccacattaatcttctgcaagttctttgagcatcttgatctttactgatactctttcttgtgactggagcattttacccatgacaccgtacacagttatagaagatccctgcctctgcatgcaaaaattatgtgtttctctggtgtatcctcatagctctgtgcaattcttctgtcatagcccttactacattttgacttaacctgcctattatcaatgtctttttctaaatgttgctatctataaagtctgtgagagtaggaatcacctctctctttttcacccttgtgtccatagtgcctcacacagtgtttagcagataaaaggtatttattcagtattgtaaaatggattacttgaatcataaaccatcaggaaggcatcttttagctatatattttcataaaagaatgggttatatgtgaaatagcatattctgaacaccaaaaaattattttaaagcaatttatggaataatgcagttggcagagtggagatatatagggagagatagatatctcaaaattttaacacacattgtcaaaatgtaaagatttttttttttttggccgggcgcaggggctcacgcctgtaatcccagcacttttggaggctgaagcaggcagatcacaaggtcaagagatcgagaccatcctggccaacatggtgaaaccccgtctctactaaaaatacaaaaattagctgggtatgggggcacgtgcctgtaatccgagctactcgggaggctgaggcaggagaatcacttgaaccgaggaggcagaggttgcagtgagccaagatcatgccactgcactccagcctggcgacagagcgagactcctcaattaaaaaaaaaaaaaaaagaaaaaagatttttttgacgaatattgacataatatttttatattccactctacttccagggggaggatttcagattatacaacataatagttatgaagagtcacacaaactagatgatggcaattctcatttgtgttctaaccacacttttatgccatatgattttatcttttattcttaaatcttcaaatttaccatcttttattaagcaaaatgtacatgacagaacagtaatagaatactgataatatctgttttacctatttaaaagggcttttgtgaggacccatagactgcaaatacatggaaattattgttatgaataatatttcattattattgctattatcactgtggttgtgattgctttatcatttttatatgctttataatttacttccagaaaataatgattaattactgggcaataaataatattgttatctctttaaaataaataaataaataaaaccttgttgttagattattaagcataaagtctatgtgtgaaaataatgcatccatttggggaaatatttcaaaagaaagaaattataattcttaaatatcctaaaacatctttagaaatatatatagtgataatttctaatatatatttaatgcttaccaggtatatggtgctctgctcagtgccttatatttgtcctttaaattagtcctcccagaagttctgagttagatgcccttatatatctcactttacaaattaaaaatctgaatatgtagagagggtgagcagcttatcccagggaattctaatgaaatttgaggcctcagctcccacacactttggtagtgtgtgctagggtatgatatgatcaataaaggtaaaatcttaaaatatatcaagtatatctaaaagtaaagcagtatgattattttagtatagttcatctgcaaaattcttttaaaaagtgaattattgagtttagttgaaagtgtatagatgtggctttgcattccactgggaactttttatcatttaatggcaagttaaaaacatttagcctaatgcatctaccacaaataattttatcattgagttctctgaggctcaattctatgaagtctatagtggtgtagcattctggaaataatgcacacctattgactacagagtctcaggcaaattctaaatgactctgttatgaaagagtgcaagaaacttagcatataatagctcatttatatttgttattgtctttaatgtaatcttcacaacaaactcatgagctcagaaactttggtctcattttatggataaatacatgttttaaataatttgtataacacactcacagtttaactgtgagtagaagtaggcatgccaagttttcaaatcagatttttctaactgcagagtctatgcttttttgacagaattagactgagttaggagctgggacttgacaccagggtggggcttggaggcttggacaatggaccatatggaggactagctaaaacagagtgcgggcaaaattagctttctttttcttttcctttttttttttttttttttgaaacaaggtctccatctctctcccaagctggaatgcagtggcacaatctcagctcacctccacctcctgggttcaagcgattctcatgcctcagcctcccgagtagctgggactataggcacgcgccaccacacctggctaatttttgtatttttactagagatggggtttcaccatgttggccaggctggtcttgaactcctgacctcaggtgatccgcccgccttggcctcccaaagtgctgggattataggcgtgagccacctcacctggctgcaaaatcagctttcaatcagacatgcctaccagtgtgccatgtcaatttaccattgccatggcaacatttgggagttaccgcccctttacatggcaatgatccaaggattactaccctttccctagaaatttctgcataaaccaccccttaatctgcatgcaattaaaaatgggaataaatatgactgcaaaactgccctgagctgctaccctctgcctagggctagccctgctctccaagggcagtcatggagctgtaatattgctggaggtgtaacactgcctcttcaattaagccgtttacttctacctctggcttgcccttgaattctttcctgggcaaagccaagaacccttgcaggctaagatccactctgtggcccacctgtcctgcatcaagactatgactatatgtaaattgcatatgtattttgaggcttggccttaggtcacacctactggcttttcttggccagcactgcctttggttggattcagatttacactgtggcagtccctaatatacatatatagcaactgtaactgaaatcgagattgaaatctgtacaaaaatggtatcagttcataaccaagctgtgatgttattacagagagttaactaggaagatattagtttttctggtgactcttttcctatatcttattttgaacagcgtatgtaataatttcatttatttggatgtagaaacatttaaaatattttcatattcttttttacgctaaagttgaacattgttcattctctaataactttgatgtaccataacaattgccttaccaaaaaaattcatttagtttagaaaattgtatcaacttttatctttttcctatttgacatcttattttatgtacagtgggtgtttagactttttttttactttgtcatagatagatggatacatagatagatatatacatcaatagataatagataaactcaggttaaataatggtataaagaaatacgtgaatgcatgttttgcttactgtgatccaatgtgtcatttgtagataaggatgaatatcttaagaagactagagatggtgttttgcctccctaccaggatgctaaaccaccctctcctgcttcaattaaaaagacatacaccactagcaaattcaatgatgctgaacctgcaaagggaaacttatttattggtatgtagcaaatatatagtgtactttccaaaattagtccatgacatgatctccttaatatcacttaatttaaggttaggtttttacaaataacaagaaattcatgaagaaaattgggaatttgtcattaattttaaatggatcatctgtttggagagttgtcttcaagggtcaatagtagagattctctaatgttcttggttcacagcactcttactgtttcagtatttacttttctgaatgccaaaatgtagcacatagttccatttattaaatgcattgggacaaaaatgtaagagtagtacttatgtgctgtctaatagatgttgcagtaatatttaacaaaaacgttaatacctgtggagcctctgtaaatttactgtgacatcccaagcactctctgtgcacagtttgggaactgcagaactaaggacttgtctcttcgttgtctaactaactgtagccaaggtttcctgtcttagaaagaggtcagcacagataaatatgtgagtttcatactattatttaccattaactgttcaaatatttatttctctggatgtaggtaataatgaacatttttctttttattgaatggaccaaaccaaattaaataatatgaggtttttagtgagtatgtgattgtgccattatataaccagatatttttggaaaaaaaagatgaaatcattttatattcttgaaaattactttaacttgaaaatgctttgttttattcaagtacttgatttggatagaaagtcatttgggatctaaaccaatattgtctttgtataattttttcagatgagattaaattttttctaatacataatgctgaagattgtcaatacattttattaatgtaataaaaaatgaaagattccacttcagggaatattttcacataccattatggcaagaagaaaatgtaacttttatgtattgaaatccagctattgttaaaacgtttctcttaggtacttaaaagtaaatgtattttcattgtttactttaagatatagtaaattgactcagaatttctttgagagcatagaataatttgtagaataggttctattagtctgcatacaaatgacaataactgacagaatattttactcctcgtcaagtagcccttttttaacaaactaattttaattttaggagtggaagtactgcctgaaaatttgcacttggatgaaagtgaaacatcagaggaagatcatgggtctctggaaaaggaaaaatatgaacaattcctttctcttgaggaaggaacaaaggcacactacttttttgagaaggttgtaaatgcagcacagacctggttcagtctctttggctggcctgaaggaccccattctttttctattccagagactataagaaggtgagagtcccatgtttctctaaattctttgcttcatatcacatcataaaatataatctattgattgagattattttaagtgaaatacaatatgaagtaatttattctaaactgatatattatgaagcatctcataatttattgttgttattgcaagaagagtaaaatgatgcaaacacaaattttttagtataatgtcatctttaatttcttttaaatatctgataattttaggcaagcactgaacatctctgaacctcaccttcctcatctgtgatatgaggaaggttatactgtgagtaggaaagcccttttaatattagccctagatcgagattatagccaggtagacaggtaatggtattaatgaacaaggagggctcacttttctttgacttgatttcctcttttacagtgcatttacttcccttctttcatgtgctgttttgttactcagtatgtctaaaatagttcaactgttttgattatatcaagtgacttacttctgttgttaatgtaaacaggagtttaggcctgttactggttataatgttgttggtgtgatatgttctcagagcttttctacctgctttctcagcaatgaggtaacttgctgcaaccacggcagggagtacagtactcatagctatagtggactatgggctatttatagaatttctgctctatattcgagtgacctaggtaaaactaaggctgcagttttcctatatgttacctttttcaggttttttaattaataggacaaacctagcttcatggaatgaattggctaatatttcatctttgtccctgctgtgagaaaattaatgcaattgataccctgaaaatttatagttttcatcataaaatcatttgttattgaaacattttttggaatgtttgtgcatcttctttcttgaacctgaagatagagattgtcagaaatgctctttgttgatgtgtaccttgcgtaatttcactctttagaaacaccacttcacagcaataaggaagataaggcccggttcatttgttgattgctgagatatatacaagtagaatagcagaagacaaagaaattatttgaggggatttcctatttattgataattcttagtctgttttctttttcataaggctatgaaaattttattaacttatattttgtcttttacaataacttttcttcataaacatattttgggatctagttaatgaattagatgacttatggagttttttcaaatttttgaacaaattgcaatcatatataattatacggtacacagcgttaatatggtatatatatgtacagtgtggaataattaaatcaagataatgaacatattcatcatcttaagtatttatcatttatttctcttgtataattgcaaccttgtatcatttgaccaacatctctcgggtccctcaaccttcagcctctgatgaccaccatttcactctcagcttcaatgaattcaacttttttagataaaatgtatgagtgagatcatgtaatattcatctttctatgcctggcttatttcacttagcataatgtccttcaggttcatccatgttgtcaaaaactactggatttcactcttttttaaggctgaggagtgttacattttctttatccattcatctgttgattgacacttaggttgattccatatcttggctattgtgaataatgctgtaataaacctgggagtgattatatcgtttcaatgtactgatttcatttactttaaatagatgcccagtattgggataggtggatcatgtggtagctttattttaatgttttaattttaattttatatgtattatttttatttatttatttatttatttatttatttatttatttatttagagatggagtctctctctgtcacccagactggggtgtagtggcgcaatctcggctaactgcaacctccgcttcccgggctcaagcagttcttctgcctcagcctcccaagtagctgagactacaggtgcttgccaccatgcctggctaatttttgtatttttcatagagacagggtttcactatgttggccaggctggtctagaactcctgacctcgtgatccacctgccttggcatcccaaagtgctgggattacaggcatgagccactgcgcccagcctgttgttattttttaataatttcaacttttattttagattcaggggtacatgtgcaatatacatgcatatattgtgtgatgctgaggtgtggaatacaaataatcctgtcacccaaataaagagcacagtacacaacagtttttcgacacttgtttccttccctcatgtctccttctgttagtcctgagtgccttttgtggccatctttttgttcatgagtacccaatatttaggtcccacaagagagagcatgcggtatttggtttttttgttcctgtgtttattcatttaagataatggtccagctgcatccatgttgctgcaaatgacatgatttcattcttttttatggtttcatagtattccattgtgtatatataccacattttctttatccagtccaccattgatggggaactaggttgattctatctctttgctatcactattgctgtgatgaatatacaagtgcatatggcttttggtagaatgatttattttcttttggatatataccccacaatgggattgctgggttgaatggtatttctgttttaagttctttgagaaatctccaaactgctttccacagtagctgatcttacttgcattcctaccaatagtatttaaacattcacttttcttttttttctttttttttttttattatactttaagttttagggtacatgtgcataacgtgcaggtttgttacatatgtatacatgtgccatgttggtgtgctgcacccattaactcatcatttaacattaggtatatctcctaatgctatccctcccccctccccccaccccacaacaagccccggtgtgtgataaacattcacttttctctgcagcctcacaaacatctcttttttttgcctgtttagtaatagccattctgactggtgtgagatggtatctcactgtgatgttgatttgtatttctctgatgtttagtaatgttgagcactttttcatatgttcattggccagttatatatctccttttgaaaagtgtctgtttatgttatttgcccactttttaatggggttatttgttttttgcttttaaactgtttcagttccttctaggttatggatattagacctttgtcagatgcatagtttgcaaatatttgctcccattctgtaggttgtctgtttactctgttaatagtttcctttgctgtgcagaagccctttagtttaactggtcccacttgtcacttttttctttttgttgcaattgattttgaggacttagacataaattctttcccaaggccaatgtccagaatggtgattcctaggttttcctctagaattcttatagattgggactttatatttaaatctttaatccatcctgagtgaatttttgtatatggtgaaagttaggggtctacttttaatcgtctgcaaatgactagccaagtatcatagtatcatttattgaatacagaatcctttctccattgcttatttttgttgactgtgttgaagattagatggctgtagctatacagctttatttctggattctctattctgttccgttggtctttgtgtctgtttttataccagtaccatccaattttggttcctgtagccttatagtacagtttgaagtcaggtaatacagcgcctccagcttttttttttttttttttttttttttttttttttttttttgctcaggagtcattcggttatttgggcttatttttggttacatatgaattttagaaaagtttttttttataattctttgaaaaatagcattggtaatgtggtagaaatagcagtgaatctgtagattgctttgggcagtaagtccattttaactatattgattcttccaatcaatgagcataaaatgtttttccatttgtttgtgtcatctatgatttctttcagcagtgttttatagatctccttgtatagatctttcacccccttggtcagatgtattattaggtattttatttttctgtggctattgtaaataggactgccttcttgatttggctctcagtgtgaacattattggtgtatagaaatactaccaattttcatacattgattttgtatcttgaaactttactgaagtcatttgtcagttacagcaaatctctgggatgcagcaaaaacattgttaagaggaatgtttataatgctaaacacctacctcaaaaattagaaagattccaaattgctgggtgcaatggctcatacctgtaattccagcactttgggaggctgaggtgggtggattgctggaggtcatgagttcaagacaagcctggccaacatggtgaaaccccatctctacaaaaatacacaaaaaattagtcaagcatggtggcacactcctatagtctcagctactagggaggctgaggcaggagaatttattgaacccatgaggcggaggttgcagtgagctgagatcgtgccactgcactccagcctgaatgacagagcaagactcagtctcaaaaaaaagaaaaaaaaaagaaaaatctcaaattaaacttcacacattgaggcagtagaaaaactacatttactgaggagtgctttacttccaactatgtggtcaattttggaataagtgcaatggggtgctgagaagaatgtatattctgttgatttggggtggagagttctgtagatgtctattaggtctgcttggtgcagagctgagttcaagtcctggatatccttgttaatcttcggtctcgtagatctgtctcatattgacagtggggtgttaaagtctcccattattattgtgtgggagtctaagtctctttgtaggtctctaaggacttgctctatgaatctgggtgctcctgtattgggtgcatatatatttaggatagttagctcttcttgttgaattgatccctttaccattatgtaatggccttctttgtctcgtttgatctttgttggtttaaagtctgttttatcggagactaggattgcaacccctactttttttttgttttccatttgcttggtaaatcttcctccatcactttattttgagcctatgtgggtctctgcacatgagatgggtctcctgaatacagcacactgatgggtcttgactctttatccaatctgccagtctgtgtcttttaaatggggcatttagcccatttacatttaaggttaatattgttatgtgtgaatttgatcctgtcattatgatgttagctgcttattttgcaatgatggtctttacaatttggcatgtttttgcagtggctggtaccggttgttcctttccatgtttagtgcttccttcaggagctcttttagggcaggcctggtggtgacaaaatctctcagcatttgcttgtctataaaggattttatttctccttcacttatgaagcttagtttggctggatatgaaattctgcgttgaaaattcttttctttaagaatattgaatattggcccccactctcttctggcttgtagggtttctgccaagagatccactgttagtctgatggacttccctttgtgggtaacccgacctttctctctggctgctcttagcattttttccttcatttcaaccttggtgaatctgacaattatgtgtcttggggttgctcttcttgaggatatctttgtggtgttctctgtatttcctgaatttgaatgttggcctgccttgctaggttggggacattctcctggttaatatcctgcagagtgttttccaacttggttccattctccccgtcactttcaggtacagcagtcaaacatagatttggtcttttcacataattccatatttcttggaggctttgttagtttctctttattcttttttctctaaacttcttttcttgcttcatttcattcatttgatcttcagtcactgataccctttcttccacttgatcaaattggctactgaagcttgtgcatgcatcacgtagttctagtgccatggttttcagctccgtctggttatttaaggtcttctctacactgtttattctagttagccaatcatctaatcttttgttcaagatttttagcttccttgagataggttcgaacatcctcctttagctcggagaagtttgttattactgactttctgaagcctacttctgtcaaattgtcaaagcaacaatggtactgggaaaactggctagccatatgtagaaagctgaaactggatcccttccttacaccttatacaaaaattaattcaagatagattaaagacttaaatgttagacctaaaaccttaaaaaccctagaagaaaacctaggctataccattcaggacataggcatgggcaaggacttcatgtctaaaacaccaaaagcaatggcaacaaaagccaaaatagacaaatgggatctaattatactaaagagcttctacatggcaaaagaaactaccatcagagtgtacaggcaacctacagaatgggagaaaatttttgcagtatacccatctgataaagggctaatatccagaatctacaaagaacttaaacaaatttacaagaaaaaaatcaaacaaccccatcaaaaagtgggcaaaggatatgaggagacgattttcaaaagaagacatttatgcagccaacaaacacatgaaaaaatgctcatcatcactggtcatcagagaaatgcaaatcaaaaccacagtgagataccatctcacatccattagaatggcgatcattaaaaagtcaggaaacgaggtactggagaggatgtggagaaataggaacacttttacactgttggtgggactgtaaactagttcaaccattagtggaagacagtgtggcaattcctcaaggatctagaactagaaataccatttgacccagtgatcccattactgggtatatacccaaaggattataaatcatgctactctaaagacacatgcccatgtatgtgtattccagcactattcacaatagcaaagacttggaactaacccaaatgtccatcaatgatagactggattaagaaaatgtggcacatatacaccatggaatactatgaagccacaaaaaaggatgagttcatgtcctttgcagcaacatggatgaagctggaaaccatcattctgagcaaactatcacaaggacagaaaaccaaacaccgcatgttctcactcgtaggtgggaactgaacaatgagaacacttggacacagggtggggaacatcacacaccagggcctgttgtggggttgggggatgggggagggatagcattaggagaaatatctaatgtaaatgacgaattaatgggtgcaacaaaccaacacagcgcatgtatacatatgtaacaaacctgcacattgtgcacatgcaccctagaacttaaaagtataattaaaacaaaagaaaaactaggaaaactaactcaaaagctagcagaagaaaataaattactaaaataagagcagaactcaatgaacttgaaactcaaaaatatatgcaaagaatcaacaaaaccaaaacatggttttttgaaaagataaacaagattgatagactactagctagactaagaaagaaaaaaagagagaatatacaaataagcacaatcaaaatcactaaatgtggcattacaactgatcccacagaaatacaaaggatcctaagagatgtttatgaacacttcggtgcacaagaactagaaaatttagagaatgtggataaattcctggaagcacacatcctctcaagattgaatcaggaagaaattgaatccctgaacagatcaatattgatttcaaaaattaaataagtaataaaaaacctactaacaaaagccatgggccaaaagaattcacagccaaattctaccagatattcaaagaagagctgttaacaattatactgattctattccaaaaaatcaaggaggaaagactcctccctaacacactcttggaagccagcatcactgtgataccaaaacctggcagagacacattgaaaaaagaaaactataggccaatattcctgatgaacatagatgtaaaaatccttaatagaatattagaaaactgaatccagtagcacatcaaaatgctaattcaccatgatcaagtaggcttcattcctgggatgcaaggttgattcaacacacactaattagtcaatgattcaccgcatgtaaggaattaaaaacaaaaactgtgtgatcatctcaatagatgtgataaaagccttcaataatatccaacatcccttcatgataaaaaatctcaacagagtcaccagcaaaggaacatacctgaaaataacaagagccatctatgacagccaatatcatactgaatgggcataagctggaaccatttcccttgagtactagaacaaaacatggatgcccactctgaccactgctattcaaaatagtatgagaagtccttttcagagcaagcagacaagagaaagaaacaaaaggcatccaaataaaagaagtcttacttctgtcttcactgatgttatgattttatgcttagaaaaccctagttttatttttatttttttgaggaacctccataatgtttcctacatcactgtactaatttaccttcctaccagaagtgtgcaagggttcccttttctccgcatcttctccaaaacttgttattgttcatatttcttataagtcaatataacaggcctgagataatatctcgttgggattttaatttgtacttcctttataattaatgactttgggcatcagtctgttttcagttcctagaagcccttaggtattatttcttttttgctcttcccctaatcaccagaagatagaagtagccctggaaatagacaagaaaacacaatttatgtttcagagataatcacagaaaatgtagtaaatattatagtctattcttttcaagctgggtgaattgtagaaataacattttctataaacaccgctgagaagatctctaagcaactaatcatagagtcatttgaatcgtactggaagtcccacttattctgagagaagtaattgcagtacatgtaggtgctgtcccaggattccactctagcatgaagcttcctgcagctgccacatacaaacaacacatcctagaatgccagtcaggaagcttaaggggaagcttaaggaaagcttgttccaaagctaactattccatcccagagcctctcatttagtataatacatagaatcttatagaaaatcaaatccttccagtagaatgttttatctttcataacaagaggatctgaaatgaggaaaatatttcctctatgcctccattttctcatctgtaaaaaaggagataatgataatacctaaccaatacagttgttgtaacatttatgagataatatatttaatgcatgtcagagcagaccttaggacctagtaagtcttcagtaaatcttagctattattaataagtttaattaggattatgttaatatagttatgtatttctaatttcattaatcatattcaccaactctttttgtatttggcagtagagagtcagtttaaaactcatcattttcaagagagcacttttccaaattatgttttattaataatatttcacctttctttgcaggatgtttccccagcttgattcaggaacatttgacttttatttatataaatacacacacatgtgcatacatacatatagatgtagtatacatatatgcatgtatacatgcatgtatacatgtacgtatgtatacacatatatgtgtatatgtacttatatattacatatatacttatatatgtatgtatatatatgcacatatatatagcatagcatgcttttctctttgcagctttgagctgctggcaagctcactgataaatttaatagtattaaaatgaaatgtcacctccatttctgggcatcctgcccattcatactgtaaacagtgtccaacaaagtcatagaaacttgactttagattcaagctaagtattaaaatgaaaatgactataataactcattctagttgtgttccttgaattcttacttttgcacactagtataacaataatgagatattctacaattcttatgtttaaaagagttttatttgttaatcattttactgcatgtttgctggtgatagtgatgggtgagacttttgaatattttcaatctccaaataggggattctcataattgaaaaataaacaaaatcctttaacatattaatatatatgtaagagcaaaatgaatatagttaaactatatataggcaactatggagttattaaacaataatgatttaataatgtttaatactattatttttgtttaattatggtttttaatcagttcatatttgcctatatatttatcaacatcattgttcttttttttgcatcattagtcttgcaggtaggatgatttttattttctcaaatgttgcagtatgaatactattctatgacctatatttcattgcagtaattttgtttttatttgatttaatctactgttagactcatccattgatttcttaattttatttattcagatttttatttgtgaatgctccattagtcaaattttatgtaccttattgttccatggcaaaattatcaattttgaacatagtacatatggttagtttaaaacctgtgtcttacaactataatacctgggatccctgaatgtctgtttttattgcttattgttcattttagtttgcattaatcttgaccaatagtggtattaattttctccataaaatatttgtttctttgctggtaacttcaggatacactagctctatcatacccattacttatgaagaaactaaggaacagaaaagtcaagtaacttttataatgtcatgcaataagtggaagagccatattttgagcagtggtagtctatttcttgcccagtggaacgtattttcttctgtgtgaacttcctatctaccaaagtgggtaactgccattcaaaatggcctcgggtacttatttgtcaatctaagcaagtgatacatctgtgactctcattgctaacagttagacaatgtggtgtgagatatttaataaattatagacagcaagaatagtggtaatttttaacttcatttaaagtcagtatgcatcacaaccttgtgcaatattactaggaattagagattgcagtatctgatttaaagaacagaggaatatatgttatctgtgggctttatctttaaaatgaaaatccctgcttattaagccaatgtgcaggatttgcccttctaagcattaaaatacaaatagtgagaaaatgtgtgtacattatttttgtatatacatgtgtgataaacatttgaaatctatcttggaaactattacagacctcattatctccaatttatatcatgcaaaattgagctcagtgagtttagatagcttgccatactcactcagctagtaggtgatgggtttaaattcaatctctattctgtttctcaagatccaatctattcataatctaatacttcagatttgacagttgcaacattagataattatgtgtgtttaaatgagatactggaaatctatgataatatttaacaaatcttttttgaccaacaaatggtagcctagtgaagtgtattatggagtttcttacttagttgattttaatagagtttcatttagtcattgaattgaacatgtttttttttcccccatactataacattttgagactgtttttaattttaagtctttttctcatagggatgtatataaaatgcaattctactcatcaacctcgccaccccaaaagttttccagacagaatgacttttccaaatataataagaccatttatgatgtgctgctccatttgagtggaaaaatgccacctggaattaattcaagtcaatctttacctgtagataaccatgaaaaaagggtaattcaactccatttgcaacattcctcacttctggactttctcaagtaagtgcctggatgtgctcatataagcatataactctggcttggatagttagataaatgaacagatagatagactttgatattattttcctttctaaccaaacacacacacacacacacacacacacataaatatacacacacgtatatatatattatatatatatatgtatggtaaagtatatatatctcacacattttgaaaaatatataatgcttaatagccaataagcattttatgatgtattggatttttaaggcaatcattcttatactttatcatgcatcaaaatcactgagagggtctgttaaaacaacagtttactgacccttacccattgagtttttcaaagttaattttcatttataacaagtttcaaggtgatgctgatatttctgatccattaccttcattttgaaaatcctggtctacagcaaatacataaatccatttagctaaaaagggatgaaaccaacaagctttatttctcagactattattagtatcatctcaatttatgggtactgtggacttttagtctgcatagataaattaaaatagtaggaaggcgaaaggaattttaaatggttgatgcaaaagataggaaaaataattgtcgtaatatctgtgttcctctgcaaagattaaatggcaagtcgccaagaaatggaaaaacaatgtacatttacattctgagaagagtactggtgaatttacattgcttctttagcctgcgcttgcaacatccatgtacactgaaacatcccacatccataggcagtaatttatttagcatcgagttgaacatgttattactccctcttccatgctcctatacaattaaaatggcatttatcacttataattgtttatgtaatatggttaatatatttttagatgtattattgtgattttctcttttgcttctttgtttatggaatctgctccatagttgttcagagatgttcatctatcctagcaggaatagagatggagggcaagaagaatactcttatagcaggaatacaaattaaagatttgacattcaattttttatttccaaatcaggatttttgagtccctagtgatactgtgtattaaaactttgacatgttacttaaaatattttctttcatttcttaggctctcaatatcatggtaataaggcaagactggcttggttccttgtggattgcaaggtagctagaagtttctaaatcacttaaggtgactgaatcaagatccaggcagcttgtcatggcggcttctgtgttgggatgttagagggacgccactggagaggcagaagagtggcagttgtctggccctgatgccacaataggaatgacaaatatatgaggactagggagtggctgagtcagttataggagacctcttggtccttgacgggcctaagggcagagacagaagatccccatctcagacatcagcagcatatgcccacatgacacagacatttcaggcagagaagaggcacagcaaaaaaagaacaagtatccagaaatgcagtcaccgaccttcatgtacaaatataggaatccctctccctgtctcgtgtaagcccaaatccagcatggatgatcctaattctgagagttcttaatacaatttgaggaacccttctatataaaatagcaaatgaaaaatataaatattagatacatggctttagaaggtaatcatgaaagtaaaaaaacctgaagttaaaacggtatttatttgacaatgagtctaccttttctcaggtgccatctggcatggataggtgggggtgaaattttgcctgttaatcacaaataacagaatttctgtaaagagattctttgggtagaagacctaaagatacatggagatgcaattttgcattttctctgtatccttctgcactcaatctaaatgggagaatgagaatggttatatcagttaaggaaataacacagctatgtggaattttgtaaatcactttcaactccgctggcttatccctgagtcagtgaatcccacaaatctgtgagcatcttaagggcagaaaccacatctcattcatctggaatttctaacacccaggatcactgggagcatggaatggggccaatgttcattacatatttattttttaacattttctttcacagagatttaccttttgaatttgtgtggtataaggaatgaaacatggaaattgcatcgcaggacatttatataagaatgaagaaaatgctgtgaaatataaaaagtggtaaaagaaagggtgaaaaatttgcatttcaggaaggagaatgtaacaaatgagagggtcaagttggagcaaacaacgtaaattttttttctcagagttctggatgctagaagtccaagatcaaggtattgtcaaggttggtttcttccgaggtttctctgctggcagataaactcttcttgctgtgtcctcatgtggtttttcctctgtgtacccatttccctgatgtctttctgtgtattcaaatttcatcttcttataaagacacaagccaaactggatttggtaccactctaattacatcattttacattagttatctttttaaagaccctaactccaaatacagtcacattctgaagtcctgaaatttatggtttcaacatatgaactttgtggaggggtgtaatgtagaccatagcaataccatatgtgttatattatgaaacaatattctgtaactgaatgttatattttataataaattttgtatggatatatttgcagtaatatatttcttgtcatttgtgtctggtatggactgaattgtgccccatcccaaattcatatgttgaaaccctaacccccaatgtgattttatttggagataaggccttaaaggatgttattaaggttaaatgtagggccctaatccaataggatggatgtcctttaaagaagaggaagagatgccagatctctctctcttctcttctctctctctctctctctttctcattatagagagaatgctatgtgagtacacagtgggcagatggccatctacaagccaggaaaagaggcctcacctagaaccaaatttttgacaccttgatcttgaacttacagcatccagaatggtgaaagaataaatgtcttgtttgagccacttatcctgtggtattttcttatggcagcttgagcttaccaatatcatatctaacatcctttgatacaatttcacttgtttatagttattatcattttatgattaattaattttcattgaaaataataaaatttttaaaaatttataatttgtgtagtataaaactaaaaccgacacagaatatcaacatcttctgccgtacattgtaactaaaaagtagaccatcagaagaatataaagctattgtaactcttatttttaaattccactaagtttttaaataaatagttaattcaccaaaataaatacacttagaaaaagcaactcacatccccttatatgtaaatttagttccacttgtgattttcacttttatccttaaaaattttatatcctgggctgggtgcggtggctcacgcgtataatcccagcactttgggaggccgaggtgagtggatcacacaaggtcaggagtttgagaccagcctggccaacatggagaagccctgtctctactaaaaacacaaaaaattagctgagcgctgtggtgggcgccagtaatcccaactactcgggaggctgaggcaggagaatcacttgaacccgggaggcgaaggttgcagtgagccaagatcgcaccactgtactccagcctgggcaacaagagcgaaactccatctcaaaaaataaaaaaaaggaaaaaaagaaaataaaaaattaaagtgttatatccttctcacttatgcatgaccattatagtatcttatttaatggaattgcatctaagaatgaaaatatttcaaagaaacaatccaagaagtaatcctggaagggtgcactgaactgggttgaaggaacatggcttttgaatcatgcagatataggcttatattccaactcttctgtactcctgtgaccttccttgcacaagttacttcacccgttttagctctaagttcaatatgtaaaattaagggtgataattccataactaacttggttgttagaagaattacatcagggaaataactaacggatgctaggcttaatattggagtggcagaataatctctacaacaaacccccgtgatacaagtttgcctatataacaaacctgcatatgtactattgaacttaaaatttaaataaaaaaagaattagaaataatataacgtgaatcacgtgacatatagtagattgttattgttattgttgttaaatgaaatgaattatggcctaaggctttcacctgcttagatatttcctgaaactattccaatatagtaaccactagtgacatactgaaactgattcttgtgatatcactatcactgaaatggaatatttattttaaaaatccattgtatgagtaataaatgtcttgttgacataaaaatgtcagaaagccagtatttatcaattatagcctcacatttattagactgaatggaaactttatttaaattttaataagtttataacagaaagcacatagcttttaattttaccacttcctacttttggtcctcaataattgattcaataaggtaagtgctctaattcaataagtccaaaacctgaatgcatttttttcagaaagttagttttactctgaaaatataataaatattaactgtgagcaaaagaaggaggcttacatacttaagtcaatcctgattgtatgcatataatggaaatcaaacaactttgtgacagcatcattaaacctatggaacttgcaatcgttgtgttattcttgtagaattctttttggcacagctcccagtagtgttgacattaacatgggtcatttgtgttatgacattttatgatgtgaggatgcaggtatggaagaataattttgacattaaagccacgccattcagatttatttgctctttatctgcaaatacatgcctatcaggatatgttgactgtgataaaatgacttaacatttagaaagtgacagtatggttaataaaattgggtcattaattcaagatatgtgcatatgtttcatcatggaaatatatgtattcaaatacaaaataatcataaatgttatcagcttccccatttaaatttgataatacaataggtaagaacttttatacacgtgaaatatctactctgcataaatgagcaacttatgtttagggattaagctaggattttttaagaaacaaattttttgaagattaagtttagcatttaataactaattgcacctaattatgttttgatccacccaatgcgaacttggaaaaaatattcaaataaaaaaactactatgtaaaagtttaatgaaatcaattaggaaagtcaactctttataaaactactgacaagacgtaaaatctactgataagacataaaggtaaatattgtcttgtgcactgatgaagttaggccttgaggtagattcaaaatgaaaagcataaaacaagtcttcataacagtctcagcctttaaaatgaaaaaaatgcatttttcttgtcctcaattttacctagggtttactctctggtggacactttggaatactcaaataaataacatgtaggctccctcctcaagaagctcccattttaatggttccctgatattttcctccagttctcagtaacgtttgatataagtgaccacttacacactgaaattctgtcttggctttgggcacaagaaaatattccagtttcttcatatgcctctgagttgtatgttttgttttactctagaggatttcaacttaatggagacatcatctcattgcatttctacataggctgtcggttggctaatcttgctgaggagtggtgttacgtaaaattagatcttatttaaatctataccaatttgactgtaatgaagattcacagaagtaatgtgcatgaggacaggaattgtgtgaaaatcaaaaagacagttttatgtttcatttcccaacaaaggaactttatgtaggcagtatgatttcttctactagcttagactgacccagggccatgtcaaacttaactctagaacaggggacactgcctccacccaagaagagtttccttcctcacttctattttctcagtcatctgcaccatcttcaaggtttgagttttcagaatcatcttaagcctccattttcctttttctttttccaacttctctgtaatcacaagactgcaaattctgagggtatttccagaattgagaactagatgtaggattctttcctattaaatgtttattggtgagtggtgttctaggttcactaactgagttagacctgaatatctgaatctccgttaggaaatatttgccacaaaatactagatttctacacagtggctctgatggtgatggatattcatattaagagtttggctaaaattatttcaatgaatttgacaatgaaaaaagtatatataaaaacataaatgtggtaaattatatgcatataaatatgtacatacataggctttaaaatgtattaaatgatataaataaatatttactgcttcaaatatgctaccacaagaatatataatcagagtctgcaatttttggatattctctttagaataaatagataatgaattaccttacacaagctttctatatttaggtatttgtggttataggtactcaataaacattggatgactagtgatctctctgttagatgttttattgtattcaaacatttccagatgttttattcaattttataatattataacaggaataaaatgattactgcattgactacaaatccaattcataaaactctttgtgttttgttaccatgtagggattgatgtagctgattataggtctaagtaagttctttctcatttatcaagttctctaaagaaaacatcgtaggcacattttagaattaagggaggttttaaaagttaactatataacttttattttttttttttactttttattttaaattttgggggtacatagtatgtgcatgagatattttgatacaggcatgcaatgcataataatctcatcatggaagatagggtattaatccctttatcctttgtgttacaaataatctatgtatactatcattattttaaaatgaaaaattaaattattattgactagagtcactctgttgtgttatccaatactacactttattcattaattataataatttttcatatccattaattatccccacttccccctcactgcctgactacccttcccagactctggtaactatccttctcttctctatctccatgtcttcaattgttttgatttttagatcccacaaataattgagaacatctgactttggtctttctgtgcttggcttatttcacttaatataattacctccaggttaatacatgttcttgcaaatgactgaatctttttctttttgatggctgaatagtactccattgtgtagttgtatgacattgtctttatctattcatctgttgatggacctacggtggcttccaaatcttggctattgtgaacaaacctgcacaaatgtgggaatgaagattatctcttcaaaatattgatttcgtttcttttggctatatacccagcaaggggattgctggattttgaggtagctctgtgtttagttttctgaagaaactccaaacttttctctggaatggttgtactaatttacattaccaccacagtgtacaaaggctcccttttctctatattctcagcagcatttgttactgcctgtcttttggataaatgtcattttaactgggatgagatgatatctctttatacttttgatttgcatttatctgttgatcaatgatgttaagtacattttcatgtggccatttgccatttgtatgttttcttttgataaatgccttttcaaatattttgcccatttaaaaaatgaaatgagaaatagaaaactacaaaaatgaaaaaacaaaacaaaaaatggtgtgagttgattgaaggtaaaaaaagaaacaaaataaatataaaaattttaaaaagaaacaaatattatgcccattttaaaattggatttttagatatttttctacagagttgtttgagcgccttatatattctggttatcaacccttgacagatgggtagtatgcaaatattttgtcctattataggatttgtctattttctttgttgattgtttcctttgctgtgcagaagccatgtattcatttatgctttaattgcctgttcttgtgggatattactcaagaaatctttgcccagacctgtatcgttcagagtttctttgaagttttcttgtagtagtttcatagtttgaggatatagctttaagcctttattatattttgattttatttttgtatatggtgggagacagatgtctagtttcattcttctgcatatggatatgcagttttcccagtaccatttgttgacaatactgtcttttccccagtgtgtgttcctggcacctttgttgaaaatgagttcattgtaggcctgtacatttgattttggtttctgtattctgttccattggtcgatgtgtatgtttttagaccagtaacacactgttttggttactatggctctgtagtataatttgaaatcaggtaaagtgattcctccagttttgttctttttgcttaagatagctttggctattctgggtcttttgtggttccatataaatgtaaggattttgtttctctttctgtatggaatattatttgtattttgacagaaattgcattgaatctataaattgctttgggtagcatagacatcttaataataatgataattccaattcatgaacatggaatagctctccattttttggtgtcctcttcaacatatttcatcagtgatttatggttttctttatagagatattttacttctttggttaagttaattccttggtacttaattttatttgtggctattgtaaatgggactcctgttttaaaatgtcttgtttcagttttttcactgttggcatatagaaatgctattgaattttgtatgttgattttgtactctgcaactttactgaatttgtttattatttctaataggtttttttgtggagtctttaggtttttctaaatatgagatcatatcatttgcaaacaaggataatttgacttttttattctaatttgtatgctccttattttttatcttgtgtgattgctctagctgggacttcctgtactgtgttcaatgacagtgatgaaagtgggcatccttgttgtgttgcagattttacaggaaaggcttttagtttttccccattcagtatgatactagctgtgggtctgtcatatatggattttattcttttgaggtatattccttccatatccagttttttgagagtattttatcttaaagtgatgttaaattttatcaaatactttttcactattggttgaaattatcatatgatttttgtcctttattctgttgatgatgtgttctacttgattgattgtatgacatacattgcatacattaaaccattcttgactcaacagggataaatctcacctggtcatgattaatgatctttttactgtattgctgaatttggtttgctaatattttgttaaggatttctgcatcaatattcatcagggatattggactgtagcattccttttttatatttctttgctttcagcattagggtaatagtgtcctcatataatgattttggaagaattccctcctcctctattttataaaatagtttgagtagggttggtattagttcttctttaaatatttaaatattcagcagtaacgccatttggtcctgggcttttctttattgggtgactctttcttatggttgtggtcttgttatttgttattggtctgttcaggttttgggtttcttcctgttacagtcttggtcagctgtatgtgtctaggactttgtccatttcttctagattttccaatttataggtcatcgtagctacttgtgatcatttgaatttctgcagtatcagttgtaatgccttctttatcacctctgattttatttattgtatcttctttctttttatcttagtctggctaaaggtttgtcaactttgtttatcttgtcaaaaaagcaacctttgttttattgatttatttatttcagtttcatgtatttctgctctgatgttgataatttcttttcttctattactttgggatttcgcttgctcttgcttttctctttccttaagatggaatgtaaggttgttggtgtgaagattttcttctttttgaagtatgtacttacagctataaacttccctcttagtactgcttttggtatatttgataggttttgataagttgtgtttccaatatcatttatctcaagaattttttcaatttccttaatttattcattgaaccactggtcactcaggagcacatttttaagttttcacatatttgtatagtttccaaatacctcttgttattcttgttttattccattgtagtcagaagatgcttgatataattgaatgtttatatataattgaatgttttaagacttgttttgtgacctaacatgtggtctgtccttcagaatgatccatgtgctgaggaaaacagtaggtattccatagccattagatgaaaacttttggaaatatctattagatccattaggtctatagtgcagatgaagtctgatgtttttttcattttctgtctggaatatctgtcaaatgctgaaagtggggttgaactctccagctattattatctattggcctatcttgctctttatttctaatatttgctttatatatctgggtgttacagtgtttagtgcaaatatatttacaattgttatatcctcttgcttaattgacccttttatcattatataatgaccttctttgtttcttcttatagtttttgtattgaaatctacttttttttgatacaagtatagctactcctgctttttttttatttccattagcatggggtatctttttccatccgtgtatgttcagtctatgtgcatctttataggtgaagtgtgtttcttgcggcaacagatcatgggatctttgttcatccattcaaccactctatatattttgatttaatactttagtccatttacattcaatgctattattgataagtaaggatttacttctgcctttttaaaatttcttttctcattgtctcctctttcttctttcttttcttcctgtttaatgagatgattttctctggtaatgtgattttgcttcttgctttttattttttgtgtatctgtcatatgttttgtggtttgtggttaccatgaggcttgcaaatagtatcttataacccattattttaagctgataacaacttaacacagtttgcataaacaagcaaacaaaaaagaaacaagcgaaaagaaaactaataaagactctacaccttaacttcagcccctcgctttttaacttttgttgtttctatttatatcatattgtactctatggctttgtagttattatttttgattgattgattacttagtctttctatttaagataagagtagtttacacaccacagttacagtgttgtaataatctgtgggtttttttgtgtacttactattgcctttgagttttgtaccttcagataattacttatggtttattattgtccttttccttctgtttgaagtattcctgttggcatgtcttgtgttgatgaaatctctcaactactgttaggggtctagtaaagtctttgttactttttcatatttgaaggataattttactagatattctattttagtgtaaaagtgttttttgttttgttttttttcttcagcactttaaatatgtcataccactctctcctggcctgtaatgtttccactaaaaagtctactgtcagacatatcagaggttcattatatgttatttatttcttttctcttgctgcctttaggatcatttcttaaaatttttgatatttgggagactggttatttaatgtgttgaggtagcctgctttgggagttttattattaaatggcttgaggtagtcttctgtgggttaactctgcttggtgttctaacattcattcggatattggatatttggatattgatttgggatattgatatatttctctaggtttgggaagttctctgctattatcttttgaataaactcttttccccggctctttctctacctcctctgtaaggccagtaactcttaggtttgcccttttggggccatcctctagatcatgtaggtgtgcctcattgtttttattctttctttttttgtgtcctctatctatttttaaatagcctgtcttcaagctcactttttcttctgcttaatcaattctgctattaaaagactgatgcattctttagtatgccaattacatttttcaactccagaattcctacttgatttttttaaattattttaatctgtttgttaaacttatctgatagaattctgaattccttctccacgttatgttgaatttctttgagtttcctcaacatacctattttgaattctctctctgaaaggtcatgtatctctatttttccaggaatggtccttggtgccttatttatttggtgagctcatgttttcctgtatcatcttgattcttggaaatatgtatctgtatttgggcattgaagagttacaattagctggtggcaaagccagccaagcctatatctttcctttaaggcttagagttcccccagaccccaggtgggtccagaggtgctgttcagagcaacggactagagttaaaaaaaactagaattccacctggtgttatattgtactgtggctgagctggcactcaaaccataggacactttcttttcactcttccctcccctttccaaaggcagagaagcttcacccagtggccactgccacctctggctaattatataacttttaaatttgaaaaataaaatctagcatatatacaaatgtgacttgaaatatttaattgatggtcaatgcaaatcatatatagaacatgtatattatattataatttgagtttttcttttttaattttagtgctcaaggaggatgtatttcacatgtcctgccagaatttttgcttgaaccagaagattataagaggtggattgaaattatggtaagaaaatataatttcttggaacaaaccacacagttattattgtatgtactggtatttggcctatgttagaatattctacttcagactgttgagttttatatgcaaaatattattaggatcataatttttggataacccatatgtttttgtacatttgtctaaaaatctctatggagttcctatgcaaaaaatgattacatggctttcttaaatatataaataattcctactttggagaatttataaatgaagaataaggtggggttatgtaaattttattcttaaacttttagaatacatattttccaaagaaaatactggttttatttcaccaccatgtgccacttttcttcttcgttttcaggggaaaatagaaatgtagcaagaaatatatagttttgtcataatatatagtttactttgtggtaacctactgagaggggagtggtctttgaggagtctgcaggctttgaggcaactatggttgtaggactctcactatgcttgccatgtgacatgagtagagaaccaggtgcctgcctgttctttggcactatgctgaggtcctgttgccttatccaaagggtgtgattctttcttggctcagcaatcagaagaacttcgtatcgtgttcggccacttattctgcagagtgatctagtaggtgcgttgaatgaataaatgtatgatctaaataagagactgtgtgctccataaagttacctgtggtgatatcttctattattggcacattgcaaattagagctcttgattaaagtatagaaaaggcatccacatgttttgaaaaaaaaaactcatatgctaaatttgccttaaattttaattaatgttgtactattttatttcttaaagtcttccactaatacgatgcctgtgagttcctgtacacctaagaaaaaatgttctattgttatagaaatgtctaaatttgaagcctggagtaaacgggcatggacagatgtatttctacagatatacaaggtaacatttccattattgttcgctgcttctctgttgattaatatgaatcatatgttaattaaagtatagacaatgctgctatgaaagattcaaaaacacagtgccttaaatgagagatttttttttattgctttctcatggaactgctgagatgtgagagggtcaaagcttctggagtatctctttcctcctcagtactaggctttcatgtatgggtctgatttctctgaagaaggaagagcaggtaaaggagtactggaggcaaggagttaccttttaaggatgtgacctgtgaaatatgtctttttcatttcagatttcattaggcagaattcagtcatacagtcatatctaactgcaaaaaaagttgagaaatacagtctctagaatgagtagctacaggaatattctagtactaaaagggagaattaaagaatgagtactggtgaaaattattgtctccacatctaatacacggtagtctcttgctataaaactatattcactaagattcatacaactataggcaaaaggtttttatgagattctcgaacttacttcctgccaaattgcatttgtgggtagattaacatagcgtaaattatacctctatactctgtacccttattgcataagcaagtcctggtttcagtgcttgaataattccttaggttttcaaatatagcactatagatcttgtccactaggaccaatggaggcttttgttctgtcttcacaccttgcaaccccagacgggtgagctgtaggactgagagttagaacaagggaggaattgaatagaatcaggaattagtgactcaaaggaaagggcaaaattaagagctgaatagtgagtagtatgtgtaagactctgtcagtaaattttttaatattaaatcctcacaactgaaatcatcaatttagcaatgaagaaactgagtgtcacaggcgcacattctttctttcaagatcacatgaatttgaccatatgcaacaatttgatgcaggtagtgcttatttcttccatgttgttctctgctggggcccaggagtccagggccctcatgttgccccctggcagtctgaagtctcctttggagtcagccacccagatcaccctctggagagttccttcttctgcatgattcctgacttgctcctcctgtgcttctctttttcaccatcaacctgaactatctttcttgctgaatgtaagaagagtattcttgtgcaaaaattcatttcattggtgactggttgttaatgctggaaatatgatcctttgcactgttagtcatatagggcctactctgcttcaccagaagcatggtcttgggtttggtttgataatccaaactgtgaaatacagtagattttacacagcaacatgttaacttagttttaaggaagtacaaaagatagttataacacagaatgcacaccaacagcgaagccaagagctgtgactcaaagcatagcttccagtgtcccactgacttcacactcacgtcagaaatggttacaagaagtggaatatggtgggcaaggaccatttcaatacaggaaagccttcaagtctgagaaatcttttcagttttctagtcatgcagcaccctcagagtaatgagcaatttctcattactcaatacaaaacactgacaatgaggtatgagcgcttgatctggtacactatcctcatctggattctcaagtaacttggatgtcctataaatgtattgctatacatttctttagttaagggggtttaaagagactccaaataagtgttaaaccatcaggcgtctctaaatctaaaggaaagatcatacataaactgacaattgattcttttctttgggtcaacataagcctagtcaagatgattcttcagaacaaatccaaatatctcattagtctcaaaaatacagagatttttatggacaagtaaaaatgaacattatgttttctaagccagtgggttaaaagaacacataatttaaaaagttgtcattaataaacaataagccaaatataatagcaaagttcatgtgaacctgaaagtgcatatgataggggtgggatagcgctcaatatatgtaaatgtatactattagtagtagttttgtcattgttgttctgaagtcttttaaatgtcccatagtgacatagtgggatagcccaggactatgttctattttgtggccaatgtattgactttaaagggtgctattacatttcttgaatcaaatctttaacaaaaatgaaagataattcgaaacaatgttttctgagggcatgaaagaatttcctgagtatggatcacaaaatttgatttacccaaatttcatcttagctggcacggctcacagcacattcttgcctctgtaattcttactccattccttcaactcatgcttggtgtggtttgcatgttaatggataaatagtaacacttattgccccaggtgtatttggatttgcaagtgatggagtcttggactttgcgtacattttaattcttcgttttatttttctagcaatttattttcagagtattttacaaaactatcattctgtggtaaagagaaaattaataagtttttttttaccaccgataatttcagaaacactgctgtagaattaagcactcagtgtaatggctcttccaatactaaaggttacaaccatgctccatatgggtccatcattaaatcagtattcttagtcaagggtcacttgcagatcttgtcttatttgcagagtagaagtgacagatgacagatgaatcctgagccagttcaggtcattagtcccaaacatatatctcatcagctgtactcaagtaatttatcatttggtatttcccagaaataaacagaaattgatgggggtccttttcaaaggctttaaattgcatttttataatacgtgagatttgaaatgtaggacttctagaccacaaaactgccagaatgaaagaaggcagttccattaaacatctatacaaaatgctaaaatggtgcaattcacatatgctagataaatagctaacattcagaaatggatttttttaatcaaattttgaagtacttcttatagtggtaaacaaaagaacagttttggatgctcataggtattttaacaatctgtatactgtagttatttgaaacactgtatggcataaatatgcattacttagaaaaagagcactttttcagttactattcacatgtacttgactgtaagagtacttgtcttaggtttgattcccctaaaagcagacactgagacaagtatttgagtgcaaatcatttatttcagaagtgctcccaagaagcatcagtagtagagtagtgaattaaagcagataatataatgaagtcagtaacagttgtggtttcaatcaggtttcgctgtgggcaactgaagctcaatgccactggggaccaataggatacattttagaacatgtctcagacttatctcaactgactagtgaggaatctggagtaattaactaccaattccctgaccatctttggtaaggggccgttgctggggtcattatcttctggcgctcctaccttgccctctgtgagctgagtgtgctctcatatgccagaaaaaaaaaaaaaaaaaaaaaaaaaaaacatccctcaagcagagacttacaggttttcacaataagcaagcttcagaatgtaaaggtggaactaaggagatatgagcagggtatcaatagtatctttatagcacatatgactcaaattgttgtgttcatacccataccactggaaaaccatctattaaaggtttgggataaatcaaggagctgagcttacactgtgtactttaatgtgaaccaatgctccattcggaaactcttgagatatatatagtgaggtagcagatcacaagctgttcatctcatctagaacttgtagacaatggttagtagagtgttactttgagtagctctgtactatagtactttactgacagacacagagttcttttcatcttaatatcgctaaaattatttttaaatccagttgcattgctacctaataaaacatgtggtgtacatgtagtgaatggtgatatgatgtgaatataccacactttaagttatagggtaacaataggtcaaatgacaaattgtgtacacttttatcatcttaaaacagacctcttaaataaatgtaagaaaataatttttggcttgttaacttatttacttttactttggcttttctaagctgcatgagctggtaaggaaataagaaaggcatcttacatccttgtgttttaaatgaatttacatcctaacagaaatgttcttaaatgcagttatgttttaaatgtacaataagcctcttgtaaattatacagtgtagttccttaagactaaataccacagaagcaaaaagttgtcaatttaaaatgagcattattgggacacatctgttctactcttttacttctgattgaatccatttaaccagaaaatactagtgccctctttaatctcctgtcatgttttttaaaattttctcttcaaatattaatttgctatttttccatttgcatctaataaaagttatctctcccaatttcaggttttggttctatcccgtgtagtgccatactgcagcaataatatgccccccatatgtgtgcaaaatacaccaaaagtcaatccttgttttgcatccagcaacatatattctgattctgaaagaattttgcttagttggatgaacataaattatgagaatactcgacatgtgatatggaaaaactgtcacaaaggtgagaagtgatatttttctttaaacaaattattgcaaattgtagtgtgatgatggagaaggagccatggatacacaatcaactcagaatccatggattctagacccctctccaacatttactttctgttctacaaaaataatgcctccttaacatcttcaagatatgtttcctcacatataaaatggaaataataaaaggtgcttctttaacttattttgaagaataactgattttaaaagcatatggaggaactctagaatgaaagcattaatcattgctgacattttcaactgtatagagtattaaatatataggtgacactgctcaaacttagtatataactagtcgagatcaagtaaaatctcctagaaaaaatttcacatgtcatatgaggatcatgttggaaatcactaagagcaataatgcttcatgaattctttggagggtaggtcatattaggtatttcacaatgaaataaagtcatttcacatccttgtgttttagatgaatttacattctaacagaactgtccttaaaatgcagtttttttaaccgagtcataagcctcttgtaaattatacagtgtggtgctgagacatgttggtgttcacagatagtactaaggacagtgcgcatggccattgttcctttagcttcaattcaactcctttcttccaagtacatacaaacctattgtgttcaaagtagactgttttttaacatgaaataactttttaatatccaatatgcagaatttaattcaaactttacaagtaaggggaagattaagagttcagtttaaaaatgagactttgaattatgattgcccttaaattgaaggtgttattttagaaaacattcaagaaaacaccaagattgaaaaagatatattgacatgttggtatttgagaacagcaaacatagaatactttattaccttctaattgacatgctgaaaatatcaaaatttatcttataaaaatatatttgccccattaaaatacaaaacaaagtacaaataaataatgctaaggtgaactacacaaaaacacataaaaattagtttgattattgcagagtaacactttgaccagggtgtcataaaatatgtgcatgtattaaaaattaacgtgttaatttgttataaaagtattatggttctaattttaccaaaacagtggcctatgccagttaatttcaaagattttgccacatttttcccaaataatatattatagacatttacctccttgctgttttttagcacactgagtccaatgcctttacaaagcttttgtgcttcctgttccctttgactagactattattttaccagatatcttcatggttccctttctcatttcattcgagtcattgattaaatgtcaccttatctgagaaggtttatcaatatcttctctaaaacaggatatccttcagtcctactctttcctgctctatttttattctcagcagcactttttaaatataaatgtaattgtaaacataaatgtatttgtttatcatctgtctcttccagtagaatgtcaccttctgaataaattagacaagattgctctttgactaattaggaatgtgaccttcttaattagccaaggaacaatcttgtctcatttattcccaaagcctagaactgtgcctaacaaaataacagacacatactgtcttagctttgtcctggtataacagaataccatagactgggtaatttataaagatcagaaatttatctttcacagatctaaaggctgagaagtccaagattaaggtactggcaggttctatgtctgataagggctgctgtctgtttccaagatggtgcctagacgatgcacactccaaacaagaggaacactgtgtcctcacgtggcagaaggcacaaaagagataaactccctccatcaaagaacaatgtattattcagcagtaaaatgaagtgagctatcaaggcatgaaaagacatggagtaaacttatagatgtattactaggtaaaaggagccaatttgaaaaggctacatactgtgcggtttcaactatatgactttctggaaaatgtaaaaccatagagacaggaaaaagatcagtggatactaggggttagcggggaaggagtgatgaataggtagagtacacaggacgtttaaggtagtgaaactactctgtttgatactataattatgaatacatgtcattatacatttgttaaaacccatagaatgtataatattaagagtgggccctgatgtaaactgtgaactttgggtgataatggtttgttaatgtaggttcatcagttgtaataaatgcaccactgcagtgcaaaaggttgatagtgggggaggattgtgtgtgtgtggtaactctctgtaacttctgattcattttgctacaaacctgataatgctttaaaaaactgtctatttaaaaataatttagtaatacatttttaaagcaaaaaataacaattccattgttagactcattaagcaatatgtctaataaatatgaatccattgctctgatgacctgtacagtaaaaaagtccttcagaaaattcataaacttcagtccattgcaatttatgtaaaattatttgtgtgttttaggtaatcattgatctaaatttcaagtctttaataatgttagatacaactcatattttctaaaatattaatatagcaaatatctgtaagctccgcaccaagctttaaatcctatgtgagcacgttgaaggtgctgaataaatatctcttaaataaatcaatggctaaatggatggttatatagataaagccaaaagaagttgaaaagatgttcaagtatttaaaactagttgaaaagctgaacatctgacaggaacagagacaagccaacagcttattattgtatcaaatattatactttttcccttgaggatataattaacctataaacagtgttctatacagacttattttgtgttgatgtgctgatgtgcactcttgtcttggctttgttcttctcatcttatacattctctcttctcctctgttactattttccttcatttattaccatatataacattctttctttttgccacattactttcctcaatcttgctatttacctaagattcttatttctatattacctttttcttacgtctcttttcttttcaatatcttcctttacgtgccttacacctctccttcaatctctatttatttatttttcccttgaccattcagggaataaacacttgaattttaactatgagtgtttccagaagatactgctcactgtgacttctgcttaaaaattacaagctttttgagcattagagttgttcagattcaaagggaggcatttcctctaccctctgatatacagacaccatttttcctcagatttcctgtcttgcccttgtatgctagctaaagcattttggctttctttgtggctctcaagaccctccttagcattctctgttcaaggtctctttccttcatcacattgatattttccttcttctgtctttgctccaaacctccacattttggccatctatatcctcttgtggttttaagttactcttccaatgcctcccagatccaaatctacctcagacctacctcctcacctccagttctgtatatctttctccttatgaacaccttcattaaaatgtcccataagcacctcaaatttcactggtcaaaaatctaggcatccctccttcttacatctaattaatcaccaaccaacaatttattttgattctatccacaagttatcttctgaatctacctacttttttctagctcttctgtcacttttgtaatttatcatttcaatcaatgtcaccctctcatatttaccacatccagtcctgccatttgcccatctgttgctcacacagccatacttagttcttcataaaacacaaattttagcatcagactcctgcctaaaatcctttaatggtattttattcacttcaatatctaccataccttataaccataactctttacattgacttttgcacattatacttcagcgctgtaaactattgattggctgctgcttcctttttttttttttttcacttttattttaagttcatgggtacatgttcaggtttgttatataggtaaactcatgtcacgggggtttgttgtatagattatttcatcatccaggtattaagcctagtacctattagttatttcttctgatgctctccctcctcccatcctccaccctcctgtaggcctcagtgtctgctgttcccctctatgtgtccatgtgttctcatcatttagctcccactttaaagtgagaacatgtcatatttgttccttcattagtttgctaaggttaatggcctccagttccatccatgttcctgcaaaggacatgatctcattctttcttctggctacatattattccatggtgtgtatgtgccatgttttgtttatgcagtctaccgttgataggcatgtaggttgattgcatgtcattgctattgtgaacagtgctgcaatgaatatatacctgcatgtgtctttatgatagaacaaatcatattccttgggtatatacccaataatgagattgctgggttgaatggtagttccatttttaggtctttggggaatcaccacactgtcttccacaatggttgaactaatttacactcccagcgacagtttataagtgtacctttttctctgcaacctctcaagcccctgttacttttcgactatatttttttattttttatttttttgagatggagtctagctctgtcaccaggctggagtgcagtggcacaatcttggctcactgcaacctccacctcccgggttcaagcgattctcctgcctcagcctcctgagtagctgggattacaggcacacgctaccacgcccagctaatttttgtatttttagtagagacggggttttaccatgttggccaggatggtctccatctcctgacctcgtgatccacccacatcggcctcccacagtgctgggattgcaggcctgagccaccgcgcccagcctactttttgactttttaataagagccattctgactcgtgtgagatggtattgcactgtggtctttatttgcatttctctaatgatcagtgatgttaagctttattcatatgcttctaggctgcatgtatgtcttttgaaaagtgtctgttcatgtcctttgcctactttttaatgggttgtttctttttggcttgtaaatttaagttccttatagatgaccttatattccttatattagacctttgtcaggtgcatagattgcaaaacttttctcccattctgtaggttgtccgtttactctgttggtagtttcttttgctgtgcaaaagcttattagcttaaacagatcccatttgtcaattttttctttggttgcaattgcttctggtgtctttgtcatgaaattttttctcatttctacatgaagaatggtagtgccaaagttgtcctccagggtttttatacttttgggttttacatttaactttttaatacaatttggattaatttttatatatagtgtaaggaaggggtccagtttcaatcttctgcatatggttagccagttattctgtcagtatttattgaatggggagtcctttccccattgctttttttgtcaattttgtcaaagattagatagttgtaggtgtgcgaccttatgtctgacctctattctgttccattggtttatgtatctgtttttgtaccagtcatcccctttttgttactgtagcccctttgtatagtttgaagttggatacagtgaagcctccagctttgttctttttgtttaggattgccttggcaatttgggatcttttttggttccatatgaattttaaaatagttatttctagttctgtgaagaatgccattggtagttttatagaaatagcattgattgtataaattgctttgggtcatatggtcattttcacaatattgattcttcctatccatgagcatggaatgattcttccatctgttggtgtcatctctgatttctttgagcagtgttttgtaattctccttgtagagatctttcaccttccttgttattcctaggtgttttatactttttgtgacaattgtgaatgtgattacattcctgatttggctcttgcttgactgttgttggtgtttagaaatgctagtgatttttctgtatgttccttttgtgtcttgagactttgcttaagttgtttatcagcataaggagtttttgggttgagactaaggagttttttacatatagaatcgtgttgtctggaaacaggaaagatttgacttcctttcctcctatttggatatcctttatttctttctcttgcccaattgctctggctaggacttccaatactatgttgaataggactagtgagagggcatacttcatctgtgctggttttcaaaaggaatgcttccacctttgcccattcagtatgatattggctgtgggtttaatatagagagctcttactattttgaggtatgttccttccatacccagtttattgagagtttttgacatgaagtcatgctgagttttattgaaagccatttctgcatctattaagataatcatgcactttttctatttagttctgtttatgtgattcatcacatatttttatttgcatacattgaattaatcttatgttgcagggataaagactacttgatcatggtagattagctttttgacatgctgctgaattcagtttgccagtattttgttgaggattcttgcatcgatgttcatcaaggatattggcctgaagatttcatttttttgttgttgttgtgtctctgccaggcttggtatcaggatgatgctggactcatagaatgagttagggaggagggcttccttctcaattttggggaataagttcagtagaaatgataccagctcttattcatacatctggtagaatttggctgtgaatccatttggtcctgggctttttgtggctggtaggttatttatttctgattcagttttggagctcattatcggtttgctcagggattcaatatcttcctaggtcagtctttggagggtgtctgtgtccaggaatttatccatgtattctagattttctagtttatgtgcttagaggtgttcataatattctctgataattatttttatttctatggggtgactgataccctttgtaatttctaattgtgtttattcagatcttctctcttgtcttctttattattctagctaatggtctatttcattgttttttcacaaactcaactcctggatttgttcatcttttgaatggttttttgtgcctcaatctccttccttcagttcagttctgattttggttatttcttgtcttctgatagttttggggtttgtttgctcttgactctctagtacttttaattgtcatgttaggtggttaaatcgacatgtttctaacttttcatgtgggcatttagtgctataaattttctttttaacattgccttagatgtttcccagagattctggtatgttgtatcttttttctcattagtttcaaaggacttcttgatttctgccttaatttcattattcacccaaaagttattcaggatcaggttattcaatttccatgtaattatatggttttgagtgaatttttaagtcttgatttctaattttattactctgtggtccaagaagtggttgttatgatttcagctattttgcacttgctgaagcgtgttttgtgtccaattatgtgatcgattttagagtatgtgtcatgtggcaattagaagaatgtataccctgttgcttttgggtggatagttctgtagatgtctgtcaggttcatttgatccagtgctgagttcaggtcctgaatatctttgttaatcttgtgtcttgatgatctgtttaatactactagtaagttgttaacatctcccactattattgtgtgggagtttgtctttttgaaggtctctaagaacttgctttattaatctaggtgctcctgtgttgggtgtatattaatttaggatagttaggcattcatgttgaattgaaccctttaccattatgtaatgcccttccttgtctcttttgatctgctttggttttgtctgagatgtagattgcaacccctacttttatttttgttttccatttgcttggtagatttttctccatccatgtattttgagactatgggtgtcattgcatatgagatgagtctcttgatgacagtataccaatgggtcttggttctttatccagcttgccactctgtgccttttaattggggcgtatagccctcttacattcaaggttagtattgatatgtgtggctttgatcctgtcatcatgatgttagctggttattatgcagacttgtttgtgtggttgctttatagtgtcactggtctgtgtacttacatgtgcttttgtaatggctggtaaaggtcttttctttctatatttagtgcttctttcaggagctcttgtaaggcaggtctggtggtaacaaattccaacatttgcttgtctgaataggatcttatttctcctttgcttataaagttaatttggccagatatgaaatcctgggttagaatttcttctctttatgaatattgaatattggccccccatcttttctggtttgtggggtttctgctgagatgtctgttgttagtgtaatgggcttccctttgtaggtgacctgacctttctcactagctgcctttaacaatttttctttcattttgaccttggagaatctgacaattatgtgtcttgtggattaccttcttgtgaagtaccttactgaagttctctgccttccctaaatttgaatgttggcctctctagctaggttggagaagttctcatagatgataccctgaaatatgttttccaagttgtttacgttctccctgtctctttcagggacaccagtgaatcatagatttggtctttttatataatcccatatttcttggatgttttgttccttcctttaaatatgtttttctctattcttgtctgtcttttttttttttttggagtctcgctctgtcgcccaggctggaatgcagtggcacgatctcggctcactgcaagctctgcctcctggggtcacaccattctcctgcctcagactcctgagtagctgggactataggcgcccaccaccatgcccagctaatttttttgtatttttagtagagatggagtttcaccgcattagccaggatggtctcgatctgctgacctcgtgatctgcccgccttggcctcccaagtctgactgtcttagttcagaaagccagtcttcaagctctgagattttctttatagcattgtctattgtgctattaatacttgtgactgcattatgaaatttttgtagtatgtttttaagctctatgacgtcgattacattcttttctatactgcctattttgtcagtcagctcctgtattactttattatgagtcctagtttccttggattgtgtttcaacatactcctgcatctccatgatccttattcctatccatctctgaattctatttctgtcatttcagccaactcagcctggttcataatccttgagaagtgatgcagtagtttggggaaagaaggcactctggctttttgagttgtcagagttcttgaactggttctttcaaatttttgtgggatgatgtttcttcagcctttagagtggctcacctttgggtgttttttcttttttcttttatcttattttatgaccttgagagtttgattgtggtataaggtggattcagctgattggcttcatttctggaagattttagaaggccagcgctcagctctctactcctagactgcgtgctctaactctggggaatatgtgccaggccctgactttgttctctggctcctcgagtttaggaatggactgcactgggtgggggtggaggatgaggtgctcccagactgctggtcactacactctggtgagtagtgttggctgaaggctttcatagtgcagtggcaacaggatccttcctaatttatacgtgccagcagcagcacgatggggtgcatgcatatcagctgcattagggtgctagtgggtgctgggattcctgccttcatgcaagtgttcactccagtggtggaggcaacttggctttggagtgcaaggaggcccctactggtgactctgtctgcttctttctgcatttaaattttatagtactttttgctttgtctggaatctcttttcagtgtctccttatcctcacaattcaagtctcattatagacatcagctcttctaggaaacctttccacaatctccccaagactagatggaatacatcttccttgtcttgtaacatactttatgtaagcttattaaagtgtttgtcatatggttttcacatttgtttctacttgtttctctctcccatagtaatttaagtcctttattgcagaggtttttctagtttattattagcaaaaataaaaaatcataatcacaaaaatattgaatatttactaagtggttctatggtaagctctttactcatattatttatcacaacacttggaacattattgtcaaataaacatctgtagagagtttttatttctaatgttaaaaatatttatgaggataataaaaatcaaacaagtcaatattgtttggcaaggtactacatcaccatagtgtctgtgatgagaagttattgtattaaaatttgacataatatgtactatgctaatcaagcactgggaccttccagagattcaggcaggtgaaactggagggtggcatgaccattatgaacttcatcatttatttattttgaagtttcctatgtatggagggaggaacaggatacagttatggacaaaattaggtttttttaaaagctgatatttaaactgtggatttatatatgaaaatagctaacagatataaaattggaatgtttattacctttactagagccatttccatagcattcctgtgcactgaaaatacatctctcctcacaaaaattgattcatcacagatatttcagaagaataactgcatctaataggacataaatctgtagtttttcatctggagataaagagtaaataactctctgaactctcaacttttctttatagtttgaataaatcaacccatctctttctctctcctatcaagttatttgttttgaaatagaccaagtagtatgttagacattttttcacactgtaaccgttgcagtttcttttttgagttaaatttaattttattttagattcagaggggacttgtgcatttttgtgacatgaatatattgcataccagtggggattgggcttctggtgtgcttattacccaaatagtgaacattgtatccaatagataattttacaatccttgacctcctcccactctcaaccctttttgagtctccagtgtctgttatctctatctttatatccatgtgcacccattgtttagctcccactacaagtgagaacacgtggtatttggttttctgtttctaagttagttcacttagcataatggcctccagctccatccacgttcctgcaaaggacatgatttcattctttttattgctgggtgtggttcgaatttcaatatacatttccttacaatacgtttaaatatataatagttaacgagcttaggtgttttggtgagatgccagttgggcataccaagaattagtcagagaataaactgattagctggttcagaattttttgtttagtggacattttaaagcagtgtggaatagcattaaattagcctttttcttatttttagtttttgtgagtgcacagtaggtgtatatatttatgggttacataagatattttgatacaggcatgcaatatgtgttaattatataatggggtatccatcacctcaagcatttatccattgtgtcacaaacaatccaattatattcttagagttatttctaaatgtacaactaaattatttttgactatagtcaccctgttgtgctagtaaatactaggtcttattaattttttctaactatttttgtacccattaacactccccacttccctcccactcctccactactctccctagcctctggtaactatccttatactctatagtcccatgagttcaattgtttcagattgcaactcccacaaataactgagatcatgcaaagtctgtctttctgtgcctggcttatttcacttaacacagtgacctccagttccatctatgttttagtaaatcacaagactttgttctttttatgactgaatggttctccattgtgtatatgtatcacattttctttattcattcatctcttgatgagcacttaatttgcttccaaatcttggctgttgcgaacagagctaaaacacacatgggagtgcggatatctctttgatatattggttttccttgttttgggtatatatccagcagtgggattgctggatcatatggtagctcaatatttagggttttaatgaacttccaaactgttctccatagtgattgtactaatttacgttcccaccagcagtgtaggtggattccctttactccacatcctcgccaacatttgttagaatctgacttttggataaaagccattttaactggggtgagatgatgtctcatagttttgatttgcatttctctgatgatcaatgatattgaacacattttctgtttgccatttgtatgctttcttttgagaaatgcctattcaaaccttttgcccattttttgattggattattccatttttcttatagagttgtttgagcttcttatatattctggttattaatcccttaacagatgggtatttttcaaacattttctctcatcctgtgggttgtctcttcactttgtgaattattttctttgctgtgcagaagcttttttacttaatatgattctatttgtccattatgcttcggttgcctgtgattgtggggtattaataaagaaattttgacacagatcagcattctacagttttccttaagtttttttgtagtaattttatagtttgaggtcttagatttaagtctttaatccattttgatttgatatttatatacgaaaagagattggtccaagtttcattcttctgcatatagatatccacttttttcagaaccatttattgaagagactctcttttccccagtgtatcttcttaacacctttctcaaaaatgagctcactgtagatatgtggatttgtttctgggttctctattctgttcccttggactatgtgtcagtttttatgccaataccatgccattttggttactatagctctgtagtataatttgaagtcagataatgtgattcttccagttttgttcattttgtttagtataactttggctattctgggtcttttagaaattttagaaattttagaattgttttttctttttatttggagaatgcccttggtattttcataggggttgcatggaatctgtagtttgctttgggtggtatggacatttaaaagatatttatttccccaacccatgaacatggaatatctttccatttttttatgtcatcttcaatttctttcaaaaatgctttatcattttcattatagagacattttacatcttttaattaatttatttatttatttttttgagatggagtcttgctctgtcacccaggctggaatgccgtggcgtgatcttggttcactgcaagctctgcctcccgggtttacaccattctcctgcctcagcctccctcctgagtagctgggactgcaggcacccgccaccatgcccggctaatttttttgtatttttagtagagatggggtttcaccgtgttagccaggatggtcttgatctcctgaccttgtgatccacctgcctcggcctcccaaagtgctgggattacaggtgtgagccaccgcgcccatgctagaaacattttacatctttagttaaggaaattcctaggtatttaattttatttgtggctattgtaaatgatattactgtttttatttctccttcagattgtttgctattggcatgtagaaatgctactgatttgtacttgttgattttgtagtctgcaagtttactgaatttgtttttcattctaatagtttttttgaggaatctttaggtttctccaaatgtaagatcatatcatcttcaaacaaggataatttgactttttctttaccaatttggatgcttattactttattttcttgtctgattaccctagctaggatttacagtactttgttgaatgacagtgctaaaagtgagtatccttgttgtgttccatacatcagaggaaaggctttcagttattccccatttggtatgatactagcttcgggtctgtcatatgtagctgttattatgttatgtcccttctatactcagctttttgagggtttttataagggatgttgaattttatcaaatgctttttcagcatcaattgaaatggtatttttttaattctttattctgttgatatggtgtatcacatttgttgatttgcatatgttgaaccatccttacatcccagggataaatcctccttggtcatgattaatgctgtttttaatgtattcttgaattcagtttgctagcattttgttgaagatttttgcatcaatattcatgagatttattggcctgtagtttccttttcttgatgtgtctttctctggttttgatatcagggtagtattggccttgtaggatgagtttggaattattccatcctcctcagtttttcagaataatttaaataagatggatattagttctttaagtgtttggtagaatacaacagtgaatccatcaggttctgggcttttcaatactgggagactttttattatggcttcattcatgttacttgttattggtctatttaagttttggatatcttcacggtttaaagttggtaggttatatgtgtcaaggaatttgtccattccttctagattttccaatttattggcatatagttgctcatagtgtcttctaatgatcttttgagttgttgtggtatcagttgtaatgtctactttttcatctcttctttctttcttctctctttttttcttagatggtctgtctaaaggtttgtcaattttgtttaccttttcaacacatcagctttttttttttttgatatggaatctcgctctgttgcccaggctggagtgcagtggcatgatcttggctcactgcaagctccgcctcccaggttcaggttcatgccattctcctgccttagcctcccgagtatctgggactacaggtgcctgccaccacacccaggtaatttttttttttttgtatttttagtagagacggggtttcatcatgttagccaggatggtctcaatctcctgacctcatgatccatccaccttggcctcccaaagtgctgggattacaggcatgagccaccactcccagcccacattgcctttttattttgttgatcttttgttttattttcttcattttgaatgaatttatttctgctatgatcttgattatttctctttttctactaattttaggcttgttttgctcttgcttttctagttttttagtatgcatcgttaggttgtttattttaagttttcctgtttttaaggcaggcacttgcagctatgaaattctccgttactactatttttgatgtatcccctaggtttggtatgttgtttccattataatttatttcaagaaatttttcaatttcctttgtaatttctccattaatccactggtcattgaaaacatattgtttaatttctatgtatttgtatagtttccaaaatttatctcattattcctttctcattttattccattgtgttcagggaagatgcttgatatgattcattttttttttttaaagtttgaaggctttttgtgccctaacatataatctgtttttgagaatgatccatgtgctgaggaaaacaatgtgtattctgtagccttcagagtaaatgttctgtaactgtctattaggtccattttgtctatagtgcagatgaagtctgatgtttctttgttgattttctgtctggaagagctgtcaaagcttgaaagtggggtgttgaagtctccagctgttattatattgggttatatctctctcttaagctctaataacatctgctttacatatctgggtgctctagtgtttggtgcatatatacttacaatttttttgcctcttgctgaattgaccaatttatcattatatagtgaccttctttgtcttctgatagtttttgtcttgaaatctattttgtctgatgtaagtatagggactcttgctcatttttggtttccattggcatggaatattttttccacccctttataattttagtctatgtgtacctttataggtgaagtgtgtttttttcatcatcaaatcattgagtattgttttttattatctattcagccacactgtatgtattgattggagagtttaattaatttacattcaatattattattgataagtaagtacttactcctgccattttgttgcttgttttctggttgttttttggtcttctctttcttctttctttccttttggtcttctcttagcgagggtgattttctctgattatatgatttagtgttttgctttatattttttgtgtatccattgcatgttttttggtttgaagttaccattaggcttgcaaatattgtcttataacccattatttaacttgataacaacttaacactggttgcctaaacaaacaaacaagccaaaagaaagcccttaagaactctatgtcttaacttcatccctccccatcttctgaactttttattgtttctttttatattgtatagtactgtctatgtcttgtaatgtttttgtagttattagttttaattggctcatcattcagtcttgatacattgaaagtggagtttacacaccacttacaatgttattatactctgcatttttctgtatgcttattattactaatttgtttagtaccatcagatgatttttttattgttcattaacatcctcttctttctgattgagttactccttttagcatttcttgtagaacatgtatggtgttaatgaaatccctaagcttttgtttgtctgataaactctattactcctacatgtttgatggacatttttgctgaatatactattctagagcaaaaggtttttttttgtttttcttcctttttccctttattactttaaatatgtcatgccactctgtcctggcctataaggtttctgctgaaaagtccactgcctgatttattggagcacaattgtatgttatttgtttcttttctcttactgcttttaggattctgtctatatccttgatctttcgaagtttgatttttaaattgctgggggtagtcttctttgggttaaatttgtttgctgttctatagccttcttgtacttggatattgatatctgtctctaggtttgggaagttctctgttattatccctttgaataatctttatacccgtatctctttctctacctcctctctaacgtcagcaactcttagatttgcccttttgaggttattctctacgttttgtagacatgctacttttttttcatttttcttttgtctctgctgactgtttatattcaaatagcctatcttcaagctcagtaattctttcttttgctgaacaattctgctattaaaggactttgatgtattttttagtatgccaactgtatgtttcagctccagaattctacttgattctttttaattattttaatatttgttaaacttacctgatataattctgaattccttctccatattatcttgaatttctttgagttttctcaaagcatctattttgaattctctgtctaaatggtcacctatctgtgtttctctgtgatttgtacttggtgattcatttagttcatttggtgaagtcatgtttttctgaatagtgttgatgcttgtatatgttcttcggtgactgggagttgaagaactcttaacatttattgtactattctcagtctgggcttgtttgtacccatacttcttggattagctttcctgatactcaaaaggacttcaatgtcatgttctaagctgtatctgctttaggaggcacccaagcccagcaatgttatggttcttgcagactcatagaggtattgccttgatggtcttggacaaaatccagaggaattttctggattatcaggcagagactcttgttctctttctttactttctcccaagcaaatgaagtcttgttctcttttctgagatacctgaagctaagggtgtagtgacacagacacctctgtagttaccagtcttaggactgtggtgagcacagcactgggtcttacccaaggcctgctgtaaccactccctagctactgcttgtgtttgctcaaggtcctgggtctctacaatcatcaggtggcaaagccatctaggattattcccttcttttcagggtggtgagttcccccaggtcccaagtgtgtccaggggtgctgttcaacagccagggactaaagtcaaaaacctttatagtctacctggtgtcctattgtattgcagctaagctggcactaaaactatgagacacagtccttcccactcttccctcccctctccgaaggcagaggagccttaccctgtggccacaaccaccacaggctcacagtgagtactgccagaccactgatgttttttttaggcccaagggctcttcagtaagcttgtagtaacttctgcatggactgggacttccccttcagaactgtgggtgcccttttgtcccagagcaggttgagaaatgccatccaaaagtcaagttctggaatcggggactccaggagcccacttggtgctctatccactgtggtcatgctactgtctaaggtgcaagacagaggtctctttactgtttcctctgcttttcttaggtgaaagtagtcttaccccatagccaccacacctggggatgtgctgagtctcacctgaatccagcaagtctcagagtctcatccaagttcctcaacattgtacctgggtatcactgctggttattcagggcccaaggcctctttggttagtggttgatgaatcctgctaagtctaggaccttcctttcatggcagtgggttcccttctggctctggatgtgtctagaagtagtgtccaggagctgagttctagaaagaggacctcacaactctgaaaagttccttatcctgctgtgcctgaactggtattgaagatgcaagacagggttctcccaactcttccctctcttctcaggtggagggaaagaatctcctttggagccacaaaagctatgcagcatggggttagggaagaggtgatgcctacagtggtgtctcgataggttgcagcccccaagtcttctggctctgagtacggttcagcactaggacttgcctgggagttcccgtccttgtggcctatattgcctttcaagttcacctagggtccaagaggactttagtctgtgatggtgagccttgtgcaagctcaagttttgaccactgtgattggtgattcccttctggctatgcttggtttatatgttccctctgtgtctggtcatcagctgagttcagtccagttttgttttctattataacagggcagcactgagttcagtgcttcacaattgctgcaatatccctctccccagtgcacagaaatgctctctgccccacactgcaactgccaaggcttaggggagggatggtgtccacaatttaagattgtttttcctacctctttattgcctcttttagtgatatgaatttaaagccaggttctgtgagtgttcacctcatttttgcttcttatgaagatgtttcttttgtgtagatagttgttaaatttgtgtctttgctgggggatgatcagtagagccatttattctgctatcttgttccaccctcgattcataaaaaatatatattttaaaattttaggaatattcacaattgaattgaacacaatagggaactcagaacaatgaatgtatataatagaatttagtataatgagagtgacatttcaaaatccataataaatattacttcagtcagtaaatagagctagatcaattggctgatactttggaatacaggtaaaattatctctgtattacataccatataccgaaaatgaataaataaatgccaagattgtaaataacttgaaggaaaaataagtgaatcattatctgatttttgtatgataatttatttaaaataatcctcacaaggacagaagccactaaaactattatttggttaacaaatatctattaatcaccaatttatatgtttagcactgttctagggattagagatgtagtagtgaacaacagagcccaaatcccttctatcatgtcagataaattctagtaaaaagaagcaagtcagctgcatcggccctggaaattagtctagtctcttgagtagcaggtggaaatgtttatcactcacaatacattcacaagctgattaaataaaatttttattatatttataattggaattcttggttgattattgaactacaaaaaatcaaaagaattataaatattacataaatatacatatacacatccacatataatttagcattttttaatatagaaaaatacataagtaaatatatgtttattcgccaactgttttatcaatgtttccatgcctgactccagtgatttacaatttagctgtcttctgtccttaatcccattatcaggacaaactgtcaccctttgtaatggtcagagaaacaacagtgtttgtgatatcattgtaaatagaaagttaagaactatgagagacaagcaactatcatattccataatgttcagagttattgtgtagataattcatttttgaagaaatcttaccttttaatgtattgtctaaatagtactctcatttcctctcaccttcctccctcagtgtcatcatttttgctacatttactatgcctgcgttataaatatgtgtaacacttatattctgttactacgattcaaccatgtgtaatgttacctggaacttccatttttactgcatttcactattagatggataaataccataataattttctttttctttttttttgcttttgttttatttttcccttcaaaattattattattattattattttattatactttaagtactggggtacatgtgcagaacgtgcagttttgttacataggtatacacgtgccatggtggtttgctgcacccatctacccatcacccaatacctaacattaggtatttctcctatatgttatccctcccctaggctcccaccccctgacaggccccggtgtgtgatgtttccctccctatgtcaacgtgttctcactgttcaagtcccacttatgtgtgagaacatgcagtgtttggttttctgttcacgtgatagtttgctgagaatgatggtttccagttccatccatgtccctgcaaaggacatgaactcatcctttttatggctgcatagtattccacatatgtatatgtgccacattttctttatccagtctattattgatggacatttgggttggttccaagtctttgctattgtgaatagtgctgcaataaacatacatgtgcatgtgtctttatagtagaatgatttataatcctttgggtatatacccagtaatgggaatgctgggtcaaatggtatttctagttctagatccttgaggaatcaccacactgtcttccacaatggttgaactaatttacactcccaccaacagtgtgtaagtgttcttatttctccacatcctctccagcatctgttttttcctgactttttaatgatcgccattctaactggcatgagatggtatctcattgtggttttgacttgcatttctctaatgaccagtgatgatgagcattttttcatatgactgttggctgcataaatgtcttcttttgagaaatgtctgttcatatcctttgcccactttctgatggggttgtttttttcttgtaaatttgtttaagttctttgtagattctggattttagacctttgtcagatggatagattgcaaatattttctcacattctgttggttgcctgttcactctgatgatagtttcttttgctgtgcagaagttttttagtttaattagatcccatttgtcaattttggtttttgttgctattgcttttggtgttttagacatgaagtctttgcccatgcctatgtcctgaatggtattgcccaggttttctttgagggtttttatggttttaggttttaggtttaagtctttaatccaacttcagttaatttttgtataaggtataaggaaggggtccagtttcagttttctgcatatggctagccagttttcccaacaacatttattaaatagggaatcttttccccattgcttgtttgtgtcaggtttgttgaagatcagatggttgtagatgtgtggtattgtttctgaagcctctgttctgttccatgggtctatatatctgttttggtaccagtaccatgctgttttggttactgcagccttgtagtatagtttgaagtcaggtaacgtgatgcctctagctttgttcttcttgcccaggattgccttggctatgcggtctcttttttggttccatatgaagtttaaagtagttgtttccaattctgtgaagaaagtcagtggtagcttgatggggtggcatcgaatctgtaaattactttgggcagtatggccgttttcatgatactgattcttcctatccataagcatggaatgtttttccatttgtttgtgtcctctcttatttcattgagcagtggtttgtagttctccttgaagaggtccttcacatcccttgtaagttggattcctaggtattttattctcttagtagcaattgtgaatggcagttcactcatgatttggttctttgtttgtctattattggtgtataggaatgcttgtgatttttgcacagtgattttgtatcctgagactttgctgaatttgcttatcagcttaaggatattttgggccgagacgatggggttttctaaatgtagaatcacgtcatctgcaaacagagacaatttgccttcctctcttcctatttgagtaccctttatttctttctcttgcctgatttccctggccagaacttccaatactatgttgaataggagtggtgagagagggcataataattttatttttctgatcacttcaagaatctctattctcttagttctctttgtaactatcttagtgtgatttatatgtgaatagtatcttactaagtataaaatttgggggttattatttttctctgaacactgtgcacagtgccctcactatgttatgcctataaagtagctgtgaaaaactgagatcagcctgataactcctacactgtaagtgaattgctttgcgttgttctgcacttttttatattctcaaaatgagtgaggttttgaaggatttaaaacctattctacaatatacatttctttgtaaatttggcatataagatatttttggtgctcatttaaattctacaatattgcttgaaactcagatatgaagatgctttttagaatattctattaacataaatgctcttgtattatacctgatatttttgtataatcttaaacagagcatatttaacatttaattattaactatggtatttactatatgattattttgcagattattttcattacatcctgaaagttatctactctccttagtttttctaggaattttatgatgaataatattgaatatatatatattaatttgtcaaattaaatttatttaaaaatgtgaattaaccttgcatcctggcacaaactcaaattttccatgatagttaaattatttttatttaacttaccagaaagaatatttactgttattttagttgattgctttaacttacttgaatgataattaatctgtaatttttttctaccattttattttttttaatacatttaatgcaaaccttaaacaattgcctggagaacattctttttttggagacattgaaagagtttctgtgttagtgatatttcttgttttttgaattttatggtattcactgataagaccatctagatttttttctttgtaggatgattttaaacaacaagttaattgtttaatcgttataggattattcttattttctgtttttccttgaatgagattttgtaacatatttttgtgaaattaatgagctttatctaaatttttataatactagcacaaaattattcataaattattgcatctattctattatatgcaacttctgtaattgttttctttttattttcaatttttttcttatagcatcttctgttttaattcagtctttctccatagcaatttttatcttgatactgaaaatattttacttaatttccagtttattgttcacttatgtagaagttatatcaagtattatatacattactttatatcacatttcatgtgactcataactattatatgtgactgatcttataatgatttagagttcacatatcttcataactcaactacctttacaagcaagattatctatgtctgcattaaagaatatacctcattgcatttcagaagtgtttcaaaacaaaattcgaaaatgccctattatattttatgaagatagacatggaaatctgaaattactagcaaatggaatccagcaatatagaaaaagaataaaatataatcaggagatgaaatctatcttaggagtacaaagttgttttaacataaatgccagtccatgtagtacatcatattaatgaaataaaaatgaggaaaaaggaatatttcaatggacacagtaacagcaaaattatgtatctagcaagagacttgtatgaagaatatataaaaaacacttacaagtcagtgataaaaagacaacccaatttaaaaatgtgcaaaatatttgaatagacatttctaaaaggaaaataagtaaatgacccacaagcacattaaaagatgttcagcataattagtaatttgggaaatgcacagcaaaatcacagtaagttagcatttggcaccaacttctgtaactaaaatttttaaaaagtcaaatgtaaaagcttctgcacagtaatggatacaatcaacaaagtaaagagacaacccacagaaatgggagaaaacatttgcaaaatattcatctgataagggattaatgaccagaatatataaggagctcaaacaactccataggaacaaaaaatttaataatctgataaaaaatgggcaaaaaatttgaatagatatttctcaaaagaagacatacaaatggtaaataggcacatgaaaaggtgctcaacatcattgatcatcagagaaatgcaaatcaaaactacagtgagatatcatttaaccacagttagaatggcttatatccaaaagacaggcaataaaaaatgctggtgaggatgtggagaaaagagagtccttgtacactgttggggggaatgtaaattagtacaatcactatagagaacagtttggaggttcctcaaaaaactaaaaattgagctgcagtttaatccaggaatcccactgctgggtatatattcaaaagacaggaaaccagtatattgaacagatatttgcacttaacagtttgttgcagcactgttcaccatagccaagatttggaagcaacctaagtgtccatcagcagttgaatagataaaaaaaatgtggtacatacacacaatggggtactattcagccataaaaaagaacgatatcctgtcatttacaacaagatgaatggaactggaaatcattatgttaagtgaaataagccatgcacagataaacaaacattgtgtgttctcatttatttgtggaatctaaatatcagaacaactaaagtcatggacagagagtagaagaatggttaccatggactgggaagggtagtgagaggctgggggaggtggggatagttaatgggtacaaaaaagaatagttagaaagaatgagacctactatttgatagcacagcagggtgattatagtcaataacaactgtacttgttaaaatggtgttatcagattgtttgcaactcaatggataaatgcttgaggagatggatgccctattcttcaagatgtgcttatttcacattgaatgcctgtatcaaaacatctcatgtaccccataaatatatgcatctactatgtagccacagaaattaaattttttgaatttaaaaaataaagactataacaagtgttggcaaggattcatagaaatcggaaacctcatgtgttgctagagggattgtaaaatggtgcaaccactttgcaaaactgtttggtagtttctcaaaatgttaaaattagattaactaatgagagaggttatgcatgcatgggggcagggagtatatgggaaatctctgcactttttgcacaattttgctgtgaatgtaaaactgctataaaaaaaagtctcttgagaaatagattagcaatatgattcaacaattccactcattggtttatactcaagataattgaaaatatatgattacaaaaaacttttacataaatgctcatagcagcattattcacaatagccaaaaattagaaacacaaatatccataaagaaaatgtggtatattcccaaagtggaatgttattcagcaataaaaagaaatgaaatacttatacatgctgcaacatgaatgaaccttgaaaatattatgctaaataaaagacaacagaacacaaaagggcacatattttataattttatttctatgacatgtccataatagacaaatccatagtgacggaatgtacattcatttatgtccatggtatgagggaagagagaaatgagaagtgacaattaatgagtatcaagtttatttatgtgttgataaaaatattttaaaagaagatagtagtgatgattgcacagctatatgactatactaagcaacaatgaattgaacaattgaattgcatgaaatttgtgttatgtgaattatatctcaatataacttttataaaaatgtactgttatagtcatctaacataaaattcatgtgacaattattatattcagaataagtaaattgactaattttttctaaaatttctgattaaattttgtgtttaacaaacacatctctaattcataatactataaagaccagtatttttattgctacttaaatatacctgaatatcagaagtgatgtaatataaaactggataaaaacataacttcccaattaaaaattttaaaaatgtgtggagcatcacttgaattttctggtttctgacaaatgacaactacattagactgctggttctgtctccaaaaaaagacaaccattgaccaacacgtctcagacgataatgtgaatacttggagattttgctaatatgtttttatattttgctaggtgttgggtgaggccagaaattctgcattttcaacaagcttccatttgatgtaggtgctgctgattcacttagctcactttgggtagcaaatccttagagggagtatagaagagagagtagcttgtatcaaaggaactatcataaaagtagagaaaatccttgatgtatcaaagctgtgataaactgtgatgagggcttggcagcagccttgagtataaaagacaagatacaggcataggatcagagattagagaagagctttgaagttttgtctttactttttcacatcatcgccttggaagaatcattgtcatcctattcttactgagagccttgtttgaacagctacggcccatgcctactggtattcaacaagtaagaatatcaaagcagattcaaagttgtgatgggttgaacaaaaatagatgccctggtttctactcagggagatagagaactggaaactgttttcttccacccttataacaacaatgaaagtcagacaagcagcaaattctctgtttttcttgaaccttaacataaagctgagattgcagggcaacaaagagagacttggtttttactggaagaaatgagatgatagcaatggtctacttgtagatagagctagacgccattaagaatagttgagttagggtgattggcgtattggtagaggccaagtatacactagtgagagatcatgaaactcctagtggccacagttatagactctgcatcttcttgcaggtgtttactccacaaacttcacatgttgctcacagaaatgactaaagtgagtctggagaatgtgtactccttagtacctagtgtaggggcaggcaattcactccgacttctgtatatctgtcttagtccatttagtgttgctgtaacagaatactacagattgggtaatttataaacaatagaagtttatttgggtcatgactctggaggctggaaagtccaagataattaggttgcatttgatgagggccttcttgctgcattattacattatagtaggcatcccatagctagagaagatgataaaaagtaagagcatgcaagaaagagagaaaaagagggccagactcccaatgtaactaacacactcctgagataacaccattaatccattcatgaagccagagctctcatgatctaattacctcctaaaagtcccacttctattggttggtattaaccattgaaatggcaatgaaatttgaacatgagatttagaggggacattcaaaccatagcaataccttatagaacagatgtgttcatctatgttaatttaaggacaacagatactgtcccccaaagggctctggtgaatactcattgcagtttaaaaaaaaaaaagaaaagaaaaagaaagaaaaaggaaaaaaaagaaaataacaaaccacctcttgccccgagaaaggggctggaattcaacatttctgtcaaatagaaaatcccaaacaatctataaaaagctcctagaaatactatattcatttatcaaagtcagaggatatatgatcactatacaattaaattaaattatatttctatatattggcagtaaacaattggaatttaaaataaaaatataccatttaacatagaagaaatacttaagtatctaatattaagtacttagtataagtatgtataacaaaataaattagagatatatatgctataaactacaaaacactgatgaaagcaatcagtgagaaataaatagagaaatatagcatgcacatgacgttggaaaactaaatgttgttaggctatcaaattgatctctagattcaattcaattccagtgaaaataccatcacatattcttatagtcaatatcagtaagttgactctaaaatatatatataaaggcattgccattaaaatagccaaaacaattttgaaaaggcggaagaaattctgaaactacgataattaagactgggtggtattgacaaaagaatagatgtgtagatcaaaagaatagaattgagaggcaaggaatatatctacacaaatataatcaactgggtgtttttggttacaaaagtgcaaaagcaattaaatcaagtaaggctagtgttttcaacaaatattacttgaataattggaagtgcatatgtaaaaaatgagcattggcctatacctcacatctcgtactaaaattatctcaaagtagatcatagatctaaatgtaaacccacacaacttttatatacatacatatatacacgtatatacatgtatacacatatctatttgtattggactttaccatattaaaatttctgctttatgaaagactattaagagaaagaaaagacaagctacagactgggggaaagtatttttgaataacatattccacaaatttcttgtatgcaggatacataaagaactctccaaattcaacaacaagaaaataaacaaccaaatttgaaaaatagtcaaaagttctgaaaagatacatcaccaaaaaaagatagaaagatagaaaaaagacatatataagttgcccaatacaattactatataatccagaaatctcttttccagctgtttcaccaaaatacattagaattaccaagcatcgtatgttttcactcataagtgggagctaagctatgaggatgccaaggcgtaagaatgatacaatggactttggggactcgcggggaaagggtgagaagggagtgagggataaaaggctaccaactgggttcggtgaatactacttgggtgctgggtgcaccaaaatctcacaaatcaccactaaagaacttactcatgtaatcaagtaccatcagttccccccaaaacctatggaaataaaacttttttaaaaaaagaattgctgatcacaataagcactacatgagataatttatagcagattttcctaattgcctctaaactgaagacaaaccaaatgcccttcaattggtgaatgaatacctcatctctgtgacatccatcaaatacagtactactcaacaatgaaaacaacaacgactattgattcacacaacataggtgcatcttaaatgaatttcactaagtaaaagaagccaaaacaacaagaccccacaagactacatattgatattgtttgattcaacttttatggcattttggtaaaggtgaagttattgagattaaaaacacatcagtgtttgccaggtgctaacagatgacggtagggattgactacaaaggtgcagcacgttggaattttgggggtgatcacacttttctttatggaaatgtgatggcaggtacgtgaaaatgtattcctcaagttcctataggtgtgtaccacaaagagtgaatgctagtgtaagtaattttataaaatcaaccaacatatgtaagtaattaaggacaaaatgcaggctgtggcaaatgaatataactgggttacaaatgttggacaacctcactgatggtaatgaaaaagaaatgagcttatttaatggtaaagaaatataactgtgtagtctaagactaaaggtgtaaagaactatacatacacaccttactctagtttctgacaggggtatggctttgcaattctgaaagcactttatatacatactagggtttaaccaatacataaaaatattgtagataatgagattgagatttttcactgttaacaaaataaggtggggcgggtgtcataatgaattctgtggtcctgagttgtgattggtggagtgggaaataacaggataacagttagttgttgctgtattgttatgtattcattgacttctgcttggaggatttttttttaattcattgttttcctgttatggatgtgattttcctgcaacaagatattaagctccttcaagacaatttctgtccctcctctaatgtctgtacaagacaaggatgtgctatctggtggatacagtctatgtccactgctaactgactgattctctatcagtgtaaaaggctagtaaattatctttttcagatcaaaagttatcattgcttccagtccagagaaaaataaatattaactacaaaagtgaaatattttgcttttattgatagctatgggtggcaaatatacattcagagaagcacattttacttaggtaagagagtacatcttaggttctcaccacatacatatacacaaaatagtgactatgtgaagtgatgaatatgttaattagcttgattttgggaatcactacacaaggtatacttatatcaaaacacaatttatgttctatatacatatactctttatttgccaattatacatcaaagctggacaaaaaagagaagcacatgtaggttatcattattcagccaactgaatttaaaatcattaattcgattacattgaatcttatatcaaaaatgttatttataagttttgatcaggaaataatactttgaaaaatacagaagttgtttgctatgcattagttgaaaatccttagtgatctgtgtttactagactgattttgtgacaatatgctatagaaatcctatagaaatgttcaatgtcatagcttctcagatgaaaaagtactggacattgtctgtgaagtgtccaggacatctgtgattcaagagataattaagtcttccaattccaggtgtaaagcaatcccggttttgaagctaatatacatgtcatgggtgtatcatgtcatggtttttcttcttcacagaaaatgggagtagagagatttgagggaatttataaagatcaccatttgccccttgttttcagacaagaaattgtctcacaccatgaagaatctaggccatttggaaacttattgaaaaagaaaatgtcgcattcaacatagggattatttccactgtttaaaattaacctccacccaatataggtcagtatttcagatattcacttaaaattcagatacttcctctttttgttccagactcagcgtagtaatcatgtctgtaattgagaattccttttactactcctccatcctgtattgccttttataggtcaattttggtttctttaagccataaatcttgaattcctttcacatactttcctgccacgtggatgaatttctgcaagaaataaagaaactggcactagcactctaaagttaaaagtaactccatgccttttcagtctccttacccatgttgatgatcattgattaaacatttgaacctcaaggtactcaacagaatgggtaattttgaaacattgaatttctattccattattacactgtagtgtatttttcaaagcagctcatatagaaataaagaagacagcttgcaattgtttataaagccttacaggtaactctcatagtattaatcttctgagacttaaaatttgtttttatttccaatataatatactttttgtttcccaagcagaagcaaaattttcttttactattgctcaaatttccataggtatcttttaataaagtaaaactattgttgtatttactctccctcttttttgaaacagatgttatcccttctgagagatggatagtaaattttgacaaagacctttcagatggtcttgtttttgcaacacagttgggagcctattgcccattcttggtaagagtcgtttttatgcataatgatcttctattatttaaaaaaacttagtgattaaaatttgaagtgtattttctgtaaacagattatttcgaatgtcttacattcaagtcaaacacctgaatctgcatggccagcactacctttttgtttattcttgcattttgattgcaataatttattactgacaaatattaatatttaaatgattctttgcctaactatagagaacacttaaaaaacagaattttttattccattaccaaaaggtttgatttttttttttttacagattgagtctcattttataaatatgtacacacgaccaaaaagtcctgaagagtatctgcacaattgcctgattattgtaaatactctttatgaaattgactttgacgtggaaatacaggtgggtgcctttatattaaacattctacaaacattttataaatttcttttgatagcttgctcatttataatattgctttgttcatatttttgaaatttaaattgaaacaggcttttgatgagacattgctaaaatgtagaaattgaaatatgactccacagaaatcgactggatattttaaaatttgtataattatatacatccagctgtgcataataggaaagtacttccagtccaagtgcctgaaaccccaaaaataaacattgagtgaattataatcattactcaaaatctaagaatgaactaaaagagcatatttatttaaatatagatgtcatattattatcttctaatttagtagcaaaaataaattttcactttagtattaaaataaatgtttgtatagtggtcataatggcaatatacgttttaattgtatgttgaccttcaagttgtaattccttttggcttttcacatcaagacctcaatagcaataatcaaaaatatattggattcttactattttatgagccttttgtttgttacttaggggcaataaaatggtaaaataaatgattcctgactttgaatatataaattcattaaattatcaagatatttgcctgttaaaagataatgctctacttatttaattgttaataatggtctatgaaaaaaatgaagtatagaattcagatgaaggaagagatcaatgtgatgcagactgatacatcaaagacagtgtggaagagacagaatttaattggcatctggaagggtgaattggatttgcattggtagtggtaagaaagaaagttgtttgctcagaggaagtaacatgaacagaatgtagagtttgaaaaagtgacatacgttaaggaaattgtgtgaataggtttccccagttgaagtttggtattggaaacagagacataggcatatactaggatattgaatatcagcataaaaaaatcaggagtttatcctgtgggcattatgggggataaaaggcctttactcttgcaacaacaattgtcaggatggaccgagaggaaaggaactggtgacagggaacgcagaccagtcgcaatgcaatttgaactggtcaaggagtacagtaattactttctctactcttatcattttaattaggatttaaacataataagctgatgtaggaaaaatcatgaggtttgctagagttggtgaccagccacaaaagaagggcattggagaaagactattataactaactctgagtttttcattctgtgatccagaaagactgatgatactagtgcccaaaatgatatcttacacctgctggagaaatgagttttataattgctcacttttttctttgtattgaagtcacttgcatgttaatgtcactttgtaccattcctgacatttgtattctttttatttcattttcttttcatttatttttttttggtacaattgtaaagggaaactgcaatcaataattttagtcagagagttctaatagtagaattttaaggacaaactctaataaaagtctttggttttgaagaataaaaatattacaattcccataaattcaacaaattatttaacctccctcatgaaagacactggatacatccttcaggggtgcagatgtgacaaaactacactcatgccttcaaaggtgttgcagactaataatcacaagttacatgaaacaaggctaatgcaaagcgacagtgaatgtcacaatagacatagaaataatatgctatgagactcaaaggagacaagaagtcactctaaaaaggataccaggaaaatttgcacagaacacttagagtttaagctgacccttgagagtttggtaggagttcataagaaatttaaaatacctttgtttagaaaaaccatacattgtgactctctcctttgctttttgatttcctcacatatgttggctcaatatatttattttattgtatagtcaaaaataatttaaaaataagtatctactagataaaaatgtagaaaagttgtccaagatttgatgaatgaagtaattgaaagtcggcttagcagataatgaccaaaactttatcagccaattccaatgccctaactctttattagcccagatttaccaaccacactaaatggcagatttaaaaccatcaccctctaatgaacttatacataatgaattaatgctggtgcttgtactggtccaccattgaatcctgtaaaattcagcaatggacttaattattaatgcttaagtttcttctttattatgttcttaattgcagcctgaaaattagcttcataagttgctggggtaatgttatgtctttttggagaatcctgccagtaggaatatacagttattacatattacatattctccttttcatgacatgatttttatttgaagcaaaaatactatggaattgtttgaccacagcgtagaatgcatgttttgttccctcatgcaaagatagataacaaaatacatataataagcatttatggagctttagtacacataatttaatgagtagtgattggagctaagggtgaatagatattctaattttgtccttaaatttttttttttttttttaatcacttgttagggttctctagagacacagaaacaataggatatatgagaggggatttattagggggaattggctcacatgaacacagagtcagagcagtctcatgataggctgcctgcaagctggaacacagaagagctggtggcatcgctcagtccagaagcctcagaatcagggaagccaatggtgcagcccctagtccaaatctaaaagccagatagcccccagagagcactggtgcaagtttcagagtctaaaaattgaagaacctagtctgatgtccaaggacaggaggagaaaaggtgtctcactctggaagggagagaaagcagagagtcctccttcttcttacctgtttgtcccagccccagctgattggatggtgtctgtccacattgagggcagatgtttctctctcagtccactgactcagcttcaacctcctctgaaaacactctcacagacacccagaaacaatgctttaccagccatttaggtatccctcaatccagtcaaattgacacctaaaattaaccttcacaatcactaggaaattttcagctttaaagaacagaattcttgagtaaaagtggtttaaaaataaggaaatttaatattttataaaaagataaagccagacaatcaaagattataaggataattgttcagttttttaacaaagttatcagagattcagttttgctcagccattcttgacctacagagtgttttaggactctgcacaaataactcccaaatttctgcagaagtctcacataacaccttcatacagttctgtctggggctggctgagtggcgtcttttcttgtgcttctctttttccagaaggtaaacctttcccagcggccccatggcatattccccattgcatatcattgaccggaattgaatcctattcttgtggctaaccagtggttgattaaaaataaaaaaaaagaatattcacaaaaagttaggttcttagtaaagaagaaaggggaaaatgattgttgggaaggcattcaatagctgtctttgtaggattatagtatatcattatgtactgctaattatatttggcgtcttatttgaaagttagtgataccttaaaagatatggcacattaaatccagcataaaactcaagatcttatcaccccttctatttactgatgatgaaactgaggcccaggaaattcaattgtcttaagagcatggcactgtgtcatagcaggacttgaattaatttaccagatttattgatttttttgttatgatttttatgatttttttgtttgtttacattcctgcattttgttaatctagtaggaaaacatagtcatcaaggagaaaaaaaggaccaatacaattgaagttatttttggttagatctatgtagcgaaaataatgattatgtccttaaaagtactttcatatgaaattttagttttaaataaacctaacttactttatttaacatttggctttctagcctaaggttgacaaaagtctgattgctttaggtcacttttgtttaaatgtataaggaaaggtaagaatgctcttttatttggtttttcagtataatgtcttattaaatatagtttcccattaaaaacgtattttttaatttgccaaattgctggatttttcaaagtttagcttttgaaataatttttatattgctatttatatcattttatgggttacttactaaaacatggttcaaaagactttgattcatcccagacttgagcccagagtgttctgctattagtactcctcttttccccagtaaacacacctcccgtcaccctagatagccctcttcggatcataccctataggttgattccaaacacagggcccagcagagccacacattcttcacttaaaaatttaccttcttaggcttcaaaagtggatgtgacaattaaactctgcatttttttattttgttcttatcttaaatcatttttctacatctatttactaacgtcgtctttaaagaatgtgagaccacaaaatactgatgagaaactttatggtcctggtatatttccaaggcttcctcaaattatactcacagttagctttctaccctgctaaggcaggccagttttctttctgtcagtcttttgcccaggcaccttcgttggtaagccttacttctaattaacaaaacaagaaagaacaaactcttctattttcccgagaagaataagagagcatgaggaaatgtggactagcagatcaccagtggggttgtcatcattctctaaaaactgctgccaaatttcagaatcaagtgccttagttccacctagcacattgggtctccttggctttcacactatttgcatttctaggccgggctcagatcgtgttcagttgctaacttgaatatgtgccattaagtcatagcagaccttcatttccattttgtggaagtacagagagctccctgtatattgacactgacagagttgtttgtctattaatggtgttttttatgtcttcaaatccctcacaccaaccccaatacttttgtgctgtgaataacttttccccactgcttctatcttcttctgttcctgacattactttttggcttcagcttacgttctggctatgtttattgtcctgataccattgcgctgtaattttggattttatctcaaatatactccagtaatcattactaatgtattttgtttatcagagtaattacaacctctgccttattgtttatctgttctgggaaaagtacttcttcaactgccccctacctgatctgcctgaattgttgctcttattatgttatttcttgttcagaaatcaagtccctcaccctgccgtctaagacctccacaatgtagcctggcactccttagtcttttttctcactaattgtcccatcttttcttatgcgtgacccaaatggtagttctttactgaacaaacactatgcttctctatctcctcatcctatagtaatttgcttttctgaaaaaatacactcttttcctcacatcaaatacatatttgaagttcaagcattctataaggcctatttaatgtgccattggttctatgggcctttgcttgaaaatctcttgccatctttaacttcaggagtaatagtcacattagtcataatttctagagtgtagtgttcttctgagttccgactagcttttacggagtctgaggttactagatcagtgttctacttaggacacatttattttttaacacttaggtcaagctcttctgattcagagcggtattattgctgtatctatgtttcagtgtcattgtcaatcacaaatattttaaatgttttaaagtaattcaataattgatttactatgcttttcctctttttatatttttatctattatcttatttgatggttaatattaggtgtcaacttgactggattgaaggatgccaagatgactggcaacgttttgtttctaggtgtgtctgagggtgtttccaaaggagatggatgcaggagtcagtggcctgagaaaggaagatatgccctcagtgtgggttgttaccatccgattggctgtggcagtggccagaacaaagagacagaagaagggggatattcagtttgcttgtttttttgtttgtttgttcttttttatttttgtcgtgatctctttctccctttggagcaggatgcatttttttctccttctgcccttggacatctgattccaggtttttcagcctttggactctaggacttgcaccagcagcctcctttgggctttcagccttcggcctcagaatggggcctgcactgtagcttccctggtttgggggatttgggacttggcctgagccatgcttctggcttccctgggagcccctattggcttctgtcattctgcagtttgtagccagcctactgtgggacttcgcctttgtgattgttcagccaattcttcctaataaattcccgtttatatatatatatgcgtgtgtgtgtgtgtgtgtgtgtgtgtgtgtgtgtatgtgtgtgtatgtgcatatatacagatatatatcctattggttctctacctatgtagaactctaactaatgcatcctctaatttcgatttatcttctttgaaactaggccacagacatctgtgacccaaatccaatcctgatgctcatgctttgtgtctacatgtatgaaagactccctacatatctccctaagaaggtggtgtcctttgaatgtactctacatgacacggtgctgaataaggtaaggataattttggggtcaaaatgtgtaaggagttacacaattaagagaggttttagatatttctttcccaacccaaaattaacagcaagcgtctgtaggaataattttattaaaagtgaataagccttatcaaatgttgcttcttctaagccaaaggtctagatgagcgaaaggtgcaatttttgcttaagagtaatcaccacttgcaatgaaatgatgactcttttcttactcattttcatttgatttaaaataatattattctgtatacaagttaatttactgctttgataagattcatgtttattccttttttcaggctcttttatgtttgtctctcttaatatatgattgggaaggaggataattttatatttttgatgcaaaactcatccatatgtggtcttcaaaagatatgccacggtgatctttgatctgtaattgtaacttctttgagaaaataactgtagcctccatgatggtgtgagcatcagttgataaggatttagttaaaaattgaagaaaaaaaaaaacaaaacccaggttcttatctcaaaatgtagaggactgaatttagtgaaaagaaagcctcctcttctttgtgtttggtttgtgttagtaaatactgaggttcaatctcttttatttactttatttctttccttttttgtcaaaaaaaaagacataaaactccatagaattcagtatttactatgataatttgctaattgcaatgatatccaagggctttggataaataacaagccttgagctataattatattgaatttttgacttcaaaataacatttcagaagagttaaaagttttttgcttaggcctgcaggagacaggagtgtaaatttgatttaagtataatttattactgttaactattattaccaattctctatttctgtctacatgattgtattccttcatatcacttaattgttattgatgtttttaagtagttaatattaatgctagctaacgtttaaaaataaatttaaattatgatgttaaaaaccaaattaaatcatgtttaaatagaacacgatttattttctcattttattattttgctagaaataatgctcatacctaagattatagataaaattatacaaatatacctttcatttttcacaatgtaagaaaaatttttgaaagaagaaataaataaaatgtatatgcaagataaaacaaattacaacaagctttgattttaacttttatttaagaaaattagtgatttggaaattgctgagaatcttttatgtattttgctcctgtgaatcaacacgatgaatggcagtgcgttaagtcatagaaagtcgttcttaccaccaaccctatcaatgttacagaatatagcaaaatctccagaaatggctacaaaattgagaaagtatttcttttctttttttttttttttttttgagacggagtttcactcttgttgcccaggctggagtgcagtggcacgatctcggctcactgcaacctctgccttcgcaggttcaagcgattctcctgcctcagcctcctgaatagctgggagtacaggtgcctgccaccatgcccagctaattttttgtatttttagtagagacggagtttcatcatgttggccaggctggtcttgaactcctgacctcaggtgatccacccgcctcggccttccaaagtgtaaaaaagtatttctatagctatgggcaaataatagaaacatagactgctagaacaagtacaaaaaagtagtggtcagtgaaaaaacatagagtgcagtgattttccgagacattcaaaaagcagttgaattttgttttccttttgaaacaaaatttacacagaagcagaataaagaatgtcattgcaaaaaaggaattgagactttaaaactttcttttgttcccttaaacagctagctcttcttcctatctactcctcatcacccctacacgaaatcctggagttgggtggtatgactgtctgaccacagatgagtccaataccattttgtcatatgtgtgatatgtatgatatagtgacaatgaatggcttccttatgatctaaacagttcacaacaaatctactataatttgcaacatttccttccaaaacaataggaattagctctctgggacttaaaatcgcttggtctgttaatgaatatttgaaatgcatacatttgtatgaatgtatgtacctacaaaaagattaccacaccacagtggggtaccacactatagtgggggtcttgcccccattattgatgtctttaagtatttgagaacatgaggcctccaaatccttaaagaaactaaagttggaaatgctttatcaacaacacacttgttctattggttaccaaagtttccattgaactaagaaaataattaatctttcaccagattttcatcatattccttatgactcactataaccatacctactgctactttttcactcttcgaatatctgtgactataggtcctgaacttcataatttgcagtgaccttttattcactctaatttgaccaattatccttttcccccatcctcaccattctctgggtcagaacttttggtgataccttggcatcttgttaaataaaaaaaaatattcatgacacctgttaaaacggtaaggcagactttattcaggactattatgatagttatagggaccactgcaaagcagttttgcagtgggggagagagattgagctcaactcgaaataaaacaaggaaaagcaggaatttacagccaaggagcaggatggagatcagtgggtgggaaatgactaagaggaaacatatgggtaaggggggattctggctaaaccaatataagatttttgctaaaggaaggccagggtgatcatacattacctgagcaatggcaggagatgaggaatttggttagatatcaagggtgattagatactgaaggtgtggaattctggttaaactgatttagcaggattcttgctaaaattgggctcttgaggacatgcccaaaggtggggcctagttaaaaaaagagttcagacaagccttactggagtgtggttgagaagaaaatctttgtcagtcttcctaaagattgttttttgaatctccattatattttacataaacactttgtgtactcacgtttttcaagaagtactcttttgtaataaagcaactcattttctaatgctccccatgtctctggatcaggaggaaggagacagccaacccttcgttgaactaccacatctagactgggccaccattatattcagcctgaaactgtttttaaatctatactccttataataccttctacactgagcagccagagtatcctttttgtaaattggatatataagttccctttttaaaattccccagtggttttcctttgcaataaaaataaaatccaagctgcaaatgctgatcttcaaatcactggtgataagatgcttttgcatttgtaattccctttgttgaaagttccttctctttgcccacttcagctaaactgtatgtatgtgtgtgtgtgtgtgtgtgtgtgtgtgtgtgtgtgtagttgttattttaaaatacaaattctggctttgtccagttggtgttcattataaataagtatatttatgactaaaatctattgctatctttgataaaaataagaaatgatatagttgcatagtttttaattttataatcttacttatatcctcttctacttctacatagattctactgaaaaattccagctcgcgaaacttagtgtataatgctagaattgttggaagagatgctgctgacttctccctttcccaaaaagggaatgttgtgacaatttctccaaggtaagtattttttttaattttacattatcagacatatcaaccccaaatatttaatgttataattataaaatgtgactttgattttaatattgatagatatttaatgaaacgattgtcactcacagtcagacaaatattcgtatgtttctacaattcctcaccaaagttgttgaaacaattctaacaacataaaacagctgttttatatgtgcatttaattttaatttgttttttatgcatacgggtcatagaaacaagactataagttggtttgttgtgtactgccattctgtttcctgcaggaaactgaaaccagtgcattctaaaagtatgtatgtatataatttaaagatatatatattttatttatttatttatttatttatttattttatttttttttgagactgggtttccctctgtcgcccaggctggagtgcagtggcacgatcttggctaactgcaacctctgcctcctgggttcaagcaattctcctgcctcagcctcccaagtagctgggattacgggcgcctgccaccacgcctggctaatttttgtatttttagtagaggcagggtttcaccacgttggccaggctggtctcgaactcctgacctcatgtgattcactcacctcagcctcccaaagtgctgggattacaggcatgagccactgtgcccggcctatatatattttatatatagtttttgctgattataaaggcagcatgtactaattataggaaatttagagactatgaaagtatgaagaaccagaaaataaaaggttcataatcctacctcaaagaactccccatgttgccatttttctctgtgccctcatagtcattgtgtatgtgtgtgtaaatgatggatagacagatagatgatatatatacatgtaaatatactcccaaattttgataatgttatatgtgtcatttttatctaattgtgttctcatagttatttaatgtttctactactatcccactcacaaaaataaagtataattgaaacctccagagaatagttttgggaaattaaatctgagcataatgtgagtcttcccagatcaacaaatcatgttggatatgccaacacatgctaatgacataaatactcttgtttattaaataatacaaagatgatatgagaacagctgtgtcagtaccatagcagttgacaaatttgataactactaatgaactttaactagtcttgaattttagtcattgcctttgcattcaattatttttctccaatgaaatgtgatagataactactaaagttactttgcttgattatctctttggattttaactatacattaaattgagtaacttttcaagctgtagtctttatttctgtactagtatatcaaacacagaaataataataaaaaagggccattttaaattgtacctaaaatatcctgtaacccattttcaacagtgcccttgtttcgtgtcattagcctatgttagctttcttcagttattactccatgctaaaggggcatataaaagatcttaattcaacctaaagtaaacctgaggaaaaaatctatacttgcctgcttctttattataaataaaatattagaataaaattccttgtataataaaaagaacctacccattttccaagatcataataaaatagttaaatttctaatatgtctattaaaaaacataatgataataacacaagttcatttggacattgtcacataaccatttattttgttgtcaaagattttaaaacttgagatctatactccactcttccaatagggtgatacaagtgaaaaggatgaagtttctcctgcattttttccactcataaacctgatagcctattccagtatttcaaagctttatgtggaaattcttcctaataaccacaataaacctctgataatttagtttaagattacttttcctgttaaggaagttcatatttgttatttttattataaatgtgcacggtagaaaatttgagttatagaaaaataaacaggataacaaaaatcacctagaattacatcaaacacagtttgttagttcgtttctttccagtcttttcataggcacacataggtttattataacatatgcatacttatgtatttacataatacaggcattatatgtaaatattaacatacttaatatttattcaacatttgctatataaaaatatctatatcatatgaactttgtttcatatgtcaatatctatatagtatgcacttcatatttaatcttcctaataccctattagtgttctcatattatagaagaagatattggacacagagacattaaattacccaatgttccctgctattaaatgccaaagtagagattcaagaccagtgaatacaaattcagagctggcacttttattaaactgacacttgcacatatcttgtgcatgtgtatgtgtgtgtgtgtctgtctgtgtgtctgtgtcacattcaacaaagccctttgcattcaatataatgttactttgactatttctaagcaatcctgaagatccatgatataattgtgtcttagtctgtttgggctgctataacaaaacaccaaaaactaggcagcttacaaacaacagaaatgtatttttcacagttctggaggctgagaagctcaagatcaaagcacccacagattgatttagtgtcttgtgaaggcttgctttctagttcatagatggtactttctttctgtgtcttcacgtggtggtaggatcaaggcaactctatggggcttcttttctaagtgtaataatcctattaatgagagctctgctctcatgatctaatcactccccaaagtccccaactcctaataccatcacaatggtgattaggttttcttctctctttttttttagctttattgaggtaaattggtaaataaaaattatatatattcaaggtatagagtatgatgttttggtatacatatacattgtcaaatgattacagcaatcaaggtattgacatattcattacctcaaaaggttgccttttgtatatgtcttatgagaatacttaaaatatactttctttacacctgtcaagtgtaaatgacattatagtcactttgatataaactaggtatccagaacttactcaagttatatcttcatgttcgtaccctttgattagtatctcctcattttctccaccacctgacccaacagtggctccttccttgatggggtacaggacccagcagcatttccctttccaagggattcacaacaggaatgcctattggttatgacaggagtgaaagctgctggcatactctgtagagcagtttactggggacctaagtagcacccactgtgtggctgataatgataagccctgcccttccttgttcctagccacctctagacagctcaagtatgcctgtctctctaatgatctttctgtgtggttttcgtcaggttattgctccattgtgttacttcagggtcttaattggaaccttgagccctctctaagctattttctttcatagatagctgtttaattattgtttttatgtggagagaatgaagattagtatctcctactctgctgttctgatgatgtcactcctcttgtaattaggtttaaacatgtgaacttggtgggggggacacaaacatttagaccttagctttctaccctgtagccccagaatttatgtcttcttgcctgaagaatatattcattccatcccaatagccccccaaaatcttagctcacttcaacgtcaactcaaaagtctgaagtcttaattctcacctatcatataagtcttgtatttagggtttgcctagaaaaataaaagtataagtctgatatgggtgagattcaaggtatgattcttcctaaggcaaattactttccagctgtgattctgtgaaatcaaataagttatattcttccaaaatacaatgatggaataggcgtagggtagacacttctaccctattccaaatgggggaaataggaaagaagaaagtgataacaggtcctaagtgtgtccaaaactaaacaggacaaataacattaaatcttaaggcaccagaataatcttctttgacttgaaactctgttctccaggcccactggtggtcctgcccccgatggctttgaggcagcccagtgcctgccacagctctgtgtctgagaacatgtcagttctctgcagtagcctcaccgctgtggtcattctatgcctgggtcttgtggttgtggttaccctgagctggaatcttgctccaatgtctctactggtgtgaggtcttcagggaggcctgcctccagagctctactgggcattgctttagtgggaactctgcagtggcccttccccatggcaattctctaactgaaccccaagactctccagggtaccctttgaaatataggtgaaggcatgcactttctgtgctttctgcaccagtggaaatggtactacatggatgcctcccaaatttattgtctgtgcccatcagaggggcagctaccacattccaagccacacctgggtctgctgaagcagcacctggggcagccaaggagcatgatactggaatgtggacagtagagccttgaggcattggtgggcagcaaacaccagggtctcacagctgttcatactcccttctccttaaaattattctgtctctcaggccctggcattctgggcctatgatgggagaggcagcaaggatgatctctgaaatgttttggggtaattctccatagttttaatgaatatcatctggttttcatggagattcctgatccatattaatctccttatcaaacagttccttgcccacacccttgttctcccctaaacatgtttgttctctcattcttttcaatatggataagctaagaattttccaaacttttaagttctgcttcccttttggttaaaaattctgtttttaaatcatttctttcttcttccattttactatatgcattcaatagaagccaatccacacctttaacactttcttggaaaattctttagtcagacattctatttaatcactcacaagttctaccttccaggaaacaccaggacacaaacaccatttagccaagttctttgtcactttttaacacgggttttcttcctctgttgtctagtaacttgctccttatttctgtctgagacctcatcaggatggcctttactgtccatacttctaccagtattcttttcacgaacttttaggtaatttctaagaatgttaaacctttctctacagctttattcttttgagccttcaccagaatcacccttttaggtaatttctgagaatgttcaagctttctctacagctttattcttttgagccttttccagaatcacccttttaggtaatttctaagaatgttcaagctttctctacagctttattcttttgaggctttaccagaatcacccttttaggtaatttctaagaatgttcaagctttctctacagctgtgttattttgagcctgcaccataatcaccctttatggcctttatatagtaatgttggcttttttttttttcagcatgcacctcaattcttccagcccctacctattacccagttccaaagccactttgacattttaggtatttgttacagcagcacccccacccacttctcaatactaatttgccatcttagtccattcaggctgctataacaataaaccataaaataggtagcttacagacaacagaaatttatttctcacagttctagagtctgggaagtccaagggatccaggtgcttgcagattcagtgtctggcaagggtctgagttctggttcatatatgtatgaatttatatatatataaattgctaagagcacttgttctctgactatttctatctcatgacatcctgttcttaaattgaggtaccatatcttcataattgtctctgacttttatgttctcatctatccttgaattttctctaaagtcagttgctttatttaccttgatcttagtgttccctgttaaaagattcgctcaaatgcctcctgacacatggttattcattcatatgtaataacatggcaatagaaaagtaaatttctgtactgtatgtgcacaggtatgtcaattggtaggcttcacattagggtgaaaaaccattctgcttttatgcccaattgtctgacattttataatggcattgaagggagtagggttgtctgaaccccatcttgccctttatgtggtggtggtttcctctaaccagctgtgttttgaaaatctctttattataattttcatgagatttttcttaggaaaagaaatgatgaatctgggtttcagatgccattgtggtttagaactcctcttatatcatttaacaattaaatgttatgtttcagtcttgacatgtaaaggctctatgatccagcctcagtttccttatttgaaaaatgtggataaggctatgtacccacagtgctgtcagtaataaatatgattatgtaggcaaaacaccttgtaccataatggaacttataggaagcaattaataaggatgaccgcctcaatttggagtactggtgactcacaaattaaaatatatcaacactactcgcaaatgcttacaatctatcccaatgccaggcaagcaaatacataccgaagatataaatcaataattattttatttattatgtgtgtatagaactagatgaaaactgaaaaagaagtgcctgcctactcttgaggaaaccaaggaagggttcccagaagaagtaatgcttaattctgaacacatataaaaaacaactactcacttatctaaatgcattttattttgtaggcttgaaataaaattattttaggtagctgttattttaggtggctctctttagttaggctaaataatttcataggatttggtttttacaaatacgactcagaaaacattttgttttcctaaacaaaaaaatgagtaattttatcattataagatattatataattatatatttatgtgtgccacattctttgttagatactgtctagatcacagttaataatgtctctttctgccagctatggatttaaattctcagacatattacttatatagaaaatgttaaacagctacaccagcatataaacaaacatatttacttctgcatctaactttatgactacatttagctataaccatagagtgactgtcataaaagtgaaagtataaatttagcaaaccattctttttttctcattattttcattgagccatatgtgcactgacattgatgtgttgtatatttattctccatctattccaaaggctaaattgaagtagcttacaatgtatatataatatcaaggaggttttttttaaaaaaaaatcagggaaaggcaattggagcaaaaaaaataaaaggtaaaataattaaaatgaaacctatagttatgatagaaatgcctggagacttaggaaacttactctaagtagactacacatttgattctgaagtttctaacaaattcagaaaagaatgctggtcatttacatgcttcaatataactacaaaatttaaaaaataattacctatacttaagagaaggctgttcatggaaccagctatttatctcataaaaaggatactctattttgaaatgtattccataagacttaagtataggttcataaaatctttcattaaattcatgttctttagatggtggtcattcttgaatgcttctcttttcatcagcttccatcgagatccaatccgttaccagatcctatcgattttaccaatcgtgtcataaaccttgtttctttttcccttcttcacctgttccaccccgatttaatgtaacatcatctttatactagactgccacaatagactcctaaaaatcttgtctgaaatctatcctctatattagaatgacagctaatttttaacagaaatttaaacctttaacagaaatttaaaaaggtgcttaaaatatttcagcttcccatcaacatttggatatagattgaatatgcttaacatggtccaaagtacactttcacttttgtgacagtcactatgatttcgcagcttgctcttggctatattttgcatcattacccctattgcttgctaagatttagcattactggcctttgattagttattcaaacacattttaattccccataccagaggccttggatgccttctttcatcccctgttcaatctagttaactcattctgatacttcacattccacctaatatatcactttctctgacctttcagactatgtcacactccccattgtatgctctcacagcacatatataatttgtaattttcacatttattttgtgttggtagaatgttggccatgtcctaccgtttgtactatccaggagagcaggaatagtggtgttttttttttctaattactgtatctcagaaacctaaaagagtgcctggaacactataaattatctaaaaatatcaattgcatgaaagaattaatggataaatgatcttatatagtgatgtactttagaataactggaaatagtctaaatcactcactgttatcttaataaataatttgagcctatatacctggaaaaagacctcaaggtcaaatgttctttgttctcagttaaattcatgcccatgagttttcataagagtccttttgcacacaattgaaattgttgaggacacatatctaaattaaaatcacccccactcctgtaagttgtgagctgtaattttccctacaaaactattttgagaacatttctattgcttttgaaaacccctcatttatctcactcctcgtttcttcctagtctcacccattcaacagcaactgcacaaaagttctggcgcaattaggtcaaggtttgacaccaagggaatctattcccatctccattcttaaatatgtgcattctaagcgaagacaataggtagtagttggtacaaaagaataactgttatgggatgtataatggtaaccatgctaaaaaccagaggaaaagcaaagataaaatttccccaagttttatcacctacagcggtatcaaggcaaggcaagattgaaagattgatccagtaacaaaatcgagagtccattgtttaatttagagtgtataacttatttaaacagtgaaagcatgagtaatcaaaggtactagattcacatgtcccttgtacagggcaatatcaaaataaaaggggtcagatcactgcctcatggatggtaagacaccctcttgctgaggagctaaatttgtgctgtcattaagcttcatggcctgtaactctatcctaaaaggagtaaggaagcaagcctcatacctcatcacaatccaggaagcaatgataaactgtctggtgacagtctctcaggggagattagggaggcaagtgagaaatgttcctagagcagcaattcgtgagcctccatgctcttatattgcaggaggatcatggggtttctgccaagacttttgtcagctgcatttttacagtgcatatgtggcctatgtggactcatgcaaggttgctggggtaccatggtgcggtcattttcctacagactggtgaatggaatctccaaatccatagcctcttcaccattatactatgtcttagactgccaaattgaagattaaggaggatgaaaatattttccttattcctttttgtaattaattaaatgttattattatctgccattatttggttatgagttttgaatgttattttcactaatgattttatgcattttttgaatttttactttcttaatgtttccacatgttaccagagaccagtgacatgacaaagtatttgcctaaacagtagcacagaatgtcctatgaatttccctcaaaacaattcatacatggtttcctgtggcttgctgttagaaaatcctttatttgagagattatatatttgaaagttaacttcagattttacaaaatatattacgatagcttaaccgatgacaataactagattgtaggcttcttgataactgcagctgaagtgagtaccttgcagggggatgtaggcattagacacatggtctacattaaacaaatgcttgtaagttgtcttttttgttaaaacgttttctcttttatcttttactaaatagaaatgaaattaatgtcactctgaaattcaccagtcgctttattcgtcctgctgaagcttcactactattaatttcaaaacccaagaatgcagtaagaggaattacaatgacttttgctcttaaaggcaaagtcctcgattttaaagccattgtaagtaaattttacctacgatgtctttgcttctcttatcagaccatgaagtatcaaaagcatgttattgttatacattttatctctaggcagctgtttcttgagtcatccctgtgccatggatacttgtgatttaagttaaagcagttctgggcctgtgtctgtgtttttgctggactaagggttgatagtttatgcagtaaaaaaggactttcctgttctctggcaggaactttcatcagtttatcttgtgtgtcctgtagatcaaatctattataaagataagactaatgctggcatttattgagaggtgacgatgttccagacagagttctaagtatttctttttcaaagggtggggaagagagatttttaaatctttataaaatggttgtgacattattgtgattgactttttgtagccattatctcttctaaatattaatttctacaatggatgtatggtacagaataagtaaattcattagattgccagatttccaaatggattataaagaaatttaggtgtgcagggcaagagtggtaagcagagaaaatgactgtaggatggttgagtgatggcctgttgttgaggaaggcactgagatgctcatatggacagactgtcttttgagacaatgatgctcagaacaggaagtgggcatttgtcacttcctatgtgtaatcttatttcctcctgaataatgaacatgtacttttcccaaccctctcacacaaattatctgaaacaagacattgttttgtcacatgtggctaagagatatggctgggcttagcctgtcattggtggttctgggggtagacatgcaactgtttacttccccatcttcccctatatggtcttaagtcactggaaagcagattagataataaaaacaaaataaaataaaacagtaaaataatctttctgaaattatagaatacctagaaagtttttctccatggaatttcttttgatagtgggaagtactgtcagtgtaatattaaatggacggtttatagatttttaagattatattttataattcagaaagttcattttttgttattatcatgtggtaagactttatttttttactttaggacattataaaatgcgaaagcccatgttatcaatttcaggaagtcactgtaaatgtgaaaaaccccttccatacggctggggacttcaggtaagttattgttttggtgtaaattcattgcaattagctctatctccactctgaagagacatatgtgattttctttctttctttttttttttttttttttgagacagtctcgctctgtggtcaggctggagtacagtagcaccatcttggctcactgcagcctccaccttccaggtcaagcgattctcctgcctcagcctcccaagtagctgggactacaggggtgccccaccacacccagctaatttttgtatttttagtagagatggggtttcaccatgttggccaggatgatctcgatctcttgacctcgtgagccacccgccttggtctcccaaagttctgggattacaggcatgaaccaccgcgcctggccgtaattttcttcatctcttcaacatgaaccatttcgagcagaaattatatgtgttcaaattcctataaacttctaagcaccatcagaaaaaattaaacagctaattaaagtaaatcagttttcctgaaatgatcatactaaatttatgagttttgtctgcaagttgtttgttgaaattcagtgttctttcaattattaaaaaatatgtataattaatagattttttacttctaattttattctgtacatgtccaaaattgaaatatcaatttaagcagaaaaaaacatttttacttagagcatcataactaatttatactgcacaatcaatgtgcatgtgttcatcttaagatttaataataataacaaaaatacatatttgtgataaaaagacaataaaattttcaagtattatttaatgacacaatagaaaagtaacttcctggaaatgtacaccacgttgaggaagacgacggaaggtgataccttctgtgctgattaaactaggaactctgttttttccagcttcagctatcagattcttatgatacttatattgaaactggaagttataatatgcttattattttactatttgataatttccagttcttttaatcactgtatgtaaaggattttggtaatttcttatctttctctaataattttggtcattttgttttaaaaaatattgttttgaaacagtgattggtaaatacctggttcctaggtgcatgtaagagagaatatgatttagtgcaattttattaaagtgatacattggagtataagaaacacaaaattttagaatatatggtgtgttaacacagtattaaagtatgcccttaagtagaccaaatgactgactgcagttcctcagagaaaaacaggatcaaacaaatttagtcttacattctagtgttaaagcagaaagaaaatctggatatgccagaaattgggagaatattacagatacatatttctcaaataacagtaatattttaacatgtctttatgttgtatctcagatttaattaaaatggttaatgcttataaggggtttgtggtttgataggaagcaaaattgttaatcaagtgattttaactatatccttcctttgaatatgtccctcaaacttaggcaatggacaaataaactcaaaaatataaaaccaatttcaaaatgtgcaaaaccaatattgtgtaagagtcatatattatgtttgaaattttaacataataaaatagattgaataagaaggaatttgaccaattaattaatatagaaactatttttaagttataaccaatataacaagagacccagtttttaatattacacttaataaatgattgacttggttattattagcagtctcatattaaacatactttaaaataaaataaaaatatccccatatattccccaatattgtatgcataagtgacaagaattgatcatgttttatcaaaatttcacattactttgaacaaataaggcaatccagtctatatttaacagagataggattagctgaccaggttgttaattcccatgccttgctcccagactggtgattctcaaattcttcttttgcagaacaccactatttcatgctctataatgctgttttttaattttatatttgataagatttagtttgctagtacagtattttattgaggattttgcctgtacaattataatatttaatagtgtaattgcctttttcagtgatttgtctgtttttgtatgattaatattaaccttatagaattatttctgaaatgttaccttctattctattgtttggaatactttgtgaaggattggtattagttatttgaatgtttgatataattcacaggtgaagccatctggttctgagctttgctttgtggaagtttatataattactaattccatctctttgttatgagcctgttcagattttctgtttcttctcaaatcggttttgctagtttattttattccagaaatttctgcatttcttctaagttatctaatttgttggcacagaggctttcagagtattcccttataatccttttttaatttctgaaaggcaaatagtgatgttcctccttctatcccttattttagtaatttaattcgtttatattcttgatcagtctaggtaataatttgtcatttcactgatcttttaaaaaaattccttctgctttccttgatgttctctattgttttactatcctctattttatttctgtgctaacttttttggatattaattatttccttctatttgctttgtgtttagatgtctcttttttttctcacttcttaaggtgaaaatttagattattattatgagattttttttcatataggcatttttatctacatatttctctctaaggactgcttgagcttcatctcatatgttttggaatgtgttatttttatcttcattaatcttaaattattattattacttttgagacagagttatgttcttgcccccaggctgaagtgcaatggcgtgatctcggctcactgcaacgtctgcctcccggtttcaagtgattctcttgcctcagcctcctgagtagctgggattacaggcgcctaccaccacacccagcaaatttttgtatttgtagtagagatgaggtgtcaccatattggccaggctggtctcgaactcttgacctcaggtgatccacccaccttggcctcccaaagtgctggaattacaggcatgagccaccatgcccagtaatcttaaattatttttaatttcttttttatttcttgctaacccaccagttatttcggagtatgttgtttaatttccccatgtttgttaattttcaacttttctgtcactaattttattccattcaagttagagagcatactttgtattatttaaatcattttaaatttatgaagatttgttttatggcgtatcataaggtccatactgcagaatgctcatgagaagaatctatattttgctgttgttgagtaaagtgttctataggtacctcttaattttagttggtttataatattgtataagacatattttcttgtagattttctgcctaaatttttctattcataattaaaagggcagtatttaactatctaactattaatgttgatctgttcatttctcccttcacttatgtcagttttactttctgtcttttggtgctctaaaattcagtgaatatatatttatagtaattttatcttcctgattgttcatataaaatgtctctatctatagttacaatttttgtttcaaattctatcatgtcttgtattagtatagctacttcaacattcttgtggttgtgtgtatgatatataatttttcatccttttactttcaatctattttttatctttcaatctaaagtatgtctcctttatatagcatatggtcagatttgggggttttgttttgttttaatagcttcattaagataacatttatatgaaagaactgcaggtatttactgtgtacattttgatgagtttagacatgtgcaaacacccatgatatcattaccataatcaaaggaacagaaatttccaacacctcccaaagttctcttgtgtccctttggttttctggtttgtttgtttgtttgttttttggtaaaaacacttagcatgatatctaccctcttacattttgaagtgcatgatattgttaactattggcactatattttatagtggatgtctataacttactcatctaaaagtataattgaaactttatacccattgaacaacaactctccatttccgtaaacccacagctactgtcagtcatgatggccttcttcgcttctatgagtttgactactgtaaacacttcatatcaatggaattatgcttatttataattctgtgactgacttatttcacttagcataatgtcctccaggttcatccacgttgttacagatgcaagacttcctctttttttagtcagaataattttctattgtatgtgtatattactcactgctttagattgcattatttaatcaattcacaaatttgttattattgacacagttgattttacttttgccaatttccatttagtttgctatattgtatgtctttttgtttgtttctctattagtccatgacttctttttttaataatagtgaatatttttcaatgcaggattttaatttttaaaggctttttcaaaatatttttgaatttgttttcttaatgattgcaccagagtttaccatagacatttttacttatcataatcaacttcagatatatactaacttaattccagtaagattcacaacgtgttactcttatatagctctattccctttccattcttttcctggtggtattgtcatacatattacatcaatattacatacccaacaatatattgctataattattactttatataatttgtatgactttgagaaagctgggagaaagtgtattggtttactagggtttccataacaaaacaccacagatcagatggaataaactacagaaatttatgttcttagagttctggcagttagaagtccaagattaaaacaccgtcattttttctttattctgaaacttttctccttggcctacagatagttgtctcctcattttgtcttttttctgtgaatgtatatccctgatatctctttgtgttttcaaatttccttcttcttataaggacataattcagattggattaggacccaccctgagggccttaacttaattatctacttaaaggctctttctccaaatacagtcacatttggagataccggggttagggcttcaacatatgaagttggaggggacaaacttcagcccataacaaacagcaagtatatatctatagttttttatattttaaccttcctacttattatttccatttctcttcatttgttcgcatggattgttgctaccatatagaataatttctgtgacctgatccagctttcatctcacccactttattttttgaacattttttctcttctttttcctctctcctttttttattcaggtaatttcattgcccacattttgttcttaatggtgtgcctaccatacatacgtcagattctatttacttttcttcatttttttctctgttcttcagaatgtgtaatctctaccaatcttcaagtttgttagttctttcttcccccaattcaaatctactattaagcccttgagtgaatttttatctctcttattgtagcttccatctccaaaatttccatttgtttcttttttttataatttcaatttctttgttgatattctctatttgatgccacattgtcatcatgctttcctttacttctttaattatagtttcctttatttctttgaagatatttataatggctattttaaatttgatttctgttcaatctgatacctgggttactctaacaggcagtttctactgtctgttacttttcttctttttgtgtgtgtgtgtttcatgtttatgaaatacagtagacattgtagacaatatattatgccaattctagatatgtgttctatctgccccaggcttgctaatgttctttgcacttctaatttttttactgactggctgggttattttggtgatgtctatctccccctgctcaaacctacacacacatagtgttaaggctctgatgttgcttgtcaaaggccaccgtctttggcatgcccacaattaccctgggattacagtggttttggcagggctccctgtgtgttttcctgaccacacccttctgttaaattccctgcgtggggtgggggtggataagttactcttcaagctaattcagtcaacttcagacctctttgaaaaaacagttctataaatcattgtttaagattttttctgactccaggaggacttctagcagtctccttcaccagttctctccagcaaactaacaggcctgtagtttagcttgcatctttgttgatctaccaatctccatccaattgtatttcaccataactggcactatttctgagaaattcaactttcgcttgaatttctccacacattattgaaaatgaaatcagtactttgggaagcgattaggagctattcattttaaagcccgcttctctcctcagggaaaatatctgatccatgactctagagctaggggtggggacaatggtgcactttttcttcagcaaaccctccattttaggagctgagtgctaggtgggcaagggggcaaaatagcctcaggattttttgacttgcttctcccagtgtggaactaccaccttacgaactgggcaaaggcagttggggtttcagtattttcagcagtgccacactcgtgagagcttcagtccgtgagtgggtgctgggtagaagaaaagagcttctcacggtctctcaactgcgcttgcccagaacctagccttagcaacatgtactgaggtgaagatgttggtatcccatgcctcccagaaacataggcctccaaatgggagccaggggaaggaagagccctatgttcttggcaaaaacagtctgaaactaagtttcttttttgttgagcttgaaaggaagaaggagatagagttcttggttcaaatatcacagactactggttttcttattatattttagtttattttgtttaaagatttttcttaatttcctgtatgcccttagaacaatctccagagaatttcaaagtgtttttttgggtttccttgtttgtttgttttgtttttactcatttgcttggggtgagagtccaaggatctctcatggtgtcaggcttaatgttggtcttaaatattattttatctgttattaagatagccactccagctccttttttattactattttcatggtattcctttttaaatctttttaatcccaattggtttgtgtttttgaacccaaagtttgtctcttttcttttacccatcttgtcaatctttcctgtttgattgaagtgtttagtctgttaaatttaagtcaatctgtaatctagtagattttatatgtcacttttatatttcctttatatatgactaatgtctttgttcatctatttctctgttactgcctgagttttttaatagttattttgtataacattttaattccttttagttccttttacttcatgattttctaattgttttcttaatagttaccctgaggattacaatcagcgtctaatgtaaaacaatctaactcagatgaataccaactgaatttcaatataactcagaaactttgtatctgcaatgtatctctttttcctagcctttccctagtgttattataccaatttcatcttaatgcattataagcccataaagcagttttatatttattgtcctactcctgcttattttacgcttatttttttttgtctttttctttttcttcccttttgtggagaacagggtctcgctatattgcccaggcaggtctcgaactcctgggctcaagctatcctgccgcctctgcctccctgagagctgggattacaggcatgagccaccgcacccagccctcctgcttattttaaatgagaaaggcaaatataaagagttgcaaagaaaatgaaaatttacagcttgtttttaaatatatatttaccagtgtagtcacctttcttcatgccttttattacctcttgtggttttgattaatttcttgtgtccttttatctcagctgaaatatttcttgtgccacagttctgctagtaatgaattgttttagttattctttactttagaatatcttttctccttcatttttgaaggacagtttttttgttttcttctctttttttaaaaatttttttgaaggagagttttttctgtatacattgtacttcatcaactcgatttcttgcagtgtactgaatacataatcctattgtcttctatcttccagcatttcagatggaaagtcagctgttaatcatattaaggagccactgtagacactgagtcaattttgtattgctacttacaagattgtctatatcttagcctttccactgtttgattattattatctatatgtggattgccttaagtttatcctacaaagtgttctttgtgcttcttggatggggaaattaatgtttttcatcaaattttagaagtattcattctttatttttaaaatgttttttttttttacctctttctctctcttgtcttttggaaattctcattagacttatgttggtgtcccacaggcatctggagctctgttagtttttctttattatttttctccctgttcctcaaaagaaataatatcaattgacgtatttttaaatgcactgcttctttttttcttttgccataccaaacctgctgttgagcccctctagtaatttttagtttcagggatgttatttttcaattctagaatttctaattggttcttttgtatcatttctatctatttaattgatgttgtctatttggtgacacatcattgtatctcatatgcagcattaaagatctttgacatattttggggatcaggcaagttagtttaatccaacacatgggcatcttttcccccatatgttcctctcatgtttcatcaggcttttgtttgacccaactgctgcagcaatctcacacataattgctgtggattgatttcagcaaacatcctggtgtggtaggtgttctcccttaagtcaggtcaaataaagacaaatgcattacaaattaaggcttgaagttttccaggaagcagcaagacaggatagataaaaacagtgctcaggaataagatttttttgaagaagtccaatctcagtctttcccttcttcaggttgtaagctacagagttttacaacttccgtggatgcaaggctgctgcagagctgtcaaaaggaggatgggagttacaacacacaagttccaatgcaacaaactccactgatcttaccaaagtttggagtttttcttggataaacactactcctgagattgttgcatgcctctctgtatttaccagtgttctgaaaaagtaaattttcacaacccttacctgtggtttttgttgcttatatagagggataaatgtatggtggttctttttatttatttatttattcattattattatactttaagttttagggtacatgtgcacaatgtgcaggttagttacatatgatacatgtgccatgctggtgcgctgcacccactacctcgtcatctagcattaggtatatctcccaatgctatccctccctcctcccccgaccccacaacagtccccagagtgtgatgttccccttcctgtgtccatgtgttctcattgtcaattcccacatatgagcgagaatatgcagtgtttggttttttgttcttgtgatagtttaccgagaatgatgatttccaatttcatccatgtccctacaaaggacatgaacacatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaacgggatggctgggtcaaatggtatttctagttctagatccctgaggaatcgccacactgacttccacaatggttgaactagtttacagtcccaccaacagtgtaaaagtgttcctatttctccacatcctctccggcacctgttgtttcctgactttttaatgattgccattctacctggtgtgaaatggtatctcattgtggttttgatttgcatttctctgatggccagtgatggtgagcattttttcatgtgttttttggctgcataaatgtcttcttttgagaagtgtccgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctcttgagtttaattagatcccatttgtcaattttggcttctgttgccattgcttttggtgttttagacatgaagtccttgcccatgcttgtgtcctgaatggtaatgcctaggttttcttctagggttgttatggttttaggtctaacgtttaagtctttaatccatcttgaattaatttttgtataaggtgtaaggaagggatccagtttcagctttctacatatggctagccagttttcccagcaccatttattaaataaggaatcctttccccattgcttgtttttctcaggtttgtcaaagatcagatagctgtagatatgtggcgttatttctgagggctctgttctgttccattgatctatatctctgttttggtaccagtaccatactgttttggttactgtagccttgtaatatagtttgaagtcaggtagtgtgatgcctccagctttgttcttttggctcaggattgacttggcgatgcgggctattttttggttccttatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagaagtggtttgtagttctccttgaagaggtccttcacatcccttgtaagttgaattcctaggtattttattctctttgaagcaattgtgaatgggagttcactcatgatttggctctctgtttgtctgtcgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctgttttcctaattgaataccctttatttccttctcctgcctgactgccctggccagaacttccaacactatgttgaataggagaggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaggggttgttgaattttgtcaaaggccttttctgcatctattgagataatcatgtggtttttgtctttggttctgtttatatgctggattacatttattgatttgcatatgttgaaccagccttgcatcccagggatgaagcccacttgatcatggtggataagctttttgatgtgctgctggattcggtttgccagtattttattgaggaattttgcagcaatattcatcaaggatattggtctaaaattctcttttttggttgtgtctctgcccggctttggtatcaggatgatgctggcctcataaaatgagttagggaggattccctctttttctgttcattggaatagtttcagaaggaatggtaccagttcctccttgtacctctggtagaattcggctgtgaatccatctggtcctggactcttttttgttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcagtggtgatattccctttatcattttttattgtgtctatttgattcttctctgtttttttctttattagtcttgctagcagtctatcaattttgttgatcctttcaaaaaaccagctcctggattcgttaattttttgaagggtttcttttgtctctatttccttcagttctgctctgattttagttatttcttgccttctgctagcttttggatgtgtttgctcttgcttttctagttcttttaattgtgatgttagggtatcaattttagatctttcctgctttctcttgtgggcatttagtgctataaatttccctctacacactgctttgaatgtgtcccagaggttctggtatgttgtgtctttgttctcgtcggtttcaaagaacatctttatttctgccttcattttgttatgtactcagtagtcattcaggagcaggttgttcagtttccatgtagttgagcggttttgagtgagattcttaatcctgagttctagtttgattgcactgtggtctgggagacagtttgttataatttctattcttttacatttgctgaggagagctttacttccaagtatgtcgtcaattttggaataggtgttgggtggtgctgaaaaaaatgtatattctgttgatttagggtggagagttctgtagatgtctattaggtccacttggtgcagagctgagctcaattcctaggtatccttgttgactttctgtctcattgatctgtttaatgttcacactggggtgttaaagtctcccattattaatgtgtgggagtctaattctctttgtaggtcactcaggacttgctttatgaatctgggtgcacctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcatgtgagatgggtttcctgaatacagcacactgatgggtcttgactctttatccaatttgccagtctgtgtcttttaattggagcatacagtccatttacatttaaggttaatattgttatgtgtgaatttgatcctgtcattatgatgttagctggttattttgctcgttagttgatgcagtttcttcctagtctcgatggtctttacattttggcatgattttgcagcagctggtaccggttgttcctttccatgttgagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgagggtaacccgacctttctctctggctgcccttaacattttttccttcatttcaactttggtgaatctgacaattatgtgtcttggagttgctcttctcgagcagtatctttgtggcattctctgtatttcctgaatctgaatgttggcctgccttgctagattggggaagttctcctggataatatcctgcagagtgttttccaacttggttccattctccccgtcactttcaggtacaccagtcagacgtagatttggtcttttcacatagtcccatatttcttggaggctttgctcgtttctttttattcttttttctctaaacttcccttctcgcttcatttcattcatttcatcttccatcactgataccctttcttccagttgatcgcatcggctcctgaggcttctgcattcttcacgtagttcttgagccttggttttcagctccatcagctcctttaagcacttctctgtattggttattctagttatacattcttctaaatttttttcaaagctttcaacttctttgcctttggtttgaatgtcctcccatagctcagagcaatttgatcgtctgaagccttcttctctcagctcatcaaggtcattctccgtctctttgttccgttgctgttgaggaactgcgttcctttggaggaggagaggcgctctgctttttagagtttccagtttttctgctctgttttttccccatctttgtggttttatctacttttggtctttgatgatggtgatgtacagattggtttttggtgtggatgtcctttctgtttgttagttttccttctaacagaccggaccctcagctgcaggtctgttggagtacccggccgtgtgaagtgtcagtctgcccctgctggggtggtgcctcccagttaggctgctcggatgtcagcagtcagggacccacttaaggaggcagtctgcccattctcagatctccagctgcttgctgggagaaccactgttttcttcaaagctgtcagacagggacatttaagtctgcagaggttactgctgtctttttgtttgtctgtgccctgcccccagaggtggagcctacagaggcaggcaggcctccttgagctgtggtgggctccacccagttccagcttccaggctgctttgtttacctaagcaagcctgggcaatggcgggcgcccctcccccagcctcgctgccgccttgcagtttgatctcagactgctgtgctagcaatcagcgagactccgtgggcgtaggaccctccgagccaggtgcgggatataatctcctggcgcgcccttttttaagcccatcggaaaagcgcagtattcaggtgggagtgacccgattttccaggtgccgtctgtcacccctttctttgactaggaaagggaactccctgaccccttgtgcttcccgagtgaggcaatgcctcaccctgcttcggctcgtgcatggtgtgcgcacccactgacctgtgcccactgtctggcactccctagtgagatgaaccccgtacctcagatggaaatgcagaaatcacccatcttctgcgtcactcacgctcggagctgtagaccggagctgttcctattcggccatcttggctcctccaactgtatggtggttctaatgctgtaattctctgcctttctttcactggttgtctagttttgtaatttgaaaaatattttatgttttagcttaggctcttgcttctcaaagtgttatccttggatcagtagcaccagcatcacctgggagcttgctagaaagacaaaatttgaggcccacttcaatccaattgagtcagaatctgcatttaataacatctccagaagatttgtttgtacattaatattagaatcacgttgttctaggtcagcaggtttcaaagtttaataaatgggtgaggccaggcttggtggctcatgcctgtaatcccagcactttgggaggccaaggcggagggatcatgaggtcaggagttcaagaccagcctggccaacatggtgaaactcagtctctacaaaaattcaaaaaaattagccgcgcatggtggcatgcacctgtaatcccagctacttgggaggctgaggtggaagaatcacttgaacctggaggctgaggttgcagtgagcggagattgtgccattgcattccagcctgggcgacagagtgagactccgtctaaaaaaataaaaataaaaaaattaaataaatgggcaaactatattaaaagcatcttaagaacttgttttaaataaagatttctggaacccattccagacctgcgtagaattcatataggtagaactttggaaatctgcattttgaacacactttaagtaattattatgcagattgaagtgtgagagctgctgatttagaaactgcagttatcaagtaggattatttttttcttttaacaggtagttcatattgcatttttacagttaatatttctgtatattttaggaaaacgtgctctttgtatttaagcagggatgattcagacacatgtagattgctattttgtctcaaaatggtgtatgtacagtgtataaaaatatgatatttattacgttgggctagtcattttatttgtgtgtcaaattttatgatccttgtgactactttttagccagaacagattatcaccaaaataaatttctccaattagttaccttggatttatagaaatataaataaatgttggaatattcttctgcctcataattttatgaaatttagatgagaatttagaatttagtagctgactttaaatgtaaattactctctggagaggaattcttctttatgtatttgcctaattgtgacttaataataatataggtgaatctggtagtctgaaagatgtttcacaaagttcacagtttacattttactatagttaattttgtctgtttaaaaatttttagtatttaatattcacataattctttataattcttatatgaaagcatcagaaatatcaatttaaaacaatagtacagaatctgatgttggcattagttcagccactgtggaaagcagtttggagatttctcaaagaacttaaaatagagttaccatttgatccagcaatcgtaatagtgggtatatacccaaagataagcaaatcattctaccagaaatacacatgcactcgtatgttcattgcagcactattcacagtaagaaagacatggaatcaacttaggtgcccatcaatggtggattggataaagaaaacgtggtacatatgcaccatggaatactctgcagccataaaaatgaaagagatcatgttctttgcaaaaacatgaaaacagctggaggccatcatcctaagagaattgatgcagaaactaaaaaccaattaccacatgtccttatttataagtgggagccaaacattgggtacacatggacataaagatgggaacaatacacactggcaactactagagggcagagggatggaggggcaaggactgcaatactacctattgggtactatgctcactatctgggtaatgagatcaattataccccaaacctcagcatcatgcaatatacctgtgtaccaaccctgcacatgaactctctgcatctaaaataaaagttgaaagttttaaaaataataaaataaaaaataaaaatttgactaaagaaaaaaatagaataagaaaaataataaattttaggatgtaggaaaatgtgttttagtttatatgtgcagagttgtgtgtgtgtttgtgggtgtgtgtgtgtgtatcaagacaaaaacttttgattaatttattactagcctagtttttctcaaaaagctagcattttgggatctcaataactgttacataataaaaggggtttcttttgataaatcaagtttggatattttattcttaacaatatttgacacaatctgttcacttctgaaggtagaattagccattcgtgacatgaattttcatgacatctttaatgtactgctaaggcatcatttgtatgctattcctaccctatgatgtgagcagcctgaggcaaaaatgtttgtgtttccagaacctcatgtcctacaagtaagaaacaaatgcgtctctataactatttcttgaatatatgagcattgtcatataggaagactttccattgctgtgtgatttcagaagatggcataattattaacatactgattgactagctacccacatctcatgtccactcctgaaagaaacatttttcttttatggaaataggtttagaaattatgaaacgtgtacagctctggtgatgtgtaagaccagtgtgatatttcctgtttgtttctggaatataatttgaccagtcacttatcttctaaatgtccttgctatgagaattcagtgctgccattccatataaaaagatactatgtttcacatatttccattcccgatctttcccttctttctaacatatatcttttgagttgcagaatgaaagcacatggatttttttaaactgtagtttattctgattctaaggatattttgtgaatgataggaaaaaataaaagaagaatgttttgtggttatcggaattttgttgcaatcaattaaaaataattatttcttcatttattccagtgtcattttggtggaatcctcaacatttgtctcttcgccaacgaagttaactgaatccaggcaatacccgaaacatgagtaagtgtctatattttgtactcataagtatctgagaaaaagttttgagaaataagtagtcaaggaaactagttatataattacacaatagtttacatttattcaaaatgtttaatttacctaattcacactcatatccaaatatatatttatatgttactagattcatgtgcataaaaattgaataaatctgaacttgattaaatatagtagattttcattatttgtggtagttatgttctataaaatttctgcacatattatgtttgtgaatactgaaccattattccaagaagaaacacatataatcatacagattacaatagtaaactctaaaaataacctgtcatggaagactctattttctttttttttttacaaaatgaaaacaaagttcagaagtatcagatggctttcctgacactgccccaataaaaggcatcagagaaggtattcaaaccctgtccactaggcctgagtgtcttgcattactctgcactgcccactattgtctctacctcttgtcatctctatacttttataaggattgaaataagaaggccccttgtcaccttgtttgacctcagctgcgaattggtgcaaccggtgatgagaacttttcaccactctgtgcacgtcctttaacaccatgaacgcaccatgagtattgattttggggttgcaaatacattttaggaagtaggtggatttgcaaatatggaattcatggataatgaggattgacaggatttaaatttattctacctactttatgagggctatatttagtttataaagaaatttgctgaataatgaaacaggatttttaaaaaaattgattgttttatgttgctcctctgttttacactatagaatcactatataaagttaagtacaattaaaaacaatgttatcaaggttaaagaaagttaagtagagagaaaataatgtagatgtctattaatgaaatgcatgcctatgttgaccattactactatgtttttagtttatttcacacccttgtttgtctttgtatagtgcttgacagcatcaatatcatccttttagatccaaaaatgtatcaaggggcaagaatttgacaatttagatgacaggaattcccagtgtcattagaaaccgttaaagtgcttgtacagatcttgctaagattaaaatgagtatagtttttattttttcaaaagtgacttgtatttaacttaacacttttgggagattatatgagttgcatctattatgagatgtttgattccttcaatggttattctgtgagaaaagttattaaagaagaaaccatttttgtctcactgaatttattttattgaacgccaatgtcatgcttacctagggcttttgaagtcttctttcacattttgctttagtgaacaataaaatatgaattgatgtattgagctataaggtagcattaaagataccaaaagaataagaggattgcaggtattttatgttaatttctttgtagatgtgaaattcaagttttactgaagtattgctaaaaacacttctgtaaacagttctcctagatttttatcttttcagccccttgattcttcttgattaagtggctgctttgtgattgtagattttgcctgaatggacttcaaataacttcttcactttaattgtgtaaaatttatagtatatggtaaattagagtcagatcttgaagtaacactgtaggtatctgtgagtataaataactcaaaattgaatcagtgtaatgaacagaaaaattgagtatactttcaggatttagaatacaaaatatgatttctgcatctcaaatttatcatgtttttctttatataatactctggaatgggtttgattagatccagagttctgggattgttgaagccatggaatctaaagctgcaagtaaggttatcttttttgtggtagtgctccccaaatcaaaaagaaaatagagcaaacaattataaaagcatttacaatttaatttttccaggaaaggaaaccttggaagtactcatcccaaataattaccaattcagcatgaaatatagcttaagaagtgtgcctgccatggtcccaagcattattgatcattctttctaattagtgtcatacattttatttataatgctatacttccttagttcttctctcaagcctttctgtgatgaaaaacaaaacaaaacaacagccaagaaaaacttaaagatgctgagacattgagtgttgggtcagagagaacattgatcccaaatagagcagtcaggctcatgcagattaactctgcaagaataactcagagccatacatttaaaatactacggatttactcatgtgtacccctgtgaagactgtctcctaaatcaaaggcaagggcaattcttataaaggcaaaagccacaaagtttcttaaggaagagggcttgtcaattaatgcaagctcttggtttatcatttagggactagcatgagatgatggctgaggcccaagtccgtatgttgaattgagataaagtagtcttaatttcatgcaaaaggttgtttttctgacagttctaaagagaagaagttactatggctccttcatctggaattctgcctgcttcctgtataacacctccagactctagatcatgtagcacgaaaatctgtattcagtttctgagggattgattaaactatccagagctccgacaatcaaatccacttcttaggcaatggaaaggaagatgcacaaggataagagtgtgcctttttcttttagggaagtttgccagaaataccacacagcacttctgtttgtagcccattggccagattttaattaaatgacaaaacctagctggaggaaagactggaaaacctcctttctccatacacatctaaataaaattagggttttgtcggtgaggagaaaaggaaaatgattattggggtaattaaccaagtctccaccatgaagggacacaaagacttttatccgcaagtagcacaaaacgatctaatatttcatcaatctggcttctttggcataatgaggcatttctatctttaaatatgtcttaataaaataatacttagtaacgttacacgttacttttaaaagctttttattgtttatcttgaagagatttccatatacaaactgaaatttaataacatgtattttaaatcatgaccagaatgaaagtcaatagcagtgcctctatgattaattttcttatgcaatccaccatataataatcattatattgtctcaataaaatcctagtataatctctatgtttaaccagcatggtagcaagtaaaacaagaaaatgtttttaaaaaaactccataaataaactggattttttaaagaggttttctcaaatgttcctgttttcctctacttaggctcatggtaatattgcacttctccaccaatgtggaatttatgtgtcaacatatagcctatttggccaatggtatgtgaggagaagtgctgtatgttatttccaaatggtagctttaagaaccagtgagaaatttttcatgttcccttctcctgccacaactatcgttgaaacacatatagaaaggagcctcctgatcaggcatgctggctcacgcctgtaatcccagcactttgggaggctgaggtggacagatcacttgagctcaggagttcaagaccagcctgggcaacatggtgaaaccctgtctctactaaaaatacaaaaattagctggacatagtggcgggtgccactactggtagtcatctcagctacttggtaggctgaggcatgagaatcatttatgcctgggtggcagaggttgcagtgagatgagattgcgccactgcactccagcctaggtgacagagtgagaccctatttcaaaaaataaaaataaagaagaaaggggcctccttcaccaaggatccctgagtgtaccctccaccatgatagacatgtagcattagcaagaaataaactattgtgctaatccattgatacatgaggctgtatgttattgcagcatgacctagcctatactattaactgatactcctcctcagattcacatcagctaatatctctccaaataatacattttctcttcttaagtgagtagtaaagtatgaaatagtaagcattgttaaactggctttaaaataatgatagactcgtctacttaaaaagcctccatgagctgctctttgtaagcaatcagatacatatattataaaataacccatttggaaccacatgaatgataaaactttatattcatcacacattttatgttgtggggacatgatccatgagcataattagagcatttagtaagttcttattctaatgaaacccaaaggaattatcaggaacgtatcagtgtagacaactgattttagccaaaccttgaaattaatgaatggaacagctgggctcagaaatgagtactttggcaattatttctaatggttataagacctgctgtgttttttttccagcaatattgagttatttaatcattcaacatattcttattaagtggcaactcaggcactggaaaaacataaagataaataagtcacatatctggccctcgaggaaccaatcatcaagcagaaaacaaaaatccctaccagtggaggaagttttacagtgaagaaagtatttgttagtattagatgaaagtattagatgacaaaaatactctatgatctgattgcttaagaatattactatctagatgttatggagaatttcatggaagagaagacattttaaaaaaagtattttggtattttctcttattataaacaaattgtgacctgaaatatgagtaagatcttgatggccagaatctagagaaggaggagaactttcttatgagcataggaacatgggtggagggaattccagaagcaatgggtaggggcatgcaaggggaaataaaagacatacaaactgcagggccaatatagaagcataggaattaatgttgagaaggtaacaaagtgtttatcattctgctttgaaagtatttctcacaaacctatgttttattgtagactgtatgctccatgagcttaggggcttcatcattaatctctatgtctcagaagagcttggttcagaattgcaaccaaaaatgaaagaaggccctgatagagataattttctgggtcttgatttttgttaaaaaaataaataaataaataaaagactggttgcagtggctcatgcctgtaatcccagcactttgggaggctggggcgggaggatcacctgaggtcgggagttcgagaccagcctgaccaatatggtgacgccctctctctattaaaaatacaaaattagctgggtgtggtggctcatgcctgtaatccctgctactcaggaggctgaggcaggagaatcacttggacctgggaggcggaggttgcagtgggccacgattgtgccattgcactccagcctgggcaacaagagcaaaacttcgtctcagaaaaaaaaaaaaaagaaagctggattctggagactcatgattttaaaatatttctttttactatgctgaataattaggaacaattagaattaggcaagggtcttagtctgttagggtgctataaaaaaatactatcgattgaggggcttaaacaacaaatatttattttgcacagttctggaggctgggaggctggtgagtccaagataaaggcactggcaggttcggtgtctggtaagggccaaattcctggttcatagaagacagtcttcttgctgcatcctcccatggcagaaggggtgagggagctttctggagtcttttttataagggcacttatctcatccatgaagactccacttttctgacctttgagaggtcttcacctctcaaagaccccacctcttaataccatgaaactggggattagatttcaacaaatgaattgagggggtcagggcaggggaagcacattcagtctatagtagctagtctctaaagaaagcagagtgaattgaaggccaagtatggtagttatcttccatgatcctattcttctagattaggatttcttaacttttgaaaatgttatcaggctctttggttctcatgaaggcaattgcactttgaagaatagcgttttctaaacacataagataagatgtaaggattaagactatcttagtctgcatgggctgccataacaaaatactatggactggatggtttaaataacacaaatttatttctcatggttttggaggctgggaagtccattatctgggtgctgcaagatagattttattctgtgtcctcttctggtggcttgtagatggctgccatcttattatgtgctcatatgacctcttctacatgtgagaatgggcaaagagagagagctctcatgtatctctatttataagaacactaattctattggatcaaggccattgtgatctcagtaaagcttaattacccccttatatttctcatttccaaatacggtcacattggtggttaggattttaacatataaatttgggggtgaagggcaccatgcagtccatggcacaaaggaaatgaatattacaatagattatcaaaatattttaagagtgtaatataataaaatatatacttgtttattaatagacataatggtgaagttaatgcctactatactttaaaagcagtgatgaacataaataatatcttaagatatgaactgagatgtagtataaacgtatctgtgattatttggtgaccaaatcatagatatgcttaatactactgtggtttgatttaaattgttgttaagttagtggaagtcaagctgaaattttttccccattgacatttgtagatcagctctgcccttctatcttaggactccttgctttagacacttctcaactgctcaggggtcaaggtggtgcaaaaaacagcaaatatttcatttttacttgcctctagatatccactgggccttttattgagaaacacctatgtatatcaagatagaatgaatctaaaacttaatgctctctagttttcatgatgcatgtggcattcaaagggcatgatgcatcaaaactagacttgaaccagacattttgctatttggttgagatacagccttgaatgtctgtcctgaattaacttcatgaaggcttatgataaacatctccctaacccttttggtagaggtttgagtaggaaatcactttttgggttgatttagtcatacccttaagcgaatcaatccaatgccatttttatcattttagcttgaaaagtgatgcataccactactgcagaggaaaaagaaatattaccccttcacacctcaaaagtagtttccactccctgactctgggccactactgggttagcaggaaatatttcactggttgttctacagtattttttttttttataattttagcctcttttgattctattttttccctaaggttaaagacttactgttcttttaattcaacaatagtttatgagcatttagaaagtggtagtgtggactgaggtgcaaggattaacagaaaggtaaataaagttattttccattctgtctttgggaccccgaagttttgtaaaaatgttagatttatcactggctttctagactcagaaacattcatcaggtaaaatagaatttttccagtcaaattatttcatcaaattattttctgatgtcttttgtaatcatgataaccattggattcattagcaagtcaaaacaaatatctaggtctgcaatgtgttctgtctagcttaaacagtcaatgaattgttctgggtttgagagtctctttttggggatgaggcaactctgatttcttcaaaaggtactttccttacttgtttccaacaaaataggtaaagacaaggaaaaagatatgaagcccaaattggtctgcttttctactcactataataaacatgattgaactagagattacaaggattgaacaaaatgaggtttggaaattatctgtatattttaatcaggctttctacccagagttccaatatcaaagaaatagcaatggagccaaatatggagaaataataagcagtctttgttattctttctattctgtatggtctcccttataaatgctaagatatccatttattgtgtctatagcagtggtaaaatgtttatcaaatgtgcaaattatgtaaaataataaatgtttttttaaaaaggtattacctttttttaaaaaagatataatttatagtgctaaccagaatacctgtgagtataattaagccacagaataactgtaagaagtggtaagtaacctcattacaaatgtggtgtaaagaaaatacagtacagtgttactcatcaaaatcaaatggtgaaaaggaatggataactttagaataactttacatgtaaagagtcaaaatattttacagcatcaaattcagggaaaagcagatgtcaaagtgagcaaatgtggggttttgtgttctcagaaaaaaatcacgtaatcaatatctctaaaccaaaatagtaattgacagcttattgagcaaaataatcatgaatattacaagaagagtgatatgggtgaaattgatgggttctggaagacctggaacctttcaagggaggcagttgcttcaggctgtgatctactagtttgtttttagaaatgcaatcagaaattaatcaaattccgaagtcttcttatacctttctaagaaacaagcaaatgtggagataataaacttagagaaggaaattttatcaagaaagcaatttctagaaccacttttggaaaaagtacctatttagtcctaaattgagatcatccacgttttgagtctttggattagggtttctattattatcaaatttgtacttctctatagcactgtattttaaagtgaaaataattattttatcaatttttttgaaaagagtggtggaaatatggacgtttgttagttttctttttgtatttttatgttttttaatttctaaaacaatgtgaacatcaaataatatttgaaatatgtctatggtcttttcatatcatttgtacttagccataactttcaaggctctatatgatttaactaatatgaagaattgtttttgagttttgtttgtgttgttgatgttgttttcctattttcttgtgtcagtgatgatatgagtagcagtgggagtgacactgatcagggctgttccgattccccaaatgtcttacatacctgtgagtacctaaataaaagtttttatttgttttcatgtctgatttttatatgcaaagcataatatgaaatgagatattcaacagggatggttacaagaatagacagagtagtaagccctggggattgctggctgatttgaggctgaagcataggtcctgagtcttttcccttgatgaccctttggacaactctgcacacatctctcctttcactgccagtctacttccctccaatgtacaaataatgtgtttagatatatggcctatatgtctcttctggcttattccaaattgtttaaacttattttggggacaggtatcaccaagtttagagttgtaaggggagcattttatttcataaaattactttatgaaataactataggtctagaaaagatggatataatgatcggtagaacaaatggacataggaatgttctggttatctagagctgtagaacaaaccaccccaaatatactggcataaaacaacacaaattaataataatggttatctctcatacatctggggtgactgggcttagctgtgtgactctagctcgcggtcaaatggaggctggggcttgagtcctttcaaagtcttcttcactcacatgtctggctgttaatgctgccttttgtttgggacatctgctggggctcttggcctgaacacttattcatggcttctctatgtggcccaggcttctttatgggatctcgttaagttctaaagtgaggtgaaccaaaaaagaaagagttggcagaattcagttacattatttgatctagtgtcaaaaatcacactgcttcacttttgctgcattctagcatacaatttgtaaggatcaagtcactaaggctggcccactacatcatcatatttaaggcaatatcagataatgtgtggacatgttttaaaactgctagatagataaatggagctctatggcacaataagttagtgtgccatacttagatagataaacatatagataatacatcctttgtttccagtttaagttatccattgtaccctgtgaaacattgcatagtccacacaaatttgaagattcttggatgaccactttgtttcacatatcctggctaattttacacattagtgaaattcttcgtaatgaaattatgtattaaggaatctttatagagggtcataattaagcattgtttcataacaaggttgatctagggtcactgtattttcattaacaaatgtacatatcatcttctaatcttacatgctaatgttatgaacattttttgataccaaaactttaatcactaaatgaacagcacttacaaaattatatgtcaacaagctctgtttatgttttgctagcaattaagtccacttttatcagagagttcttctgctccatgcatactgttcacctgggagtgaaaggaacttcaagcctagagctccgctttcttccctttaacatgcacgtgcgctactgtgtcatcatcttgagcaacaaaaaggtgagaacagaattgtgatctgtgtgtttacacgagctgtcactttaatggagtaacgaacagcaggtgacttgaaggcaactgaagactctagaaatgtggatgatttcagctctcaagttactaagcaaagagcttatcctcaagaatatccacagttacactagttgtgggtaaattttataatagctgcataaagcagtcccatgggagcagagtgacctttttgtggctctatttgtattagttatccatagctttgtaacaaattatcacacaccaggtggcttaaaacaagacatgcttattatctcacagttactgtatgtcacaggtccagatatgacctagatagatattccgacgacagtctatcaagtctccattcaagggattgaccagagctggattctcttcagaggttcaactgaggaaggatctgcttccaaactccctcaacttgttggcaaaattcatttccttatgtctctgggatccatgccacctacactttcaaaactagcaagggagagagacagagagagttagagagggggagagagacagagagggttagagagggggagagacacagatgtgagagagaaagagagagagagttagagccaccactgagggaaggtttatagcattacctgcttccagagagacactgccatgtgttgaccttaggaagaaatttataacccccaggatgtagtcccaaatttatcatcagttatatgtacactaaattgaatacatatacagtgaaaaatggtaattggaaagaggtattgtacttacctggtgtctatggcagtatttacatgtgaaaaataatatacctattagaaatgtaaaatatagtttaattttacacttaaaattaccacttagaaggaaaaaaatgcctttttatagtaatgctgaaacttgtttgttaaattcttttaaaggagatcaggatttaagtaaattcctgcatatataaaatttgtgaaatgtaataactatattgtgaccagtagtttgatcaaatactttacagtcacttttgtatattaatttgtaatatgacccaacaaaatactagagttaattctcaatagcatagtaacaaggttgattttattctttgacttagtatattggaatattaatattagcttacacaaatttaatataattaatcaaaatataattaacatgttatctcaatttactaaaaactaaatcttgcttacgtatgttttgtccttgtcagagaaaacattaaaataaaacaacaatcttgaaattatactgctatcaattgagaaacaatgccctcagtacaaagtattgcattgaattaatgtttcttacatgaagaagatctattgttttacacgttgctaattatattaaaaatataatagttaatcaaacatgcaagctcacctagttagctactgttctttttaaacgggccgtaactgctttaccattaagaaccacctgttggccgggcgcagtgactcaagcctgtaattccagcactttgggaagccaaggtgggcagaatacctgaggtcaggagtttgagaccaccctggccacatggtgaaaccccttctctactatcaatacaaaaatcagctgggcatagtggcacgcacctgtagtcccagctactcaggaggctgaggcaggagaattgcttgaacctggaaggtggaggctgcagtgagccgagatcatgccactgcactgtaagcctgggcaacagagtgagacactgtctcaaacaacaacaacaacaacaaaaaccacctatcgaaaactgaaattagacccctacttgatagttttccatgtataaaattgaaacattgctaccaacactgttacgaagcaaagactatttctttcattctggctcttctgtttgaattttcaaataaagttgaaaagatttaaggaacaactatttaaaaacagaatagttttacaaatcttacattagtgttcatagaaattcttaactaagggagaaacctatgaaagccctgaaaattcgtgctatcaaatgctacagagccaataatgttttgctccaacatggaatggagcaaattaggtggaggaatttcaagcagaatcagtgtccagtccctggtgaattgtaccttttaggaggaggggttgacagacccctttacaaagcacacagacgttgcaaaacacacaatgatgtattgataaaaccttggggttctgtcttcactgtagtgtctgtagtgtctagcatgtgaacacccactctgtgtgatcctgggtttttatgcagtaaaccacttggcattgctgagctgacctgtgtaagggaggcaagggtataaaagaggatgcctgacctgggggctgagttaacagcgggttccagttacagccatttgctgtgatatagccagccccctcccaacaaaccttcagtgttttttattgacttgacccagagcctcccttccacctggtagatttatcttctggccttttttgttctctgtctacaaaccttgcttagaacaaattgagaccaaagtccaggcattgctgaattgaagaagccagaagggaggtcagcatcccagaataacttatgtgaattggtcaggcccacaccagggtgccatataccaaagtgagtttcagccttgccaagtcaagttggaggttaacagggaaagcatgcccactcccaggtagaagaccctgcaaggctttcttgttgatttatggcctataataatttagcctaagggtatgaagcaccagttcttaagtatattaatgtcactttggccatctcccatatatttgcataaatcaatagggccactcctctgattctttccactctcagtcatttcgttttctctcagtcttttgtgtcttcctgtgtctggtgatgcagagattaagttggcagtctctaatatgcatatatttaaatattttccaagaatgtgcaacttttttcaattataatgaatgtttataacattaatacagaatttaacagtattgattttgcttgtttattgaatgtgaaggtaaaaacattaaactatattatgctaaaatctttatgtgattttatatttaagcagactaacttttgttttattagagatatatttatagcttgaggaactgagtattatttgaggatgctttcttttttatttttcatgatttataatggcaagccctatttcatttgtcctttgatttttttattcaattttcacaacttttttctttttttggggaatgaggataactacacacctccctacaggtaacacccctgaattcctggggaaacataggcaagatgaaatcccatttggcctataattgctttgaagcatttgttaacctcataaagcctgctgccaatatgggggcaggttatgtcaaccttgaagtctctgtcaatgtggcatatactcacaaagttacaaagattctcagctcccttcatactgcaaggcctttttgctcttcagccaccctcctttctcctattaaccagaaaaccctcatcctacaataagcagtgcagactttttcaagataaacatgaagagaaaaatctgaaaattagaattttgtacctaattgtcagttatttatttttgggctactctcttggttccttatcaacggtactatcagatagactgtaaagagtccacatgcctgaggtaccaacattttagctctagggaatatcacctcacatgacatggcacagctgaggaaacagtaattgctattttccaaaatcaatactatttttatggaccctcacattctacaaagaagttgtagaatatagagaatgactatatcacattttaaaaagtttgtatccttcaagctggattttaataatttcattttattattctgctcactcttcccaacatagtttaattcaccaacagtatacagccaattttctaggcagagagagagtgaacatatgcaaaatccatgatccctgcactcaagggactcacattccagttgtattagtccattcttgcactggtcagcgcttggtcccaaccattcaacaagtctctatgaagttccagactttccctcatctttctatctccttctgagccctccaaatggctccaacctctgcctcttacccagttccaaagtcccttccacattttcaggtatctttatggcaataccccaattctggtaccaattttctgtattacttcattctcacactactataaagaactacctggactgggtcatgtgtaatgaatggagatttaattggctcatggttctgcgggctgtatagccttctgcttctggggaggccacaggaaacttacaattgtggcagaaggagaaggagaaacaagcatgtcttcacatggctggcaggagagagagaaagaaaaagagtgaagggggcggtgctacacactttgaaacaaccagatcttgtgagaactctatcatgagacagcactagaggaatggttccaaaccattagaaaccacccccatgatctaatcacttcctaccagaccccacctccaacttcgggaaatacaattcaagatgatatttgggtggagacacagagccaaactatatcaccagtggagaaggcaaacttgcatagggctggcctatctcacacagaaactttgcatgaatttgaaatataagggcctcctactggtgaattagagaagcttactgaacatatgacacagtcaaatgaattagaaaaatgcatctcttactcagtggatggtgctttgtgatgggacatccttgtccttgacaaaatgcccccatgcaaggcatactctttgctagtatacacagtgtcctgaaacatgtccgctaatttctataaaacagttagacagattgtgacaatttctagaatagaaagaagaattcatttctgtatgatagtgaagacagggataattgattaatacaggagtttgatcaaggatgagttgccaataaaacaaagagactgggcaggagagatgggtactcccaagaagattctatgaacacagcaaaacagctaagtatgaaatctcatgtacacatggattaatgattctgagaatggtttcttggaagtgatagaaaatgggttggatggataaatcagactgatattgagtagggcagttaattttaagttgaattatttataatcattataattattattgaagcaggaatccagtggaagaataggcagggcctgatttcatctttgttttagaaagcatctttgatgccaaaacagatagtagattacaggttggagaaaggaactggagatagggagactggctaggagacttttgtattgtgttacactgcttcacatactccctttctatactgccctcggctattccctctgtaattctagcaagggattccaaggaccacagtttatattgctataaagatcaaacttaatgacagtttgagtgatgttcgcatttgaagggaaggaagttttcattcacttgcagagcaaattggtgacacatttgagtgaaatggttctgaaaaatgtggtgataaaaggaaagagagactgtagatttcattgccacagtgacttctaaagtctaaggacagcttccaggtttttgaggaaataatgtcctaaaacataccaccaattattattaaacaatccattaataatttatgtcatttaaatatattttatcttctcaaaatgtctgtggaataatctgtaaggcctgcaattaatgttgtgtcaaaattttgttaagaaaattgaacttttaagtgcaggtatacaaatcttttcatgagtcttctcaccctcactgagtttcctagctcctagctcactgccttaattattataaattgttctataaaaatataattttaaataacagtgattattcttactaatcaggtttatattataattttgatagccaaatggtgacctataatgattaatgatctctctttagcatatggaatttaacatttcgaattttagcttaacttccatgtgcctgtttagccatcaaaataatataatattgctcagccttctcaaacaaataaatcacaaaacgggaaagatccgaacccaaaataagagaataaatacgatttaatacctatgaaaaatcaaggagattttctgtctaggtaaatgcacttttttgggggaagattgaggttatttgtatctagagggcatccgtgacttgtcaaaggttacccagctaattagtggcagagctgggattaaaacttttgtgccaattcagtgtttgtatccctcttttctgggtaattaacagctggtcttcttgcaaatttgcatgtaactgtgctatttgaggactgcatttaactagatacacaagaggaacaaaatatcttctgtaaaagtttcttataattgacaatgagctttggcatctttctggaaaatacaatatatttctaattaagcatgccaaacagaagttatgaaattaaaagcaggaaaaacttgtataggtgattattagaacagctcatgatgacaagcgtctgctaagtgtcaactaatttcatttcccttgtcaaagcttctagatttggaatatgagaggattttctactttaaaacagctttttatttattgcatttctgtgcctttcatggtctaattttattccaagaaaaagtggaagcaaataatcaaactatagtagagattatggctcttctgaataatgttctgacacaggcaagataagcattattttcgattatattaagtgattttttaatacaaagaatatattgatattgaacatgttagtcaaaataattttttgagatatggtaatatactgtgtgtgtaagatgtagaatttagtggaaattgagtggagtcctagttaataatattttaactgatgaatcaatggctgagaagatgttataatttatatttgaggaaaatattctggcaaatagccatttactccttttaaattgactcccataggttggtattcattttcacatggtagacaagccctagttcaggttttatttgggcacacattaaaggaaacaggtagttataataactctacactcaatgagtctaattgcttatgcacattttatttttgataaaacaacgaatttttaggtaattagttatctaatttcgttgttttatctaaagatcttcagtctttaactgatgcatttttcctctacttgaattactgaatattttacatctttaattgttgatcattcagttgtatttgtgtggaaacacatacaaacacacaaacacacaaatcacatttcaaatggctagcttggatttttgcttgtaaagtacgtggctgcttaagaaaatatactatatgaaaattgtgtattatgtagtatttattgccaggagtgtatagacttaaatgataaataatataaaacgttcaaagtttttcatattcttttttccagcatgaactatagataactgtgggtcttaattaataaaattttagggaacattatcatacagcaatagaccaccaaatgaattataaacaaatcctaatgggggataacaaagctataaataatagacctcacagtgagaaatttttcattcttatattgtttatagattaatttttaatttctgtttcatttgttatctagatttgtaatattttagaatatgtattttttgcatgatcaatttacctttatatcattgttgacaaaaagagtcaaactctaaaatatttggggagatttattctgagcctaatatgaatgaccatggcctgtgacccagccccaggagatcctgagaacatgtgccctaggtagtcaggatgcagcttggtcttatacattttagggaggcataagacatcaatcaatacatgtaagatatacattggttctgtccagaaagcaggataacacaaagtggagacttccaggtcatagaatttaatgattttctgattggcaattggttgaaagagtatatctaaagatctggaatacatggaagggagaatgttggttaagatactgggttgtggagaccaagattcttcttatacagatgaagtcttcagatagcaggcttcagaaggaatagatagcaaattattcttatcagacttaaaaagatgccaaactctttagttaattctctcctggatcaggaaaaagacccggaaaaggaaaggggattctctacagaatgtaggttatccccgtaagtgacagctttgcagggccatttcaaaatgtcaaggaaatctattttgagataaaatactttgatttctttcagggcctgctatttcatgttgataccttcctgctagagtctgtttttcagtcttaaggtctctgttgtaatgttaatgctggtaagctgtgcctgaattccaacaggaggaaggtataatgaggcatgtctggactcccccacttcctgtcatggcttgaactagtttttcaggttaactttggaatgcctttggctgggcagggatccatttagttagttgggatcttagaattttatttttggtttacatcatttatctagatgtttcatgattataatgaagcaaatcccagtgatcacagaattttattcataagcaattcagtaagtgtttctacaacaaaaatgtttttttgacactgccaaagatatccttgctataaaaatatggtaaagtttttcttaatatcgtccaaacatccaagctgttttcagatttctccaattgtcttatacttatttgtatgttttttctgtcacttcgttttaagattctttgaatcaggatctaaataaggttcaaccattgtgattgcatatgtcttttgagactccctctctccttttcctttttattaaaactctaggttcctaaaattaaggtattgatcatcccatattacagaggaggaaactggatttcagaggtttagtaaacttgcttgaagcctagtagctaagaaatggcagtgccaattaaaaccagaaatgtccacctctgctgatctttcactatatcatgttgctgcccttgcattattcctgcttttgtttttgccttatctctttagcctgttggtctaaagaaagaaattgaggcaacattaatatagagaggttatttgggccaaggttcaggatggctgcaaatgacttacttccaggtcgccttgggtagtgctcccttcattctttgttacaaacagatttttaaaggcaaaaagggacaagggtggctgatacaaagttgtttgacaggaatcctccctgatttatagaaataatattggctaatgattggctatacattgtttgaactatagagtatgagttatggtttctagcatatggcattttatggctacttggcttcagttagtgtagagaccacatatcaagtggcctcaagaagtaattatttagctcaaggggatgtgaaactcaactgctgtcacattttaatgcctctctgggacggataattaaagagggcttttgttaatcaaataaaagattcttttctttcttaagccttttctacttctggtctaattattttttctaaaaaaaatttagacttttccatgttcattttgaaagcctgcactttaaaatgtagagttttggggactcagatgcctggcaaaactgatgtcactcctgtccaataataagttacagactaaaggaaaaaaatttcttgcttcctcattttgttcattttaagacagcatttgcctgaggatatttgggaagatcaactgctatcaatgcaatcctgggaccttcttaagcaatccctgtgctctggttgcaggcaaagtttctcccatactatggttgaactatatttgtgccttacctttgtttacccatttataggctgtgttgcttataaaagcacaatgcatggtagttcttacagtatgcagatttcccttgtagcagaaaaagttatatttttatgagagattttgaaatttaatactataatgtcttgtgttttagattggacaattaatatatgttgcggaaggaaaaggtatgacccccttgccttccagttgccttccaatgaatacgtcttcaagtccagtttattacagcactactcgagaagaaggtagagtacacatgtgttttatttcatttataatgttgaagaatggacttttcctcatatagttacctaagcatactcatagcaagcttctcttctgtgtgtttagatttcgaaagggcttcttttaactttattatgtcagtatccatgaaatagagcagcaccattttaccaattaaaaaatttcaatggtgattttttaagtcttccttttccagtcttaagctaaatattggaatttggcatacaaaatatttacttggcaacactttccatttctcaaataatctggaaattattttactctcaaaaaatctacataatgttatataacctggaattttaccctggcccccagttcttgattatttttccttaaggaactaagcattaaaatgttgtcagtgaaagcaaatgacagttcttgggagtttttgacaggtgtcttttttttttccacatttatgtctactctccccctacctatcactgataggagcacaatggtcactgaatttttgagcatgttgatgacgtttatatggaccaatcatttgactagatctcttagagaataccaataatctttaattcctgaaaacttgctctttaattactgaattagaactaatagacatgtgctatgcatttatttttactctgtttcataatgaccataactgcaattttatatttcaaacctcccaagtccatcctggatgacaatgtcaagggcataaatgttcattgtattcattaatattttttttcttcctccagggcctaataagaaatacccagttctgtatttgaaatgcaaaccctatcaaatcctgtatgtggaccttaaattgccaatgactaatgaagccaaggaaaaggctttggcttttgcagcacagcaacagatgtcgagtattgagtatgagcgaaggttgatcacaggcactctagagagcagtagtatccgtgtggccatcgccctcctgggactgacgaagatcgaggtgggaatggagtaatagatgattcacttcaattactctctctttaaaaatacacagagttacagagctgttactatttaaaatattattttcattaaataacatttttagaaggaaaagtaatgagtaccgaaggacagctcagttgtcattttttcctttatacctcgttaaataatgaatctgaaacaaagcattctactatgtaatttaaggcattacagtgtagtcattaattcacagtagttttcacttctgtttgcacattagagtgccctggagaacttaaaataatgcccatacccaggccccactcaagaaaaattaaatatgaatcactaggagggggtgggtaggaatatgttctaaaagttgcccaggatattttgctgtgtagccaggtagaatcatctctggtgtcagatagccagactgagaattcagactctaacactgtctagctgtgtgactgtaggctggttatttaaacctcctcaagcctaaatttttatatttttttatatggagatattggtaatttgtaaaaactgaaataattatacataaaatgcttacctcgtatatataataagtgcactctttatgcatgatattgaggtacttattactaccctgtagtaatagtacactactattgctattaactattgctatagactctatcattacagcttagaataaggtacaatctatttttatgattggaattaggtacaatctattctcacagagcagccaaagcgattgttgtaaacgcaagcctgctcatgttgctcctgtgtgcatattcttctactggctttccagctaacgtttgttaaaagcccatatcctttggatgatctacatgacccgtcatgtaggagtccatcagttcctcttccttccctcatctcaccttttctactggagtccattctctaaggccactccctcagcacatgcctggttgctttgcttcaaacatgccaggtgtcttccccatggcctttgaactttctctgttacttttccctacacattagtgggctacctctctcagttacttcaggtgtctgttaaagtgctcttactggccaggcgtggtgtctcacgcctgtaatcccagcactttgggaggccaaggcaggtggattacctgaggtcaggagttcaagaccagcctgaccaatatgaaaccgggtgttcactaaaaatacaaaaaacttagcctagtgtggaggcgtgcacctgtaatcccagctacttgggaggccgagacaggagaattgcttgaacctgggaggtggaggttgcagtgagctgagatcacaccattgcactccagccctggcaacaagagtgaaactccgtctcaaaaaaaaaaaaaagagaaagaaaaaaagctataaatgaggttttgttttagcaacttacacacatttttatatacatttttctttcttaagatttatcttcatttatatatatcaaagtacttggcattgtagaaattatttatttttttatttgtcagaagctagaatcaatacagcctaatcccagatttctaacaattggtgatgatatttttaaatgacctggattttgaatttctggttggctcaaaaaatgttaaatcctgaggctttgatactttcttgactgcaccgtgcttctaagaagttgatggttttctttagctcaaaccaaaccacttctttctgatatagaacaatagatttcagaaggtttatgttcaactttcagtacactattacattaaaatttttcaattagtggctctttcaaaatttaagcctgtcataatgccctcccattttctttttcaattcattttcttcattattacctcttgtcaaaacattttatttaaattataaatggttgagagaggtgttattttgtccatgactagccttttcattgtgtatgcatatatatagtttctttctccttcttcctttagctttttccttggaacgcagcatatgtgtttattattacatttaataaattatgtttttattggatttacttttatgtttaactgtttctcctgtcagattgtgaaatcctagaatcttaagaacttttctcacgtgttttggtctatcctttgacatcttatgcatgatatgagccttgtcgttgtttaattgaattgaaaatatgcctaaagaaacaaaagtcacttttaacttgcttcacttacacttagagacctgggcttatattaagtgtccactttacgaagaatagtattgaactacattttgtctagaggagcatatgcatggaggtgagttgttgtaacccccattatcattgtaatcattgaggaactaaaaataacaaacctaggtaagagagtttttgaacatctgtggagaggtgggacccagttatttttgtaaattcacaaaattgtctttagtgaaataggaggcctcagtctgtgctactaataagaatgtatctgatgatgagcattttttcatgtgttttttggctgcgtaaatgtcttcttttgagaagtgtctgttcatatccttcgcccactttttgatggggtcgtttgttttttcttgtaaatttgtttgagttcattgtagattctggatattagccctttgtcagatgagtaggttgcaaaaattttctcccattctgtaggttgcctgttcactctgacggtggtttcttttgctgtgcagaagctctttagtttcattagatcccatttgtcaattttggcttttgttgccattgcttggaaaccatcattctcagcaaactatcgcaagaacaaaaaccaaacaccgcatgttctcactcataggtgggaattgaacaatgagaacacatggacacaggaaggggaacatcacacaccagggactgttgtggggttgggggagggggagggatagcattaggagatatacctaatgctaaatgacgagttaatgggtgcagcacacctacatggcacatgtatacatatgtaacaaacctgcatgttgtgcacatgtatcctaaaacttaaagtataataataaaaacaaaagaatgtatctgatatatctgatgggtagatatgaaggagtacaggtttcaactaaaggagaaaagcactttctcaaatgctggtcagcggtggaatagtttcctcttaaggcaaggcatttctcaacactgaaagcattagcacgggggacattggtcatctctcaataaaagaggactccactggttttctgaaatgtgtttgtactgttttccaccaattaaataaaaataatgaaataatcaaattcaatccttgatggatttttttccccaaaggtatagtctaaatacataatgctgtcttttgtgttttggaggtgaaagttaagaaaattacattctaattttactgtttgttcacagactcttatgctctttcgtatctcaaagttgaggaagcctaagaccgtttcatacacaacagaagtgagccttccaaagtatttttatatccctgagaaaatctccattccttggattccagaacctcaagtaattaaactttcaaaagcaaaaggtaatcagtgatgtgcggcctaaaaatctaagtgttccgggaatgatgatgtattcacttcacagttgaggcaaaaagagattacacttttactgacaaagtgttcataatataattgaagggtttcagtgaagtaaataccaattattgaatgatgctttgcattacatataatcaacatattacatcacagtaatcaaaattatgtactgaatttgggtgctaaattactggtactgaaacttgcaggcttacaaatttgttaaagagtggtaatctgataaagataataagtgcactttgaggaaggtgagctcttgctttgagagtgaacttggttatggaagttgtgctgaagttgaggcttaggctggctctaaaagaaaggaaaaatgttgatggctagaggttatcagaggagaagaatgtgttattggtgagtaacttatctttgatctggagcaggatttttattgaatactgtacttatttttgatctcctggtgcccctttattctgttgccattatcaataaggtttaatccaaatttaatatgaatattgatatactagcattactaaatacaagtgataagacataaacaagtgactaaatatttttaactattcaaaattacctttctttttcatttcagttcttttcaaacaactggataatagtaggaatgtaatttattcactaaggctattcctagaatgttccacaattccagtatcatggattctcacttatgcttttgctaaatttggttttgttaaatcttcatttgtcattctagtatggatttgtgttggctacaaaatatttgtaagcctgaaagggtgattacaacttataaattacaagatagtctgtttactttccctccctaggagaactgagatcccagactcaaatgctaagtggccatgcaaataacaaggaattaagagttaggtctggtctaaggtaatagggatgatagatcctatggtgaactagagagtagatgccctgtctaaacattcacattcaaaaagtaaaaataaaaataacctgagccagccaaacaactacggagggatatttggcttaccagcaatcagtttgagacccttcatcataagtctttatcttattaaaatctttattaactcagcttttcaatgtgctattagaattttaaatggataacttgttttagtaactttttaatcccttttgagataactggataaagctgcatctactttgaaacacagagaggattgtgaatgtatttattcagccattcgttcatcgacaatgttgagcatcaattcccctaggcaaaaagataaaaattgccttattctttcctttggtggactcacagataagtagctcttataatacaatgagataagtgttatatatagacacatatagaatgtgtttataaataaaattaagaattaattcaggtgactatataggataattcaaatgttaaagcatttcactttgagaaaatgtataaccaaggatacacagcatagaattgacttaaaacttgaagtatagccttattaaacactcatgaagactgtgtcatatttaaatagtttttaagttatctacatttaaaaatctgttcagatatttttctaaggctgattttttctttcatatcaattattaattatccattttggtaagatgattactgtcaaaatatgaaaaaataaaatggcaaacaattttgaattatcattaataaaacgttttaaatgtagttgggctatcatggtttatgtctaactcgattttctgtgcagctgagattataaagggatcttttcatcctatgtttctgttttcactgccttaaacaggcacttaaatgaagtaagtttaagaagaaagatattagtaaactttcaaaaataggatattataactcaggatagtaacaaatgaaataaaaggcatgccctaaactctgtgcattctgctgttcagaggtggacttgaataatgaaaaggaatgggatgcaagcattgtaactttaataaatgcaattctattagaatttgtgccttagaagattagagttatgtgtttagaaaacatatttttatggtataaactgattttaggagaataaacaagcaaatttctgataataaatatggcaatattgaaacaaaactttttttttttcttttggtgtcatggagaaagaaacaaatgacaagaatttatctggagaaccagggatagcccagtgttcccctaactgcagaagacaggtagaagtaggaccatatttatgatcacttgaagttctaaactcatcaaaagaagctagttttaaggtattaaaaaagtggctttctttcctctcacattaatgttgtcaatcagtctttactgaaacatttagtgattttagggacggatttactgtgataccaaaggagcagaagctttatgattttttacttttttgaccccctttcctagtccctgtacctacttttatatttctaattttacattattgctcttttggaaggcccctcccgcaaattgtgacaacctcatgcctcacaaaactcagaattgaacctgggtgtagatattgacttacaatcccttctacctgtggttcctgggatgttgaaatttatggacaggcagagctttattggccttaaattgctagcatagctaagcaggagacctgctatgtttccactagcaattatccaaatcacttccccaatatacagagtcctatatgagcaatatttgccaaagcactcaaacaaaatgctccgggctggttttgctgatcaattaatatggagcaaaaaaccctcattcctaagtgttaatgacttcagtttctagtattttgtatcgctctaatttcttctgctccttctctcttgggagaagaagaagaaattagattaattcaaaatattgatctaaatattgatcttctaatgtgacagacatgttagaagagcatattgtaggagcactgttatccttctgtcccttctcccacctaattccaatttccctaattttaaaatattcactaataattagcagttaaattggtggctgaaataccagtaaatcatccatgacaactttttaatgtgtaacgtaattgtaaatatgtagaaaatatttattatcaataactaatactatatgtacagtcatccctcagtatgcacaggggatttgttccagaaccacccgtgtatactcaaatccactcatactcaagtcccacaatggatctcggggaactcactgataagaaaactcagccctgggtatacacgggttcacggcccacagacactgtattttctgtctacatttggttgaaaaaaaatctgcatgtaagtgcacccatacagttcaaatacgtgttgttcaatggtcaactgcagttctcattttacgaagattaaatacattaatagctaaattactcttcagcctcaaaatataattgaaaaattgtgaaaaaatgaaactaaactaatccttaaaacataaaataggtgaggtgcggtggctcatgcctgtaatcccagcactttgggaggccgagatgggtggattacctgaagtcaggagtttgagaccagtgtggccaacatggtgaaaccccgtctctactaaaaatacaaaaattagcctggcatggtggcgggtgcctgtaatcccagcaacttgggaggctgaggcaggagaattgctagaacctgggaggcggagtttgcagtgagccgagatcacaccattgcacttcagcctgggcgacaagagagaaactctatctcccccaaaataaaaacaaacaaacaaaaaaaccaaaaacttatgaaacatactttgtaaataaactctacatctctgtatcatatggaataaccacaaatacatttcaaacaggataaaaaataaattttgtttaacagaatatcaaattaaatgctagttttaatgatgtaagctgactttaattggaacaaatctattatactttattgttagcattgccaaaacttacctaatattaaaagtatgagtcggttaatttttctcaaaataacaagggttaagcttgtgttattatattcgtcacattagtttttggcaaaaactcttcaaatttgcaaaacaaatttaaaattgaatttctttaactcacttagaaatataatttatatgtatctttcagagaggattgccacaattgtaaagcatcctgtccaattatagtccatataagaatgtgattagattctggaagaaaatcagtaacccatatactacatttaaatcttataagatcaaaacataaattttttagcaaacccaaattggcaagagcaaggaaatgacaactctgtttttggtctttaaatgtaaatttaattataaatataataaattttattatagtctatcttcctagaagagttgcaaaaataaccataaaggatacttgtcatttgaatttacatcaagtaaaaaataaaaggatattcacctgtgctcacactcagatctctaatcctctatttatgtattttgattttaaggtttgttgagatatctttcacataccatacaattcacaaatttaaagtgtataattcaatagttttcagtatatttataaatatgtgtagtcattaacacagtcaattttagaacacttttatggtctcaaaaaaaacccagtactctttaggtaccatgcccctccatcctccaccatcccatcagccttaagcagtcactaatctaatgtctatctctatagaagtgcctattttggagatctcatgtaaaatgaatcgtatgttacattttctgactggcttcttcacgtagcagtatgccatttctagtaatgatcaaataatattccattttgtgactatgccctactttgtttatccattcatcagttaatggacatttgggttgtttctaccttttagctaccatgaataatgctgctatcaacatttgtgtacaaggttttatgcagacatatgtttctatttatcttgggtatacatctgtgagtagaagggttgaatcatatgggtaactctatgtttaaccatttgagaaactgccaaaattttttccaaagtggctgcaccatcttacattcccaccaacagtgtatgaggattctaattattccacatcataggcaacacttgttattgtctgacttcttgattctagccatcctagtgagcagaagtagtgtctcactgaggttttcattggcattttcctgatgaataatgatgttgagcacctttccatgtgcttatttgccatttgtataccttatttgtataaatgtctattcggattttttacccactttaaaaatttagttgtctttttatcattgagttgcaagtgttctttctatatctcagatacaatatcttatcagatagacatatgatttgcaagtattttctcccattctgtaagttgtctttttactctcttgatagtatcctttgaagcacaggagttttttatttcaatgaagtccagtttaactgtttttgttgttcttgttgctcttgcttttgatcatatctaagaatccattgccaaatgtgaggtcatgaagatttatccttatctttcttgtaagactttcatagctttagttctcacatttaggtgttttatccattttatgttaatatctgtatatcctgtgagaacttcattcctttgcatgtggctaccaagtcgtcttagcagcatttgttgaaaacactactctttccacactgaatgatcttggcacctttgttgaaaatcagttgaccctctcacagccattgcagtacattgatctccatagagacagtgccagggcaggtgagagccagaagggcactgggcaattctgtgcctcactgaagaaaagtaactaaacatgggcaaaagagaccctaagcagccaagaggcaaaatgtcatcatatgcattttttgtgcaaactgctcaggaggagcacaagaagaaacaactagatgcttcagtcagtttctcagagttttctaagaactgctcagagaggtggaagaccatgtctgttaaagagaaaggaaaatttgaagacatggcaaaggcagacaaggcctgttatgaaagagaaatgaaaatatatccctacttaaaggggagacaaaaaagaagttcaaggatctcaatgcacctaagatgcctccttcggccttttttctgttctgttctgagtatcacccaaaaaccaaaggagaacatcctgtccagtccactagtgatattgtaaagaaactgggaggaatgtggaataacactgctgcagatgaaaagcagcctcatgaaaagaaggctgtgaagctgaaggaaaaatacaaaaaggatattgctgcatatcaagctaaaggaaagcctgatgcagcaaaaaaaagggagttgtaaaggttgaaaacagtaagaaaaagaaagaagaggaggaagatgaagaagatgaagatcaaggggaggaagaagatgaagatgatgatgatggataagttgcttctagtgtagtctttttttcttgtctataaagcatttaatccccctgtacacaactcccttcttttaaagaaaaaaaattgaaatgtaaggctgtgtaagatttgttttttaactgtacagtgtctttttttttgtatagttaacacactactgaatgtgtctttagaaagccctgttctggtggtatttacaatagccactaaccttgcctggtagaatatgggggttgtaaattggcgtggaaatttaaatcagattctcgttagtgcacagcacaaattagttatatatagggatggtagttttttcttcttcaattgtctgtgatgcatctaacacaaaataattgttctgttaactgaatatctctctaattgcaaaaaagaaacagtttcagctgttttgttgacattctgaatgcttctaagtaaaaacaatttttgaaataaaaaaatcaattgaccatagatacatagtttatttctgtattctttattttatcccattggtctacatgtctgtcctcatgccagtcccaaactggtctaattactattgctttgtagtaagttttgaaatcagaaagtgtgagtccttcaatatttttctttttaacaagattattttgcttattccagacccttcccaaccacaaatggattttagaatctgctcgttgatttataagaagaagcctacgggccttctgataagtattgcattgattctgtagatcaatttgaggaggattgttatcttaacaatattgtcttgaatcagaaatttggaatttttttttatgtctttagaaattctttatttttttaaaatgggttttatatttctcagagtataagttttacactttttttagttaaatatattcctattttattctttttgataatatcttaaaagtaattgctttcttaatttcatgctaaattattcattacaaatatatagaaacacaatatttttgtatattgaaagtgtatcagagataagcagagcaagatggcagaatacaagcctccattgatcatcccctctccaaggacaccaatttaaaaactatacgcagccaggagcagtggatcatcatgcttgtaatctcagcacttcgggaggccaaggtgggtagattgcttgagaccaggagttcgagaccagcctggccaacatggcgaaaccccatctctactgaaaacataaaaattagctgggcgtggtggcacaagcctgtgatcctggctactccggaggctgaaacacgagaatttcttgaacctgggaggcagaggttgcaatgagccaggatcatgccactgcatcgaaagtgaggtatggtaacctccaactattattattatatattattattaaaaagcctatttctctctttaattctgtcaatgtgttttatatatttgaggattacattttatggttatatatgtttctaattgctgtatcttcttaaataatggaactttcatcattctataatgatgttctttggctcttttaacattttttgacttaaagctcatttataattgtagtatagccactccagctcacttttggttgttgtttgccagtggtcaccaaccctggatgtacatcagtggtacctgggtacctgcaacaaaatacatattccaggcccaactctaggcctactgaattatcctcagtttggaaggagtctagaaacctatattatcaaaattatccctgcccagatcacttgtgtagttaatccatgtattagaataaattggggaaccaccacttgcacagcataatgccaccatggtccaacatctccatttgtaaaagggagaatgttaggcccaggaaatttaagtgtcttcacagaccatgtaggagatcacatcaagtctcctgagtaagcattcaagtctactaagtaattagagtaagtacactgagtaagcctgctaagtcttcctctattctgtttccattatgttatgctgcacaaaatgtgaaatcacaatgctgtttattcttactctagtaattgtcttagtttgagtcccctagaaaataaaaccttaagcaataattaaatacgaatactttatttgggagatgcgaattcagggcactgagagtggaaaaataaaaatagaaacaaggaagggaaggatgggaggtaaagcaatgcatgatacatgagccgttgcctcagtatccacaacttacctctgtgaatacaatcatgcatggcttaacaaaggggatacattctgagaaatgccttgttaggtggtttcatctttgtacgaacatcacagtgtacttacaccaacctagatggtatagcctactaatcacctaggctatatggtacaacctgttgctctgaggctacaaacctgcacaccaagttactgtaccaaatactgtaagcaattgtaacacactgctaagtatttgtgtagctaaacatatctaaacctagaaaaggtacagtacaaatggggtataaaatattttaaaaaagatatacctgtacaggatacttaccatgtatggaacctataggactggaaattgctctaggagagtcagtgaatgagtggtgagtgaatgtgaagtcctagaagattactgtacattcctgtagactttataaacactgatacttaggctacactaaatttatttttttaattttatataataaattaatcttggcttactataacttttttgctttataaacttcttagtatttttaaacttgttgactcttgtaataaaacttagctaaaacatatgtagctgtacaaaaatattttctttctttatatccttattctataaatttttttactttaaagtttatttatttatttattttacttcttaaacttctttgttaaaaactaagacacaagcacacacattaccctaggcctacacagagtcgggatcatcaatatcactatcttccacctccacatcttgtcccacactggaagttctttaggaacaatagcatgcatggagctgtcatctcctataataactataataacaatattttattttggaatacctcctgaagtaactgcctgagactattttacagttaatttttagcaggacaccctaaaataacaagaaaaagtatagtataataaatacataaatcaacaacacaggctggtaattatttgccatggcaaataaattctggtaatttattaccataaagttttatgaactgtacataattgtatgtgctaggcttttataccacttggcagctcagtaggtttgtttacaccagcatcaccacataatatgcactgcagcaggacattatgacgtcactaggcagtaggaattcttcatctccattataatcttatgggaccaccatcatataggcactcagtggttgaccagatagtgcatgactgtatatgcatcagattgctcagcaggtgtctctgcaaagtacccttgagccatcaatgtgagagagaaaagaaaaggaattttatctgcatatttacttccttgtctcctgttcctgtttgctaaactttactccatggccctagcatttaaggtggcattctctagctaagatgtcaaattccatgctctaccaaggcaaaaggagcctgaaactgagcatgggggcaggtctgcttggttgtaaaggagcagtgaaggggttggctctattgcttctgatgcaagatataggtcacccccaagcagaggaacctggaaaaaaagacaagtggctgaggttgatggaggtggtggcagcgaaggaattggagtaagcacataaaaaaattggaggaggcacataaaatgtatcacatacagaaatgttgtctgttgggattcaatcagaatggtggcagaaatattagggaaagttatagggaatagtcacaaaccttttggaaggccgaaaggttacatagcttgtaataattgaacaggctgaaggcagctggtgcttaccttagagcattaggtcatagggtaaatactagggacaatagaggcttccccagttaagtctgtttaccctacctccattaactaacctttgagccagatggccctctccgggggaggtcaactagggatgttgccccctaatggtatttatttcagaccatggtacctgagttttaatcattctgagaactactctcttaaccatgttaattacccacaagtgtgttgactcagagcttctgttgttaattgtatatgaaataaatgcctggagtgcaagctgctcagggctggccgcagtgacaaacctctcttggtgggcaggcggtcagacactcagcaggactggcaaaatagaatatctgtgtgtcagtgtacgttttattcatccgtcatttgggtcagggtctgcgggcagagccccgcagctaatgccctcttgtgagaagcaatacctcagttgtagtattgttattttaaagaagtctactagttacattgtcagtagcattaaatgtactaaatttctgatttctttctcttccccctaccatccctgttgacatgttccatcccaggtcctgagccaatttctatctcaggagtgggttccagaggcccatctgtgctgaccaccagtctcccatgtcctacttgcagtctaatgagtaccagtctgatgctggatctgttagccctggctcctcatttacattgtaaccacccaatgggttctccttgcctgctgcctagacagagccaatttatcaaaacaggggaattgtaatagagtttaatttatgcagagctggctgtatgggagactcgagttttattattacttaaattagtctccccaagaattcaaggatcagagtttttaaggataatttttcaggtaggggctggagaagtggggattgcttattggtcaggttggagatgaaatcacagagggtaaaagccatcctcttgaactgagtcagttcctgggtggaggccacaagaccagatgagccagtttatcatctggctcctggcagctgatccatccaggatacagggtctacaaaatatctcaagcactgatcttgggctttacaatagtgatgttatctccaggagcaatttggggaggttcagactcctaagccataatttctaatcttttgtctaatgtattagttccgtaaaggcagtcttgtccccaggtaggaaggggatttgttttgggaaacagctgttaccatctttgtttcaaagttaaactataaacagagttcctcccaaagttattttggctcatacccaggaataaacaacaatggcttggaggttagaagaaagatggactccattggataagatttctttcactgtcattattttctcagtattaatttttgcaaaggtggtttcagcatgatccttctttgtgatacatttatttctgtcatgtctgtcccagcactcaggcatagatttctactttatttcttaacagcctagtttgtttctgccagctccctccctgggtactggtacactcttcctgccatccatcattgttctggatagccctaggcccctcaaataggaatctttccctcaacttgggatcctgggtctttaactgtggaattggcgtcttttataccagccttacccatttcttcttttctctatgcgactccccttattttaagcttgcttcttactttagataaccccagtgataactgttacttgatggatatgcctttctcctgctgccctcccatacctatcttctcatagtcagagtctgtactttgtttagttgcaaatatatgccctgtgtactttgtttagttacaaatatatgtcctactaacattctggttttctgcgcaatccaaattctttcctcctactctgcatgcaccaaactacaatgagatttgattgtgttctatgttatttaaaaaaatacactttaagtcaaataatgtaacataaccaattcaacataattgtaatatccaagactgcatatattctttgtccttatagttttaatttattttcaatttgataaatgactcactttgcctttcattgctttatatttatagacagagctggtaagtaaaaaaaaagtgaacttttaaaaagtttcttgttctttctgttaggtcttcagtggtaaacacatgctctacaattatatatttagggaggcatttaatcagaaatttcagtagtcttttccattattttaagtcctagaaaacatgctgtttattggcttgctagcagcacattcatactaatttgcacacttagtaaatcagtctgcaaaaattaaaaataaactctgttcaaaacagaatttatatttaatacaggacaattagagaaagtttatggtattcagaaatgaaaatgcaaaatacaaagttaatttgctgtcagcaatcccttgcttctttccatgtggaggggttaattagaaagtgaaatcttacatcagttgttctctttgggtaattttgtcttcttagaaaataatagaaaacttactatttaaaatgctatcaagctagaactccttgaaaggtcccctcctaatttttcattaaatgacccatgaaggcctacagaaatccgaaaattcaacagcagctagccatttacatgtatcctatgaggaattcccaaaaatgaccacaactgtaggggattatctggaggaacatcactctatcaataatgtatagaatctcacatgagatctggtagtagtggtggcagagatgggaagagtctacgtgagttgtggtgcattttgttgatgaaaaagccaaactctgtgaaatatttaaagaggtttattctgagccaatatgagtgaccatagacaggagaacaatctcaggaggtcttgagaaagtgcctgagatggtcgagttacagtttggttttatacattttagggagacaagttacagggaaagacataaggcaatacatacatgtaatgtatacattggtttggcctagaaaagtcaaacatctcaatgtgaggacagggagggcttattacagttatagaaggattcaaaggtattctcattggcaattgggttaaagagttaagctgaagacttgcagtcctggaaatctgcttggaaagaaatgcttgagttaagataaatggagttgtggaagccaaggttcttgttatgtagatgaagcctccggatagcaagcatcagagacaatagatgctaaatgtctttttttcagaccttagaaggtatcagatgcttagttaatctctcctggatcaggaaaggccttagatgcattaatgaagattctctacagatacaaaattactcccacaaaagacagaagatttgcagggccatttcaaaatatgtcaaagacatgtatttgggggtaaaatgattttatttcattcagggtttgttatttgccatgtgatgctataccagagtcagtttggaatatggtatcttattgacaaaaagagtctgtttcatcagtcttatgatatctatttaatcttaatgatggtcaattgtgtctaaactccaaaagggagagggtataacaaagcatgtccaacctccctttccatcatggctggtaattcaatgtttcaggtttcccttggcccagagggggtccgttcacttgcctaagtggttggggttatatttttggctgtaatattattggtgggacaagagtttattgtgaaaggaaactaaatcttgaggtcccaaaatcactatgctaaagggaaaagtcaagctgggaactgcttagggcaaacctgcctctcattctattcaaagtaacccctctgctcactgagataaatgcatatctaattgcctcctttggagaggctaatcagaaacccagaaaaatacaaccatttgtctcttatctacctataacctagaagccccctcccctcttcgagttgtcccacctttgcccaccttttcggactgaaccaatgcacatcttacacatattgattgatgtctcatgtctctctaaaatgtataaaaccaagttgtgccccgaccaccttgagcacatgttgtcaggacctcttgagactgtgtcacatcacgggtgtgcatcctcaaccttggcaaaataaactttctaaattaactgagacctgtctcagattttcagggttcacattattgattataggttgagtaaaaccaacgtggaaatccaaaatttgaatgttccaaaaccccaaatgctcaaaatcagaaacgttttgatcaccaacatggtgccacaggtggaaaatttcacatttgatctcatattaggtcacagtcaaaaggcagtcaaaacttgtttcatgaacaaagttacttaaaatgtcatgtaaaattaccttcaggctatgtatataatgtgtatatgaaacgtaaatgaatttcctgtttagacttgggtcctatccctaagttatctcattatgcatatgcgtgtattccgaaatctgaaaaattctgaaatctaaaatacttctggccccaggcatttcagataaggaatactcaacctgttaacacaaagatatatatatatcctgtttgtatatgtatacatatatatgttatatatatatttttaagatgtaaatttttctttagatcattacaaaactgccagggcgtgaaaaaccaaacaaacaaacaagtaccctatctacatttaataggtagatgcttgtttgatacaggaaatgggcccaagggctgcatattgagttacctccatagttagaactaagagattgctgtaaagtaaatatggaatgaggtcctctacaagtgaccacctaagacagataaatttcttatcttactaggagcaaataagaataaggaaaagcagaaataaaatgtctacaattccagaagacaatagaagaatacctaaatttacacgtagatagataggtcatagtgaaaccatagaatggcaaagataagagaaattccaaaaagcaatgagagaaaaaagcagattatttttaaaggaacaaaagttatactgaaggcagaattaccaacagtaacattagaagccaaaagacaatagcattatagtgctgatgaaaattaactaccagtctagaattttatgtcctagtgaactatcactcatgagtaaagatgaaataataacatttgtaatttaacaatgaacttgagaccatttaaaactcagagattttggtaaaagaacaagtagaaggcctcttattggtgaaggaaattgaattcagaagagagaattgggatccaagaacaatggttactaaaataatcagtaaatgtgggtaactcccatgaggatttgactgtagaaataatgataagaataaataattcgggtgttaccaaaacaaagtgagctcaattactagatagcaactttataaggaagggtttgccattataggcaagtaaagttcttacattttagggaccagggttgaattactgtaagatatttttatgtgaagtattagatgttgaatatttggggcaatgaaaagtatagggatagaatgtataatttctaaaccagtagaggcataaatgaaaataaacaaaacttgatgaattcaatagaattcaagaatagaaaagaacaaaataaaatgggataaagtgtggcaaaaaatgagatgttaaaataaacacaaatatatcattaatcacaataaatatgaacagactaaactataaaaggtgatattttcacaatgaaaactaaaatgtagctttatactgtttataaaatttcctggtaaaatatcaaaaaacctataccaggtatttactaatcataaaatagttggcatagatatattaatattaaaacaagtagactttgtggtaaataaagtattacttaattcaaaaagggaaaaatccaacttagagaagaaactttgaaattatttatacctgaacacatattctcaaaatgtataaagccaaaatcaattaatgtgaaaagagaaatgaacaaattctaaattacagtggaagatcttattagacctctctcaataattgacagatcaagcagacagaaggttaataaagccctgctagacttgaacaacaaaattaataagtttttctatagctcttaaggctagcttgactgtgctggtaatgattggccatccttgccatttacatactacagcactctggtatctgtctatgaccttctttccctgtgctttagggcacctgggagaatgtgcacttaacaacttttcagtaacagggaactgcataccagtctgccctgctggcagatacttacaaacttcatgggaaggcaagtccagtgctttcagacatttgaggttggtccggcagaaaggatcacatgacattcttttagcattccaaatacttttcattttccttcctcaattcctacttcccctctcctttatatttatcctctttttttcttcttttcttcctttctttccttttcctttcccctctctcttcctatcactctttgtcttttatcccctaagtattatattattttaaatctccctggtaatagaaaaggaaaagtagttcaacctctttttaaataataaaatgaattttaaccaatattttaaaaattgaatttgtcaataataagtataggtctttattattttaaattattttattgaatattataataaatataacaatttaagcagttagtccattttagaaaatggatttttttcctgagtggaccatattacaaaatttctactaatacaaattttttacaaaataaacactgtaaattttttaactgctgatttctttttttaatgtctatggctacatttcatatttttattaaagaggaaatagtaatgaacagtttttagcgcaaaatcacttttccagagtatttgtgattcagatactcatgtacatgcctacaaaaatataataatataaccaaaatgggaaaaatttcactttacttgtgatatagtttggatctgtgtccttgctcaaatctcatttcaaattgtaatcaccatgttggaagtgggaactagtaggaggtgattagatcttaggggtggtttcacatgaatggtttagcaccatactcttgatgctgtactcaggatagtgagtgagttctagtgaggtctggttgttgaaaagtgtatagtacctccccctactctcttctcttacttgtgttcctgccatgtaagatgcctgctcctgctttgtcttctgccatgattgtaagtttcctgagtcctccccagaagccaagcagatacttccatgcttcctttatagcttacagaaccgtgagcaaattaaactttttttttagttaaataaatttcccagtctcaggtatttctttatagcaatgcgagaatggcctaagagagcaggtaagttagtcttttgacttatacaatagaaaaaaagcctacattgagtttttagcagtagatggcagtgtgattaacaaataggccaaaaaattctctaaaatataattattcatgttttcttataataaatattatacaattatgtatatacatgtaataaatataattattcattcttaattattcattttctgaattaaaagctctgactattgtttgttaataatataccaaaaacaactatagaaggcagtgttcaacttactatattacttaatctcttccatatgtttgatgtgtttttatacaattatgacctattaaggcacaaacaagtctaataaattagttaatcaaattatattctatgaagccccaaaattcttctgaagtgctttggcttatctatagtgaggccatggaagtaaatggggacttctagctcctcattctacttcaaccagattaactccagtttcctttgttttatatgttaattcaattttaaatattgttcatacacagtacgtctaagccagaaaataaaaatttttgaaagctattaatcaaatcccactcattgaaagaggttaagaagtttggagggacgtgtgggttgaaaaactacttattgggtattatacccactacctgggtccaatatacccatgtaaaaattcaatacatgtacctccctgtatctaaaataaaagctaaaattaaaaaaattataaagttaaaaattgttttaaaaattgatgttcttaaatagttgggaggatattaaaataatgcttatgtcttaactttcacaactatttttagatggctttcagttttaaaatcacatgccaaaaatatctgggagggactaccttgtatccatggggggaaataaacccttttctggtattaaaaatatatagagtacatttagaaaataaacttgtggttgaaaaatgaaaggaaaaaaaaagaagttgagtttaaaaaaaaaccttaagttgtttgcttaaggtcacacaatgtagaattggaaccaaaactgaaaaaaagtgttttaactctcagttgattttatctttttcaggtcacaagttttatacatgtatgtttctctgcagttagggaattgtagattattacagtaaaagcccaagtggatcatatctgcctttacacaggttttgtatagtctccctttcctcgttgacctggttgtggccatgtgacttgctttggacaaaggatcatttaggaatgggaaagaggcagatatttgatagcttcttttacattagtctcttttttgctgctggtaattcttctgtactctatgaaaaatgattgggctcatctcatacaggatttgagtgctcatggacagaattcccagctgagatccaaagaccacagtcaatacccagtatatacacaggtcaaaatacccaggtagtaccatgtggagatgataagctgtcctaaatgagctcaggccacagaattatgagcaaatgaatggttgttgctttaaatcactaagtttttgggtagtttgttatgcagttgtagctgaacaaaacaatggtattgattttttgttccaactatgacctattctaggatctgaacatagtatatttttatgggttatttgaaaaactgtagatagcactgatttcttccaataaccaaagttaaatgaaatgatgtagtctttacttcaagaaattctttctttatgtttattttcttcagtaattgtaatttttctgtaaatttacatatattcggttatctttaaatatagaatcttgacaattgccacacttgtaaagaaaagatacaggttaactacatctgagttgagtagggatggaagggacagatccagatagtccctaacatttgttatgcccaagtcaagagtacaaatggaaacccacataacatatgtctaaattttaaaaacttacaaatcaaactaacacatttcaaaatagaatacattctattattccattttaacaaatctaaccttataagaaccttgaagaccaagtttgaatttagaatttttggactcctcagagttttgcactagaaaatgacagcacagggtagctgggtgctagtcaggtgcccacatcattgtcttctttcaactcttacatgcactctaatggttcttatgtttaaacatgtggatatgtcagcccacacacttactcttggtccataccctcctaatagtgacctcttagttactgcacagttctaggagtcttctaccaagaggactgacctagggaagagtcttgtgaaagcactgtaaacaggatcaaggaactatggattgtgaattataatgtctcatgaacttgaaccatgggtggggctgggatccatagagatctgtcccattgggcccatgtacttcttgcacgtgcagagaggcaatgccagaggaggatcagagtaaggccctagaaagcatgagaccaggacaggaacctctctatcctgggatttagggcatgtgttaagctaggtaattccaaagcagaccctgagatctggtcttgagagcaagtagtttgagaggtgatcccaaagcataggtaggggagtaggagactgcaaagagaagaaaccaattccagggattttaattatcaggttatcattgcaggcaattgggactcagtcccactgggggcctctggaagttggtgtcaaattcacctcagagttcttctaaccaaagggcaagaaaacagatttttttgttcgtttgttttttagcaattttgatcaatttttggtttggtactgctcctgcaggcttttactaccacttctggatgatctatgtgagaactgagtaccattctttgtctagagagaactttcaaggaggaagtcacacatatccataaatccatgccctttaaggcatacttaaaggggacatgtcaaggcatggacagcatttgctacagtccagaattggaaatagatttaagaaaacatgtcccattattatatgatggcacaatgtgtccagtaaaatttccaaatttctgaagatcaaaatggtttctacctctgctagtttacatctgatggggacgcaaatactgtcaaataaatatcttaacccagaagtttttaaatctcttatttataatatatatcacccctacttatgtttcttatacaacttaataaaattattttggatatttaaaaatgaaacagatattgatttataaatacatcatcaaaattaaaattataatttccacaaattccactattataatgatttactttttggatttgtaagagagaggggctgacattgtgtagcccttaaagtccttgctcataaacatttcatgagttggaaaatgtacacttaagaatgtctttggctttaactttcagactcagcaatcattaggaaatgaacattttttttggaaaaagaaatgtataacataaagcttttgacagaaattttatacttgaacttgtgcgttgcaatgattgtgtagcattaaatagcaagaggtttttatctttgatgaaaacaatagatattctgcaattcttaaaattgtctgaacagtttaattcttatataaataaaataaacgtaaattaatagaattctatttaaattacatattctaaatatttttatttcattctcttcatccaagaaaaaaaaatgagttctgtttatgcctgttattaaaacaacaaataattttctgtgctgatttgttctattgagattgccacaacacaaatacctctctcaggataaaagtaatcaattaacaacagatgataaaatgtgcctggagtcctttttgccaagaaaaaaatgtgttctaaaattaggtttatgcttgaataggatggaacaaaaataacattctgagagcctttgagagtaactgttttctcctcagaccagctgaagtcttgaacttgttggatgtaatacaaatttcaaatattatccattatcagcatgttttaatatgtactattcaatgtagcattatacattatatatattgtattacatatagcaacatagacatggaatatatgctatataatattcaattaatataagatatgtaacattacataatgtataatttataacacacacataaactcttgtttgataaaggatttagggtagttaatgttcttgcatagaatgttcttgcgtataaatgttcttgcatatcttggcatatacatttcattgtatttgaaaacaacatgccacctttcacatttgaagtgttcactttgggagaattaaaattgtagccatttaatgtcataatatgtgtctggccaattgattgatatgcttgatttgttttcttggtttcagagaacttccttgtacagaattaggcgtcagatgtttttaaaatcatttgttgtttgttgactatttaaatagtttggcattaactatgaaacttttattatgttcttatactgcattctactttagggttgccaaatttttataactattttctcattttatggatgccaaggaaatggtgaccttcagagaaaaagtggtgttgcctgaaaggaaagaatgagaatagatagctcaacctagcgtaagaagtaaaattagctagtagcttaaggtaaatgttgtaacggggtgttatgagaagtattaattacacatgcacttttctggttcccttggttattagctatgaaaaaattatttctatctgctggccaagttgcaaattattttgattgctgtgagacagagcacctctaagtcatagaaatgtggctgacagtaaagcccatctaatattgcatgtatttccttctatctcagccccctttctattaggtagagtcacatagctgggtctggccagttaaatgtaatgtttatattaattttgagctgaaaactgaaaagtccttgagcaaacttccagccattccttttcccctgacctctcagccaaagagcagagacatttcttatggtacaaatgcaagatggtggtatctttcacagtatggagtcctgagtgactttgaggagcacactgttctctgaccagtgcagtatatatactctaattgataaataagcttgcatggtaagccctggagatttagaagtattgtgttatcccagtgaaacctattctaggttatgcagtacaatttaatacaataatattaaatattgcttaccaagatgaattttaggttttatatgattttaaatgaactgttttaaaattattttgatagcttcagatggatctgttccacttcctttgcaatttcttcctctccaatctggacgctacccttgtaaaattttattgaaatcaaggtatgatgtgcgtgcctattatgttgaaggtattgtgaatgaagaacaaccagaggccaaatttgagtttgaaacaccagcatttgaagcccttactcagaatattccaatagtatgtataaacttttttggtacctttctttattcatattgccactgtgtcaattaaagtcctccagacctctcatcttggactattacaaatttctgactgtcttatctgctgtcaattatttcttcatatttatgtcagaatctcttcctaaatataaatgttattatgttactcatctcattaatcacttctgctggctctttgcttaaaacaattaactccaatgtccttaatgtatcattaaattccttcttgcttcaacaagcagagttatggactctcaggtcactctactctaaattctgttgtgatctaacacttggttaagatgggttcataggcactgagaacaatgattgcctgtagcttggctacctattagtcaaagtgacaatatagtgtaaaagaaggtaagataattgtaaagaactttggctttttagagggataaattgccttttttggtttatttgtctaattattaaagacatgacaaaagtcaatctgaagcacaaaattttgttctgatgagatatataatctttgctatgtgagcaacataccaggtagaatgacaattattaccttgaattagaagtaaagtgtgtcctctaaggccattttatcatcttaatggtaattagtaagtgagacaaagggaatttctttagatattaaatgatccttcgatagatctattaggcaatgctcttatgtgacatagaaagaacatgtagtcatcattatgccttatgtttacatttttgatatttattctttttttattttattattattatactttaggttttagggtacatgtgcacaatctgcaggttagttacatatgtatacatgtgccatgctggtgtgctgcacccattaattcgtcatttagcattaggtatatctcctaaagctatctctcccccctccccccaccccacaacagtccccagagtgtgatgttccccttcctttgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttgggcatttgggttggttccaagtctttgctactgtgaacagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatgccattctaactggtgtgagatggtatctcattgtggttttgatttgcatttctctgatggccagtgatgatgagcattttttcatgtgttttttggctgcataaatgtcttcttttgagaagtgtctgttcacgtccttcacccactttttgatggggttgtttgtttttttcttgtaaatttgtttgagttcattgtagaatctggatattagccctttgtcagctgagtaggttgcaaaaattttctcccattttgtaggttgcctgttcactctgatggtagtttcttttgctgtgcagaagctcttgagcttaattagatcccatttgtcaattttggcttttgttgccattgcttctggtgttttagacatgaagtccttgcccacgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaataaggaatcctttccccattgcttgtttttctcaggtttgtcaaagatcagatagttgtagatatgcgacgttatttctgagggctctgttctgttccattgatcaatatctctgttttggtaccagtaccatgctgttttagttactgtagccttgtaatatagtttgaagtcaggtagtgtgatgcctccagctttgttcttttggcttaggattgacttggcaatgcgggctcttttttggttccatattaactttaaagtagtttttttccaattctgtgaagaaaggcattggtagcttgatggggatggcattgaatctataaattactttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggccgagacaatggggttttctacgtatacaatcatgtcatctgcaaacagggacaatttgacttcctcttttcctaattgaataccctttatttccttctcctgcctgactgccctggccagaacttccatcactatgttgaataggagtggtgagagagggcatccctgtcttgtgccagttttcaaagggaatgcttccagtttttgcccattcagtatgatattggctgtggatttgtcatagatagctcttattattttgagatacatcccatcaatacctaatttattgagagtttttagcatgaaggattgttgaattttgtcaaaggccttttctgcatctattgagataatcatgtggtttttgtctttggttctgcttatatgctggattacatttattgatttgcgtatattgaaccagccttgcatcccagggatgaagcccacttgatcatggtggataggctttttgatgtgctgctggattcggtttgctagtattttattgaggatttttgcatcaatgttcatcaaggatattggtctaaaattctcctttttggttgtgtctctgcccggctttggtatcaggatgatgccggcatcataaaatgagttagggaggattccctctttttctattgattggaatagttttagaaggaatggtaccagttcctccttgtacctctggtagaattcggctgtgaatccatctggtcctggactctttttggttggtaagctattgattattgccacaatttcagagcctgttatcggtctattcagggattcaacttcttcctggtttagtgttgggagagtgtatgtgtcaaggaatttatccatttcttctagactttctagtttatttgcgtagaggtgtttgtagtattctctgatggtagtttgtatttctgtgggattggtggtgatatcccctttatcattttttattgcgtctatttgattcttctctctgtttttctttattagtcttgctagtggtctatcaattttgttgatcctttcaaaaaaccagctcctggattcattaattttttaaagggtttttttgtgtctctatttccttcagttctgctctgattttagttatttcttgccttctgctagcttttgaatgtgtttgctcttgcttttctagttcttttaattgtggtgttagggtgtcaattttagatctttcctgctttctcttgtgggcatttagtgctataaatttccctctacacactgctttaaatgtgtcccagagattctggtatgttgtgtctttgttcttattggtttcaaagaacatctttatttctgccttcatttcgttatgtatccagtagtcattcaggagcaggttgttcagtttccatgtaattgagtggttttgagtgagtttcttaatcctgagttctagtttgattgcactgtggtctgagagacagtttgttataatttctgttcttttacatttgctgaggagagctttacttccaagtatgtggtcaattttggaataggtgttgtgtggtgctgagaagaatgtatattctgttgatttggggtggagagttctgtagatgtctattaggtctgcttggtgcagagctgagttcaagtcctggatatccttgttaatcttctgtctcgtagatctgtctaatgttgagagtggggtgttaaagtctcccattattattgtgtgggagtctaattctctttgtaggtcactcaggactggctttatgaatctggttgctcctgtattgggtgcatatatatttaggatagttagctcttcttgttgaattgatccctttaccattatgtaatggcttctttgtctcttttgatctttgttggtttaaagtctgttttatcagagactaggattgcaacccctgcctttttttgttttccattggcttggtagatcttcctccatccttttattttgagcctatgtgtgtctctgcccgtgagatgggtttcctgaatacagcacactgatgggtcttgactctttatccaatttgccagtcagtgtgttttaattggagcatttagtccatttacatttaaggttaatattgttatgtgtgaatttgatcctgtcattatgatgttagctggttattttgctggttagttgatgcagtttcttcctagccttgacggtctttacaatttggcatgattttgcagtggctggtaccggttgttcctttccatgtttagcgcttccttcaggagctcttttagggcaggcctggtggtgacaaaatctctcagcatttgcttgtctgtaaaggattttatttctccttcacttatgaagcttagtttggctggatatgaaattttgggttgaaaattctttttctttaagaatgttgaatattggcccccactctcttctggcttgtagagtttctaccgagagatccactgttagtctgatgggtttccctttgtgggtaaccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggctttgttcatttctttttattcttttttctctaaacttcccttctctcttcatttcattcatttcatcttccatcactgacaccctttcttccagttgatcgcatcggctcctgaggcttctccattcttcacgtagttctcaagccttggctttcagctccatcagctcctttaagcacttctctgtattggtttttctagttttacattcgtttaaatttttttcaaagttttcaacttctttgcctttggtttgaatttcctcctgtagctcggaatagtttgatcatctgaggccttcttctctcaactcgtcaaagtcattctccatccagctttgttccattgctggtgaggagctgcgttcctttggaggaggagaggtgctctgctttttagagtttccagtttttctgctctgttttttccccatctttgtggttttatctacttttggcctttgatgatggtgaggtacagatgggtttttggtgtggatgtcctttctgtttgttagttttccttctaagagacaggagcctcagctgcaggtctgttggagtttgctagaggtccactccagaccctgtttgcctgggtaccagcagcggtggctgcagaacagtggattttcgtgaactgcgaatgctgctgtctgatcgttcctctggaagttttgcctcagaggagtacccggccgtgtgaggtgtcagtctgcccctactggcgggtgcctctaagttaggctgctcgggggtcaggggtcagggacgcacttgaggaggtagtctgcccgttctcagatctccaggtgtgtgctgggagaaccactgctctcttcaaagctgtcagacagggacatttaagtctgcagaggttactgctgtctttttgtttgtctgtgccctgcccccagaggtggagcatacagaggcaggcaggcccccttgagctgcggtgggctccacccagttcaagcttcccagctgctttgtttacctaaacaagcctgggcaatggcaggcgcccctcccccagcctcgctgctgccttgcagtctgatctcagactgttgtgctagcaatcagcgagactccgtgggcgtaggaccctccgagccaggtgggggatataatctcctggtgcgccatttttttaagcctgtggaaaagcgcagtattgaggtgggagtgacccgattttccaggtgccgtctgtcatccctttctttgactaggaaagggaactccctgacctcttgtgcttcccgagtgaggcaatgcctcgccctgcttcggctcacacacggtgcgctgcacccactgtcctgtgcccactgtctggcactccctagtgagatgaacccggtacctcagatggaaatgcagaaatcacccgtcttctgcatcgctcacgctaggagctgtagaccggagctgttcctattcggccatcttggctccagcacatcgatatttattcttaacaaatatgactttccactggtgattccttggaaatacaattaaaaatacaatatataatgctatagaaattaccaagaattcatatgtaattcaatttcatcaatatcatctctctgatatttctgtacctttttcatgctttagaaaaatcaaacaaacgataaatggacctttcaagttactatagaaggagaatggttttatggacctgttgatttacatgttggaccagatgaaattgtggagtatcctctcacattcaaacctatttttgaatgtgtcattacggtatgaactccttgatattttccccagtattaattaatagtatcattagttaataaactaatgtatgacattagtcttttaattgatagtacaactgtttagtagaaaagttaatattttccatgaatttgactatttttacttaaaactttaatacatgttttaatttgaggcataaacatcatgaacataacaatatttttgtctgtgaatactagcattcaaattaattttgtacaacatgctgaacaaagtaagataattacttttccttcctattcattaaagaaattggtgtatcagaaaatactttcttaagacaatatttcttttacatggaagtagacatgcatataattgctgtgtatgaaaatacctatatacactctgtaatttagcaagggtaatcagaaataaatgacttttcaccagaaatttgtctttatgtgttttgtagaagcagttatttgtgtattgaaaaagtcaatggctaacacctctctacaagctctttttattaatcagacacaagaagaataagatagcagaggttgtttaacatttatctatgactcctatagacctgaaatttgtctggtttctcatagggtaaacttattctacaaaatgaagtagatggtagggagcacatctttgacataaaaggggttgggaaaaaaccttcggccttggaacacatcactgtggaatgtcaagtggggaatgtgacacaaaagcatataacattgcctcatttcacaaatactgccctaacatttaaggtaagaatttatttttagtgtgaaagtgtttttttctgaatatagtgaatcacatgaaatataataattacaaacaattttttaaacatttagttttacttaatcagttgaagcaatgtcacataagatgtctacaatcctacctattattagtccaacagcttttaaatatcatttcaattataaagttgaattaggatgaaataagtcttatatgtatataactataaagcacattaaaatctacttatttgagtcatgtgcttttcattgaaaaaattgtacatgataataaatggtgttttcaaaaatatttagaaacatcttttaaaattttaatgtgaaatctgtaagcaaaacaaaatttcagaagtgtagcctatcatttaccagtgtaaataatggtggaaatattaaggaatgcataattgtttacacccttttacttatttattttttgttttaggttttatttattttattttattttattttattttttgtctgttgctcaggttggaggccagtggtatgatctcggctcactgcaacctccacctcctgggttcaagtgtttcttgtgtctcagcctcccaagtagctgggattataggcatgtgccaccacgcccagctactttctatattttttgtagagatggggttttaccatgttggccaggctggtatcaaactcctgggctcaagttatccacccaccttggcctcccaaagtgctgggattacaggcatgagccactgcgcctggcctatatccttattttttatgaagcattatactctgtcatcctcacttggtttgtttaaaccaatctttaaataacattttccactcactcctacaattacccacaaatagttatttgctcaataggatcctcaaaagaagcttcaaatatctacccattataggtgcctgaattcaattttagaggggactacagaagtttgtaaattctctgggtttactctttgctttttttgtaaccctgataaatatgtgccttggttttcctcttctttttttttgctagattgcaaatggaattaatattctaaatgaaactcttatcttctcatgtccgagtaaaattattcagtgccatctcttaccttcaaaatcaaaacctagtcctttgcccatttttttatagggatatctggattttaatgtctttttttttctgttgagttgtgttttccttatattttatgatatggtttggttgtgtccccacccaaatctcatcttgaattgtagctcccataattcccatgtgtcatgggtgggacctggtgggaggtaattgaatcatgtgggtggatttttcccatgctgttctcgtgataatgaataagtctcatgagatctgatggttttataaagggaagttcccctgcacatgttctctctggcttattgccatgtaagacatgtcttttgccttccaccatgatagtgacgcctccccagccacatggagctgtgtgtccattaaaaatctttttctttataaattacccagtcttgggtgtgtctttatcagcagcatgaaaatagactaatacattttatctattatcctcatatcacctatgtaatttgcgaatattttgtccattccttaggttgccttacatttcattgattgtttcctctgctgtgacctctgtgaactcaagggccagtaacatgtgaagtttgacactgttgacctaccttcttaatgttattcaccctttattttatattattctacatttcttgtttccttgacattaattccttaacattggattatcaagtgataatcaaaccttgattattacttatctggtccgtttattcctctaaccttctgatttcaagtttcacgcatcaaaagcatccttatttctgtatgacctcccacttggcagtttcctggcttcaggctatcatctaaatacaaataccaaattcatacttttattcaagatgtacatgtaagctccagcccttcattttcaactccttgctataccactccactttgataatctgttactatagactagactcagcatgttcttttaaatgttttccttgttcaatttttcattggtgctagtaactatttttatgatgctttgtatttttaaaaagctttttaatatacatttcatttgattgctgaaggttgagacctctttaacatgaaagagaaactaaaaactagagaacataaatgagatataggtaaaatgctatagaattttatcaaattaacaaagtagtagaaaataattatataataaagaagacaagagatgtgggacttccacgaaggtgaagcaagaaggtttgtaaattcattttttaaagaaaagcaatgaaaacactggcaaaaattgtcaaaatcgaatttttcagtgatcttgaaattaaagacttgaaataatctaagaagtatatatttaagaaaaactcggaattctggaaagagcaggatggtttgtggcattttaacttgaattattcttatccctctctctttagctctgcagtcttgcaactgtagtaactatgaaaaccagcagctttgcagtcaaaagaagagacagtgtatggattactatttgacctttttccaagtttgctagcagcatcccactaggaaggcattatcattatttgacttgtctcagagtttgctctgatggataggtcctatccttagagcatttgtcaaaaatatttagcagcaatggtttaacattgcagttgtctgaggctgcaataacaatagcagctaataagagattggctaaaaacttgaaaggaagatctggaatataagatgcccttaggggattttagaatctctggtatattcctgggaaacaagcaggccgcacggatgttcaagattgtgtacatgcctgagagagtcctaatttttcacctctggctgatacagacactgtgagagctgaaaattaaggctaaatcagagttttaaactacttgagtacttaaagtatacaacaacacatatacagtactccttgtcaaaggatagaagatttattggttctttcaccgtttatagaaacctgtggcaaattactgctgaccgctaagccaactaaatagagcttcagtgggcacatactataatgaatacagactttacagaattagttcagaaaagtcactaaaccataaaagaacaaaacaacaaaaacaagaacaatgaaaacaaaccattaggaggggatgatctgatttccaaagtggctatattaccttacataaaaagtagttttcaataagaaattaattatgagatgaagcaaaaggacaaggaagcaaagaaacaggaaagtatgaccaatgcacaaaaaataagcaattgttagaagctgtctctaaggggacctacacgttgaattactagactaagactttaaataagcctttgtaagtatatgcaatgaactaaaagaaatcccatctaaagaattaatgaaaagtatgacaatgatgtttcaataaatatatcatataaatatagttataaaaataatgaaaaagaccaacattctggtgttgacgagtacaatgagaattattaattatacagcctcaacagtagatgtaagctggcagaagaaataatcatcaaactttaatatgagtcaatacagattgtctagtctggggaagaggaaaaaataaagaaaaatgaacagaactttagatatacatggaacagcatcaagcataccaatgtatgacttacagtagttctacagaagagaaatataatggaaaagaaatagttttcaaagaaataaaggccaaaaaagccccagattttattaaactttaaaccacatatccaaaaagctcaaccaacttaaaaacagcatcaaaaaaattactgtataggtgaatagaatatacaacataaatatatgctagatgtaactgcttttccttctaggtcatttaaaagaaaaaatggggagggggacaatacggccaaatagacacagccaagaactgctgttcccattgatagagacaaaaatatccagtaagccaacataattagagcagatcttcagagggaaaacaccgagagtggattgagaggcaactcagactctgaggctgaaggaggaggaagctggaaaccctacatggggtacctgagtgctagagatagttcctggccccaaacaacttctggggaagggaagagtgaaggaactaaggtacagcttattctcactgcagacctttaggataccagctacagaggactccatgtccccatggatgtttgagctgagaaagagatgttttcagaaagtaggcagagacaggacttcagctaacatggagccaggggctttcctgcatgaagcagctctgttggagtgcagccgtaagtgtccaggccccagggatccccatctcccttctagaagctctagccccagctgactgccaggccaagagagagcaagggcagcttccagatggaactggggcacatttattctgtacgccctactgctagccagcatctcccagggcacctgcctggctgccccacagaagtgtgtgcacaatacagcctacactctccaggctgagtgctttgctccaactgagtactttcctggcaacctgggagcacttcagatccctgagagcagctggagcctgacccctagctgtgggcctgtcatgatgccttagggttgcatcatgcagctcaggagtactgagccaatatctttggccagcactcaagttgaagaggagcccccagtcttagagcactgagaacagtgagacacattagtccatcagctggtgtgggagtgggacattcctttctctgcaaggccagtctagaaacagtgtggcctacctgcctgctgcagcctctgcccaagtgagccccctggcctggaacgcctaacaaaagaaatgtgggtgcagtgccagtaatcaaatggggctcctctaaggcccagaaatcgacctggtgagagtgtcatctcttccccaccctctcccaccacagagcacacatgcaaacatgagaaaaagagtcacgtggctgtgtaagagcttatctaccagtcattattcttaagcaccatctactggatcacagcccaaaagacagcccccaaaatattctgctaacatacacccctgtgaaaccaagggcaagaattcagcctcaaataaatattgtttctgaaaacatccacaaacaaagcaaactgactatacccaaattacaccacagttaaaggaaaaccaaccctcccagataagaaagaatcaatgcaagaactttggcaattcgaaaaccagagcgtcttcttacctccaaatgagcccactaggtctccaggaatggttcttaaccagactgaaatgactgaaattacagaaatagaattcagaatctggagggcaaggaaacttgacgacattcaggagaaagttgaaacccaatgcaaggaatccaataaaatgatccaataaaatgatccaaggagctgaaaagtgaaataaccattttaagaaaaaaaccaaactgaacgtctggaactgagaaatttactacaagaatttcataatgcaaatggaggtattaacagcagaatagaccaagctgaggaaagaagttcatagctcaaagatgttctttgagtcaactcagtcagacaaaaataaagtaaaaagaattttaaaagttgaacaaaacctctgataaaaattagattatataaagagacaaagcttgtgactcattggcattcgtgagagaaggagagaaagtaagcaacatggaaaatatatttgaggatatagtccatgaaaatttccctaatcttgctagagaggttgacaagcaaattaaagaaatacagagaaccctggctagatactatacaagacaactatcccaaaggcacatgctcatcacattcaccaaggtcaatgtgaaagaaaaagtcctaaaggcaggtaaagtgaaaggttagggcacatagaaaggacacctgatcgtctaccaatagatccttcagcagaaaccttacaaaccagaagaaattggtggtagtggtgggctattttctacatccttaatgaaaggaaattccaaccaagaattttatgtcccacccaacaaagcttcataagtggagagataaaatctttctcagataatcaaatgctgagggaatttgttactactagatgagactgacaagaagtcctttagggagtgctaaacatagaattgaaaggacacctgcttccacaaaaacacacttaagcacatagcccatagacattataaaacaactgtgcaaccaaggcttcataattaccagctaacaacatgatgatagtatcaaaatttcacatatcagtactgaccctaaatgtaattggactaaaaaccccacttacaaaacacagaatggaaggctagattaaatgacaagacccaattgactgctgtcttcaagagacccgtctcacatgtaacaatacccacaggctcaaagtaaaaaggatggaaaaggatttacatgcaaaacaaaaagaaaaaagagtacaagtctctattcttatatcagataaaatagagtttaaaccaacaacaattaagaagaacaaaaaaaggcattacattatgataaagggtgcaagtcaacaaaaaacttaactattatatgtgtgtgtatatatatatatatatatatatatatatatatatatattcaatattcgagcatccagattcatgaaacaagttcttgatgttccaaagacatagacagccacataataatagtgggagacttcaacgccccactgacagcattagacagatcatcaagtcagaaaatttagaaagaagtcctgaacttcaaagaagtcctgaacttaaacttcacacttgtctaattggacctaatagaaagctatacaatggtccaccaaacaatcacagaaaatactttcttttcatctgtgcatagaacatattttaagattgaccacatgttcagtaattaaagcaagactcaatacgttaaaaaacaaaacaaaactcatgcccagcacattctcagatcacagtgcaatagtaataaaaattaatatcaagaagatttctcaaaaccacacacatacatgaaaattaaataacttgcgcctgagtaactgctgggtaaagttaaaaattaaaccagaaatcaaacattatttgaaactaataaaacttgaggcataacttataaaaatctctgggatacagctaaagcgatgttaagagaaaagtttacagcactaaaagccttcataaagaagttagaaaaagctcaaattaacaatttaactttgcacccagtgaaactagaaaaaaataacagaccaaccccaaagctagtattataaaagaaagaattaaaattagagaagaactaaatgatactgagacacataaatccatacaaaggatcaataaaatcaagtgttggctcttaaaaaaataaacaagatagaaagtgcactagctagattaacacaagagtaaagaaaagaagatgcaaataagaacaattgtaaatgatgaagacattgcagtggatcccacggaaatacaaaagatcctcagagactattatcatcaactctatgcagacaaatttaaaaatctaaaggaaattgataaattactggaaacacacaacctgccaagataaaaccagaatgtgaagacctgaacagactaataacatgttccaaaattgaatcagtaataaaaacccctaccaaccaaaaaagccctggaccagatagattcacagccaaattatatcactggtaccaatcctactgaaactattccaaaaaattgaggaggggcttctccctaactcattatataaatccagcattaacctgatgccaaaatctggcagagacacaacaaaaaaggataacttgaggccgatatccctgatgaaagtacacacaaaaatcctcaaaaaaataatagcaaaccaaatgcagaagcacattaaaaagtcaatacaccaggatcaagcaagcattactcctggcatgtaagtctggttcaacatacacaaatcaataaatgtcattcactcattataagaattgaaagcaaaaatcatttggtcatcttaatagatgcagaaaaagcttttgataaaatccagcatctcttcatgggaaacaccttcaagagactaggtatcaaaaaatccatctatgacagacccacagccaaaatcataatgaaagagcaaaagctggaagcattcaccttgagtactagaaaaagccaaggatgccaaatttcaccactcctgtttaacatagtagtggaagatctaaacagagctatcaggcaaaagaaagaaataaaaggcatccaaatgacaaaagaagaacttaaactatgtctttttgcagacaatatggttctacacctagaaaactctaaagactgccaaatggctccaagaaatgataaaaaaactttaatagagttttaggataaacaaatagaagtatgaacatcagtagcatttctatccaccagcaatgttcaagctgagacccaaatcaagaacacattccaatttaccatagccacaaaaagttaaaatatccaggaagacagctaagcaaggaggtagaagatctctgcaaaggaaaatgtgaaacacgctctaagggtacagtaaccaacacagcatagtactgatgcaaaaacaaacacatagaccaatggaacagagtagaaaacccagaaataaagccacacacctacgatcatctgatcttcaaaaaaccctacaaaaacaagcaatagtaaaaggacttcctattcaataaatggtgctgagataactgtctatccatatgcagaagaatgaaactggatccctatctttcactgtatacaaaaattaactcaagattgatgaacaatttaaaggtaggacctcaaactattaaaatcctggattttattagcttgagcacctttctcaacatcagccttggcaaggaaattatgactaagtacccaaaagtaaattgcaacaaatcaaaaattttattaaggatctaattaaattaaagagtatctgcatagcaaaataaattatcaacaaaacaaagacatcctacagaatggtagaaaatattcacaatctgttcatccaacaaaggtctaaaacccagaatctataaggaacttaaatcagcaagcttaaaagaaataagcctgttaaaaatttgcacaggacgtgaataaacccttctgaaaagaagacatacaaatgtccaacaaacatatgaaaaaatgctcatcatcactaatcatcagagaaacacaaaccaaaaccaaaatggcataccgtctgtattagtccactgctataaagaactgcccaaggctgggtaatttataaatgaaataagtttaattgactcacagttctgcatggcttgagaggcctcaggaagcttacaatcatggcagaagacacctcttcacagggtggtgggagggagaggaacaagcaggggaaatgccagatgcttgtaaaaccataagatctcatgagaattcactcgctgtcatgagaacagcatgggaaaccaccctcgtgatccagttatctccacctggtcccggttttgatacgtggggattatggggattatggggattacaattgaagatgagattttgggtggggacacagcaaaaccatatcaccatctcacactagtcagaacggctgttattaaaaagtcaaataataacagatgttggagtggctgagagaaaagggaatgcttatacactgttgttgggaatgtaaattggttcagccactttgggtagcattttggagatttttaaaataacgtaaactgagctaccattcaacccagcaatttcattattaggtatatacccaaaagaaaacaaatcactctaccaaaaagacacatgaactcatatgttcattgcagtactattcacagtagcaaagacttggaagctacccaggtgcccatcagtggtggattggatagagaaaatgtagtacatatataccatggaatactatacattcataaaaaggaacagcatcatgttctttgcagcaacgtggttgtagctggagtctagaattccaaacaaagtaatgcagtaacagaaaaccaaatactgcaatttgtcacttacaggtggcagctaaactttgaatacacatggacatagagataggaacaatagatacacaaactattagatgaggaagggaaggagggggcatgtgttgaaaagctacctattaggtgctgtgcctactacttgagtgacaagatccataacctaaacctcagcatcatgcaatatacccatgtaacaaacctgtacaagtaacccctgtatctaaaataaaaattgaaattattaaaaaacttaaaaattaataattatataaatatcttggcaggcttaaaatgtgtaaagatgtaattggtatgaatgtagtaacatacaggaagactagaaggataggtgcatactggaaaaatatttctgtatgctactgaaattaagttagaattattacaaagcaaattgtttcaaaataagatgctagttataaaacccaagacatcttagaaaataactcaaaaatagagtaaaatatacgaaaaggaatttaagtgacacattagaaaatattttactcaaaatctgacagtaatggaagattacaggaacaaaggtgacataagatatatagataataggaaaatggcagatttcagttttcttgtctgcattatatataaattgtctaaacactcaaatgtcagaaattggaagaatgtatttttaaagaaaagttcaactttaggctgcttatattagacccattttaaataaaatgacaaaaatagtttgaaagtaaaacatataccatgaacatagtttctaaaatagagccaaagtggctggagtatttcagaaatcaaatgacttgagacataaaattattactgcatatgaagagacattttataaagataaaagtgtcaatctatcaggaatatataccaattataagtatatacatgtatatgtatgtgtgtatatatattatcatatattatacacatatcatatatgtattatgtattatatttattatgtattatatttattatgtattatatatcatatatgtattatgtattatattatacacactatcagaagatctacagttacctataaaagataattcaaaaacaagaattatgtagtattaacataaaatatttttctatgctttagaaaaaatatttttctatgctttctttataatatgtgtgtatatatattataacatattatatattatattatattatatattatgatatatttgatatataatataattttattataacataaagaaagcatagaaaagtattttaaaaatatcacatattatatcacacacacacacacacacacacacacaacaacagagcctgaaaagacatgaagcaaaaccaacagaatttaagaagtcagaaacaacaatgttagttggaggtttaaatatcccactgtcaataatgggtaattaactagccagtagatcaacatagatatagaagacttgcaaaaatcaatgagatctaatagacatctgtggaacattccatgtaataacagcagaataaatattcttctcaagcatacatggaatattctcccagatagactatgtcttatagcataaaataaaccttaataaatttaaaagcgaggtaatcatgtacagtatgatttttgacaaccacggaattaaattagaagtcaaaaatggaaataaatttgggaaatccttgaatatgcggaatttaaaacaacatactcctaaataaccaataagtcaaagaagaaatcacaagggaaattagaaaatgatatgagatgagtgaaaatgaagacataattgaccaaaatttaggaggtgcacctgaagcagtgcttaaagggaaatttgtagatgtgcatacctgtagtaaaaaaagaagaaagatgttaagtcagttacctaactttgtatcttaagtaactagaaaaacaagcaaatgaaagacaaggcaagcacaaagaggcagtaagagagagtagagtgaaataaaatgatatggaaaataaatcaatagagaaaaccaataaaaacaaaagttagttatttgaaaaggtcagtaaataagctaatttaccttgactgacagaaaaagagagaatactcaaactactgaattaagaaatgaatatggagacaccactatctacctgaagaaataataattagagataaatactaagaaaacctgtatgcccataaatttgataatttggaaaaaaactgaccaatatatagagttacaaaaactactgagctgactcaagaaggaatagaaatatgatgcacctacaacaagtagagaattagcatttgtaagacttcccacaaagaaaacacagtcttagatggctttaatagtggattttactcacagttgaagaactaatattaatgtttcacaaacacttctaaaaaataaaagataagtaaacatattctaacttccactttgagatcaatattattacctagataataaatccagacagaggcatcatggaaaatgaaaactacagatcagttttccttaggattatagccgaaatactctcaacaaaatattagaaaactgaattcaacaacatttaaaaatgattatacaccaacatagaatatatggaattgtattaccagagtccatggcgatatatggactttccctacactactggagtgtttgaagattcctagaaaagaaaattcaaaaacaagtgttggtgatgatgtggataaaggaaaacccttttaaactgttggtgggagtgtaaattagtacagccattacgataaacattatgaagtttcttccaaaaattaaaagtagaactatcatatgattctgtaattctactgctgggtatatattcaaaagacttgaaatctctatgtcaaagaaatatctgcactttgttgttcattgcagcattattcacaatagccaagatatggactgaacctgtgtccatcaacaaatgaatggataaagaaaatgtgatatgtacgcaatgaaatactattcagtcttaaaacagaaggaaatcctgtcatttgtgacatggatgaacctggaagccattatgttgagtgaagtaagccaggcacagaaaagcaaatattgcatgatctcaattatatgtggaatctaaaaaagttcagttcatggaagtggagagtagaatggtggttatcaggagctgatggggggagttgttggagagatgtgaatgaaaggacacaaaatttcagtttgatagaagaaataagttcaagagaattattagagcttgtgtacagcatggttatgataattataacaacgtactgtattcttgaaaagagctgagagaatagattttttgttcaccacaaaaatgataactatgtgagataatgcatagattaattagtttgatttagccatttcacaatgtatatatatatatatatcaaaacatcatgttgtacattatatacaatttctcatccattaaaagtatgaaaaagtttttaaaagtatgctaaataaaaaagtcagtgacaaaagtccacatcgtactgtttaatttcattactaataattgttcataacaggctcatatgtagagacacaaagtagattattgtttccctgagcagtgggaagtaggaagatataagcacgcagtaaactgaaagttgggtttagccagggtgtggtcaaatgctgcttaaatattttttatttgttttattaatattgatgtagaaatttattgaaatgattcatctcttttgtatatcaaactgcctaaagacaattgtgcatggttgatgagagctattcagactttctaagcatcaatgatcttgatataagtagcaacagaatataagcatcatttgttttgtaagaataatttcctttgttccatttttaaataggtttgttcttagatttctcttctactggatgtagaatttttctggcttgctgttttttaaaaaagtgaatgattttattgggggtatttaaattaaatttcagtttgttctatgctttaacttgttacagtaatttcatgtagtgtagtgtacttattttatgttgatactacataattcttgtttctgaattatctcttataggtaactgcagatcttccaatagtgtggggaaatccacaaattacagtatacccttataaagaaattctgtacctgattcatgtgcgcccttggaaacgtggtatattgaaaggtataaaatccattaataaaatattagtcattttcctactacgctaagatggaaatatgatgagacaaatagaaatgcaatttgtatttccactttctattaaatgactcagaagaaagtttaattttatatttcagtcattagctttctaagtaatcagggctttgatgcatacattttatgtctagtgctatattatcttggccatttattcaaatttatttgtggaacaaatttctataaatgaaaatatttaattaagggtatttacatttaaaatgtgataaatactttcaaatacttatacccgcgtatcaacccaatgacattttaagagaatgtttatttacaggactggatattataaaaacattcacatgcacttacttgatatatgaaaaataagttaaaggtttgatatatgtgaattttttcctttatcttcccttgtctgtaataaagtatttatttatgcagatttccgcaatggtcccagaacagaattacttacatgggaatcggagggagaggtgttcctgttactttttgaagggagaggggtaagaagtgatagaagagtaatagctagtactgagtgattatgattcatcaaaggaataagttgtcctatttgagagaaaattaaattccctatggtagttggatactgttgaggaaattattataatgtaggtaagtggatacaactttagaagtgtagaaagcatatacatatacacatattctttctacacttacatatgtagtggtatctactgctccttggatgtactagcctcacatccctgcttacctcaacaaagtgtttgagggaagggtttatatctagtatagaagcgatagtgagctgctgcaaagaagaaagtgcagagagcatactggatgcctatgctattaaaaagcagaagggaaatttcagagtgccaaccacaatgatccaattattaccactgtaatagaatttatgtaggaagaaacagctgccaatccccattccctgcttctagtgtgcttaacctcaaatgccaacacaacaaaaattgttagcatcttctgaaatcttccccttgtttttgagatgtttagatttacaaaccccattaataagtcctcatttgataggtaggtttgagctataatgtctctagtccaaacatttcaataaagtaacatattttactattttttaggtaatccataagaagtgaattgatttaaagaaatttaagttttagttttcattttaattgtcattgacagtcctagtagttggtatattttccttaattttagagttttaactcgtcttttgtaaaaggcagcaagtcattcagaattggtataattagttttgataaaacataatcaatttcagtttcctgttctgtaggaagcagtgagttctactacttatgagaagaaacacataagaaaccacaaactgtgaaacattgttgaatttggaatgtttataactaccacaaagcccctggtctgtgaatcaaactcttaaagttattggaatagactgacgaaaaattaaataattagatttggcaggcctttcctttgtgtaatcttttttgttgttgttggttttagcagcttttgtggcaccacaatatttcaatacatatttttactattttgatatggactattaacatgttggtttgaaaaaatttggaacatatttggtgaagttaaatgcagcgcaggatacattgttaagtgaggatgaattaggttaatgtttctggctatacaaaccattttacaggcttcataattttgaaaaatatttacaagacgtgatcatgttagctcttcccagggcagtgccttagagttaaattagttgtcccattatgctttggaaaaaacagcctgtaaaagggagcctagctctaatttttattgatattactattggaagacttaaactatagattaaacagtataaatacaattgcttctgaacagctgctaactaatctgaagtgatataaagaaagctagattataaaaatttcacacatatgagaattttcctgcttttgctggttaaagaaccgtgtccatgtatgggtgcatgcatgtgtacgcacgtgtgttatgtatcagatacttttttaaaattttgtgttcattttcaattctgttattgattatataataattatttactaaagacctataatttggaaagcctttataaacatagtagttatgaacaaagctgacattcaactaattatgctttgcttattgaaatattgtaacaactgatcttttcttatatgttggcaaatattcagttgtttgagctccactatcaaataacttttgccagtccagataccacagcccctcacccagaactcttggaacctcccaacaatttagcagctcctaaagtgttaacacataaagcatcaggatgcctcaggacctagatcaggcaggacctagatcaggtgtcctttctggttggtcagtattgggataaagttttgttaattattttgaatattaccactgtatctaaatatgaatatcacgtagctccttcttcctgagaattcacatctggtggtggaaacaggtatccataaatcatctcaatgaaggtatgctttgatatatctaaagtttaattatagcactggggagcctgatggaaggaaatattaatcccaacaatgggggtctgagagggcttcacaggggatggtgggtttgatctgaaccttgaagaatatggcagagggttggggaaactttccagcaggagaaataaccttattgaaaacacagagaagacagtttctgtaaattaaaaagtagatggatgtgtttggagtgcatgtgtgaggtagggagtgcagagtgacatacaattagcaatgcaggtagacattttagggcagagttttgttttacttattgcactgggagccattgaagattgctgaggaggcaagaggtatgagtcaactgagtttgaaaaagggaaatctggaggtaatataaaaaacagacaggaggggtgagataggccagtaagatctgggagatcatttaggggtctttgacaatatccaaggtaatcagttctgtgtacccactcccaaaagcaaaccctaaggcaagagtttaattgcaagtagttaatctgagaggtgatcaggagaatcacactaagtaaatggggaagtgagatgctggagggagaaagccaataagtaagcaagctagttatcaggttactgctgaaaactgagggacctcactgggaccttcagaaagaattgtcatactgaagggcaagggagttggagtacttatctgttaacccctaattgattaaagctttctcttaggtcagaggtctgtaacagtgagttcccacaggcagagttgtaggaaaccactggtgtgtataggaactctctgcaggggggatttttgtgagggcactgacagcatgtactaatgttataccaatattatatttggtatgtttgttggtagaaagaaatgttgggaactggatggatttggaattttcaaggcagcctgcagtgatctacgatcatgttccaagtgtgcctgtgtggaggtttgttttaaatgcctgtttggccatggaaccaaaagtgaagatggaccattctaaatcagagttagggcagaacaaactaggcaatgataatgaattaagaaacagagggacagcttcaagagaaataaagagggaaaatgatgctgtaacaggttgagtttccaggaaatcagattccgagagaggaagttagaatgcaggacatttattagggaaactgttatgagcaacacttgtgggaaaaaaaggtaagaaagtatgtttagcagaggtagaaactgagctttggcgaaggcccactgaaggcttcagccaactcattaaggctcctgaagctgggatggctcttcagagttgtcccgagttgggagaaagagactagaccttcacagtactgtgttgatcagtcattgaaagtgggctacatgtggaaggaggtttgaccttgagtgaagcttttattttttttttcaagcaaggcaatgcataaagagggctgacctgttggccatcttccagcattatatccagtagctatgggagtaagttcctcattcctgaaaagatatatcattagtgcattgtagtgtcttccacagttgtatttgatgaaaattgaatatgaaaaagaaaggagaaagtagagtcaaatgtacttcggacagtaagcaactctaagcaaagtgaaaccaataactgtgagggggaagtaatcagaagggtaagtttactgcttaggaatgaaagcctagttctatctcgacttcaaagttatctttttatgtcattaagttttggaaaaaaatgacaatatagaataagtaaacctagatataaaaacatataaccttaaggagaaacaaacaaatccaagcaaaaatcaccatgtttgcaggtgtgagagagataatgtgttaatgactgaaagcaataaaacacgattgcttaattctttcttttgtaactgtaaaatgacctatctggtatagataaatatgagaatgcaaaaagctattattactgttcattattacaggattagtgtgtaaccaactgtagacacagagtaatggcctgttacttatttgcagtggtgaaatatgcaaataaattttcatttatcttagctagaagctgttttgttttgcacaagactagtatataggtgaagatgagtaggccttagtggtgattatatactttattagtagtaattctcaattttattttgattgcaacaacataatatgattcagaaatatgatttagagatggctgtaaagatgcatgttcacaacataaagcaactaatttgtaatgtagcactagcaaaataacttgtaagtgtaagagttaagactgtatcatttggtataccttacatatcattttcctaataatttgctccagttgttctttaataatctacatagacctcatgtctctggcatgacttttctgagctctgtatgaagacgtcatcaatcagcttagctttttttcagcctgtgaacatcagggttaaactacaactttaaaaaacatgttttacaaacaacaaacagggagatgtgtaaacttgtaaagatacttctagggatccctttctatgtctagagctaggaagctaaataattaatttggggcttggtgatccaaaaatatgtgaaaactgtaccccaaaccatgcaaatgtgagctctttaactaatgattttgctcttatggtccctaaagccaagattccagccactactgagtagcacatattccagaacaaatgtcatctccaatgatgacccactacagtagattcatgctgttttagtttctgtgtgtttaactcaaaattttcagttgagagaggattctctgaatatctttccaacatattataaaaatagaaacccatgaatgtttttaaaggcttttattttattgttaactagtgcagttgattttttaaagccttagtataggacttcataattatctcttgtgaacttctacatgtaagcaacaaatacagtttcatctccaaggaaaaagtttttagaatttcttacagtcatcaatgatgttttatttgtgaacctgaaggacataaaaagagggggtagaactcagtaatcgagtatcttccctttgcccgcaggattgatgaaaggacaacagagaaaggatataacaagaataatttattgaattatgagccatttaagcatatgaacaaaaccaggctagaagactttaatatgttgatcatggcctggtggcctaaaactatctccaaacattacacaacaagaatattttctttttcttttttctttcttttttttttttttaaattgagacagggtctcaccctgttgcccaggtagagttcagtggtgtgaacatggcttactgtagcttcgacctcctggactcagcgatcctcccacctcagcctcccatgtagttgggacaacagttgtgtaccaccatgcctggctgtttttgaatttgtttaacatatggagcctgaccatgttgctcaggctgctcttgaactgctgggctcaagcaatttacctgccttgggttcccaaagtgctgagattataggcgtgagccactgcacctggccagcaagaatatttgcacacagtatgtactttgtgcacttacagtggcaagtctttggattttatataaccctacatggactcagttcactgtagtcaccaaggtgctttaaatatttttactccatactaaaaaactaaatacaaaggaccaaagggtttccagtcatattagtagtcttcatttctaccttgaacattcatgctatagtagtgtgaaattctcttattatccatgactgttagtagcctggtagctgcagcaagtaagtaagaatgatcaattttgattttgtcaaaattcagcttgtattttgtttaatagcaccgaaaagtgctttcttacttgctgaaaaattattgtgttccttaacacaactgtaaactttgtgcttgtttatgtatagagaacattcatttctaaaaatttgcaatttggaacttgctacactggaatgggatctttttatgacactggcataagaaagcttcattcaaattgcaaacaagcttttagttcgcttttgtaaaagatccccaaaccaatagagttagcttgagaaatatgaagttttgtttttattcaacactaaatatatccatagtaggcttattttgtctttacttttataaaacaatttttagatattactttctagaatataaagaaataattttctttacaatgagagctctttaatatttattatttttattctggaatataagccaagctacatttacatatcctgaataagccgtctttgatttttgacatttaattgatgcacaactattttcagggcttcaaacaagaatattgtagcaattgaggataactttacataaaatgtagtctcagtgtgagtttatgtatcttaggaatatgtaatattttctcaaataaatgcagctttttaaaaatgaaaggccaccatcgacatataattatttttctatatttccatgttgcataaataaaagactctggttatgtacctgataccactttcaggctgtagaacctcagccaggttattccatccccagagcatccatttctttatccacggaaatgcaatataaatactttctctatcacctgttgctgtgtcatcaatgggtgatagcactgtgaagcccctaacatagaacatgcagaaggcagtaaataaatattattattttatgcaatttgacacacatcacttcaactaccaatattatccttctctaactgtgtaatcttgggtaatttacttaacctccctgaatgtcgggtttttttgtttgtgaaatatagataatatttagactttcagggtggctatggggattaaatggaaatatatgaaaactgttgatttagtaggtgttcaattaatgtcgattgctcttatttaaaacactaactctcaactctacccatctgctcctcacatttggaaaaagtcatttccaacattgaaaacgatcatttaggggcataatttgcacaaaatcgctgtgtttattaaaatttatcttttattctttaaatgtagcaagtgctagaaaaaaatctgtgtgagaaactggcttagggcatgcatgatacaaatgtaaaaatataccatttacatatagatttgcaaaatatataaatatatatgtatatatgtagtatttgaggcttattagaattttgcttatgattgtcagtttcatttttatgtctcctagtaactattgaaaaatgcatgatttctttattaataataactattaacagcaactacatatacttctctaatcctctaacagtatttgatataggtactattattttttttgttgtaccaagaaggaaactaagtcacagacagcttaattttttaggcacatcgtttgtcaatggcagagctggaattggaacctgggaagtttgactccaaagtatttgctctgcatcactctaccacattgtctctttattaattttttttttgccttttctacttttattttagattcagggagtacatgtgcaagtttgttacatggataaattgcatgttgctgaggcttggtgtgcaaatgactttgtcaccaaggtatttagcatagtacctgataagttgccttccaaccaatgcccttctcccacttttccccctcaagcagttcccagtgtctattgctcccatctttgtgcccatgtctattcaatctttagctctcatttgtaagtgagaacatgtgatatttggttttctgttcctgtgttagtttgctcaggataatggcctccagatgcatccatgttgcttcaaatgacacaatttcattcatttttatggctacatagtgttccatggtgtgtgtgtgtgtgtgtatgtttgtgtaacattttctttattcagtacactcttgatggtcatcttggttggttccatgtctttgttattgtgaatagccctgtgataaacaatatgagcacataaattcttttggtagaactatttatttccctttggatatatgccaaatagtgggattgctgggtcaaatgatagttcaaaattctttaagaagtatccaaactgctttccacagtggctgaactaacttacattcccaccaacaatgtgtaagtgttcccttttcttcacaacctcgctagcatctattattttctgactttttaataataaccattcagattggtgtgagatggtatctcatagagtttttgatttacatttatctaatatttagttatgatcagcattttttcatatatttgttggttacatgtttgtcttcttttaagaactgtttgttcatgtgtttagctacatttttaatggggttgtttgctttttgtgtattaagttacttatagattttggatattagacctttgttgaatgcgtactttgcaaatattttcccccattctgtaagttgtctgtttctcttgctgtgcagaaactttttactttaattaggtcccgcttgtctgtttttggttttgttgcagttgcttttggtatattcaacaagacatctttgccaaggtctatgtccagaatggtatgtcttaggttttgttctagggtttttttatagttcagggtcttacatttaagtctttaatcaatcttgagttcctttttgtgtatggtgaaaggaaggagtacagtttcagtcttctgcatatggctagacaattaccccagtactatttattgaatagggagtccattactcattgcttgttattgttgactttgtcaaagatcagatagctgtaggggttcagctttatttctggtttctctaacgtgttggattggtctatgtgtctatttctgtacaggtaccttgccattttggttactttagccttgtagtatagtttctttttttttttttttttccttttgcaagtaatttatttccccttcagttcactgacagtgtagctgtggctcattttcactgatgtagaggaatagttagtgcttattaaaacacctgctatgtgctgggagcaaatggtttatatttcatatttggttgaacccttaaggccaccctatcagttagatactattcttttttttttttttttttttttttcattgatcattcttgggtgtttctcggagagggggacttggcagggtcataggacaacagtggagggaaggtcagcagataaacaagtgaacaaaggtctctggttttcctaggcagaggaccctgcggccttcctcagtgtttgtgtccctgggtacttgagattagggagtggtgatgactcttaatgagcatgctgccttcaagcatctgtttaacaaagcacatcttgcaccgcccttaatccatttaactctgagtggacacagcacatgtttcagagagcacatggttgggggtaaggtcatagatcaacagcatcccaaggcagaagaatttttcttagtacagaacaaagtgaagtctcccatgtctacttctttctacacagacacagcaacaatctgatttctctatcttttccccacctttcccccttttctattccgcaaaaccgccatcgtcatcatggcccgttctcaatgagctgttgggtacacctcccagacggggtggtggccgggcagaggggcgcctcacttcccagaaggggcggccgggcagaggcgccccccacctcccggacgggtcggctggccgggcgggggctgaccccccacctccctcccggacggggtggctggccgggcgggggctgaccccccacctcctgtagtatagtttcaagtcaggtagtgtgatgcctttggctttgcgtttcttttaaatttttttatttttaattattgtgggtacatagtagttgtatgtatttgtggggtacatgagatgttttgataaaggcatgcaatatgaaataaatcatggagaatgggatatccattccctcaagcatctattatttgtgttacaaacaatccaattacaatcttttagttattttaaaatgtacaattaagttattattgtctatagtcaccctgttttggtatcaaatagtaggtcttattcatttcttctattttgttgtaccaattaaccattcctacctcccaccaaccccccactacccttcccagcctctggtaaccatccttctactctctgtcaccataaattcatttgttttgatttttagatccacaaataagaaaatgcaatgtttgtctttctgtgcctggctcatttcacttaacataacgatctccaattgcatctatgttattacaaataacaggatctcattcttttttatggctaaatcatactccattgtgtgtatatacgcattttctttatttattcatctgttgatgtatgctaacattgcttccaaatcttaaatattgtgaacagtgctacaacaaacatgggagtgtagctatctctttgatatattgatttcctttctttgggatatatactcagcgatgggattactggatcatacagtatatctatttttcattttttaaggaacctctaaactgttcttcacgatggttgtactaatttatattcccaacaacagtatatgagggttcccctttctccacatcctcagcagcatttgttattgcctgccttttggatataagccatgttgcctggggtgagatgatatctcattatagttttgatttgcatttctctgatgatcaataatgttgagaacctttttacatgcctgtttgccatttgtatgtcttcttttgagatatatttattcaaatatttctcccatttttatcagattattagttttttatagagttgtttgagctccttatatattctggtcattaatcccttgtctgatgtgtagtttgcaaatgtgttctctcaatctgtgggttgtcatttcactttgttgatagtttcttttactgtgcagaatatttttaatttgccattgtcttctggcctataaaatttccactgaaatggctgctgtcagacacatgggagctccatcgtatgttatttgtttcttttctcctgctgcttttaggatccttcctttatccttgacctttgggagtttgattattaaatgccttgagatagtcttctttgagttaaaactgcttggtttctgtaacattcttgaaggtggatagtcatatctttctctaggtttgggaagttctccatttttatcccttggaataaactttctacccatagttatttgcttaccttccctttaaggccaataactatctttccaaagacagaggagccccacctgtggctaaaaccactgcaggccatgaggaatactgccaaatgacagccaatgttcctttaaggcccaagggctctcaagtcagcttgtggtgaatgctgcctgacctgggactcacccttcagggcactgggctctcctcttgcccagggcgagtccagaaacgtcatccaatagacaagtcctgaaatcaaggacgccaagagcccctgtggccatgctggtacctaaggtgcaagttgatgtcccttttacttttcactctgcttttctcaagcagccaccctatagccatcacaactggtgatgtgctgagtctcacctgaagccagcaagtctcagaggctcacccaaggcccttgatgtagtacctgggtattactgctggttattcagggcccgaggactcttcagttagcacgtgatgaatgctgccaggactgtgtccttccctccaatgtatctggttcccttctgaccaagtgtgtgtctagaaatgtcgtctgcgagctagggcctagaatgggatcctcacaacattgactgatgcttatcctgctgtggctgagctgctatccaaaatgcaagacaaagtactccccattcttccctctcctttcctcaaggggaaggaaggggtctcttctggagctacgagccttgcagcctggggttaggacttcagtgatgccagctctccctcacccagctggtgtctcagtagatcacgtacaccccccagtccattgtctctgggctagatctagggtttgcttaatgactgcagtctttatagactatactgcctttccagtatatttatagacccaacacagtttatcccttggttgcaaggtttgtaggaactcaagttcagaccactgggattgacaattcccctctggcgaggactggtttaaatgctccctctgtgggtgggcatcagctgattttggtctggttttcctttctgctctaacaggaaagcactgagttaaataccccacaattgctatgcttctcctcctccagcacccagagatgctctccgctcactgccaccattactgtggggtgggtgacgggtgacattggagactcaagactttttttctatttcttcagtgcctctttcagtgacacagatataaagccaagtactaagagggcacacctgatttttggttcttatgaaggtattttttctgtgcagataagtgttaaaatgctattgttgcaggggagataatcagtggagccttctattctgccgtcttgctccaactctcccacctttgactttcttctttttgcttaggattgctttgactatttgggcacttttttggctccatatgaattttaaaacaatttttatttctaattctgtgaaaaatgttgttgagagtttcacagaaataacattgaatctgtaaatttctttggggcatttggccattttaataagacttcttcctgtgcatgagcatggagtgttttttcatttgtggtgtcttgtgatttctttcagctgtgttttgtaattctcattgtagtcatttttcacctccttggtaagctgtatttctaggtagtttatactttttgtgcctattataaaaaggactgtgttcttgatttggctctgaattaggacattttccatgtgtagaaatgctactgatttttttgtgggttgattttgtatcctgaaaatttactgaagtcatttatcagttctggaagccttctggtggtgtctgtgagttttctgagtatagaatcatattgtctgtgaagagattgtttgacatcctctcttctgatttgaatgccctttatttctttatcttgtttgattgctctggctaggacttccagtattatgttgaagaggagtagtgtgagtggacgtccttgtcttgtttcaattctcaaggtggatatttccagctcttgcccattcagtatgatattggctatagatttgttgtacatggttcttattattttgaggtttgttccttcggtaagtaatttgttgagggttttgaatgtgaagtgatgataaattttattgaagaccttttctgtgtctcatatcttaatgtgctttcttgccatccagattttgaattctatgtctgacatttcagccatttcaatctgattaagaaccatttctgggaagatagtgtgatttttttggggggtaaaaagatactgtgacttttagagtttccagagttctgtgctggttctttccatctgtgagggctgatgttcctttatcatttgaaattgctgtcatttggatgggctttatatttttatggtcattattgcccttgaaggtgtgactgcggtacaagttgtgtatagttgaatgacttagtttctggatgctttcagagggccagtgctcaattccacattgctgggctatgtactctatccatgagtgactggtactgggtccatggctttgtccactgttcccttgaggttaagcccaagctgggatggaggagctgaggcactgccagattattggcaacagcactccataaggaatgatgggggcacggtgggtgtaaatgctccagtgggggtggcgagagcactatgagtgggaagtgctctggtgggggacttgggagcaccacaggtgacaggctcttcagcaggggtgccatgggtgggatgcactcgggctgggttgatggtggcaccactgatgggacacactgtgacggggtggcaggggtgccacaggtgggatgcactccagcaagggtgacaccagaaggaagtacttggggaggtgggtggccatgggctggaagtgctccagtgggcacagcatgggcactatttgtaggaggtgctctggcaggggcactgtgggtgggaacccttctggcaggggatgccatggtcagaaagtacttcggtgggacagtggtgatgccgcagctgattgtgacccatagggacagtggtgaggttgcagacaaatgccttctggtgggaggatgtcagcaaaagtgctccagtggggtgacaggaggatctggttaaagtgctatgatggtagatgctggcaaaaaaccttttggtggggtagctgaggctgcactgcgtgtaggcatggcccggcaggaactctgggaggggctgggaggtcagtggggcatgcagatcagattcgccctggtcctatggaaaagacagcccttttctctccaggtctagcagcttacatatgtcagacccacccctttcctcaggagctgttcagggcctggaacgtatcctgccactcagcaatcccatgcatggttcccagcttcctcctccttcaatcccaacatctgggccctctcttcaacctctctcagtgcattctttcagacagtctgcttgacgcatgccatattcctcaatattctgatctgtcttggtgagagaagttcttcctggctgtgtctagttagccatcttgtccaagtctttgacattgaaagaaacttattgaccatagtaccacaggaacagttgagatattatctaatgtaaattttgcttttttctgtgtttttctttctcctcactgttcccttcttaatttgatttgcaaaagccaaaaatgccagatgattatatacacctctcttgacaacttccaaatatgatatgggcatatgggggatttggaacttcttttgtcccctctctatcctagcttatttcagtgaaaaaagctaggtagagtgctatcaatatcttggctgaaactgaatttggatctttttggttttttgccatcagcaatattgactgccatacttgtagacacgaaaccaatcaggtgtcattggtctttgaaaataattattgtttgctataaagtggttcatgttctttttttttttttttttttgagacagagtcttgctctgttgcccaggttggagtacagtggcatgatcttggctcactgcaagctccgcctcctgggttcacgccattctcctgcctcagcctcgtgagtagctgggactacaggcacccgccaccacactcagctaattttttgtatttttggtagagacggggtttcaccgtgttagccaggatggttttgatctcctgacctcatgatccacccgccttggcctcccaaagtgctgggattacaggcgtgagccaccgcgcccagcaaagtggttcatgttcttttaggtgacaggagtgatttttaaaagcaagaccttgaggcattgtggagatcgtatatttggtattattggatgctctcatggtcctttggacatttttcttttcgtttacaattttagctttcccaggtagcctatgctctgatgtttcatgatgctattaccctagagggtttgtgagtactagactttttctttctgactcttgataccaaaatcaagatgagtattaattctatccccaagttgtactcacatgattgtctagacatgaattcatttgtgtaaatagatctacaagtgatgtcacatacggcattttctgcctttacataagatgatctgtcctctgattgctagcctggccttggcctccaggccaatttctggcatacagctgcaggtgtccagtcaacaatgaatagaagaagcaatgcattttcaaaaataaagttgctcccaatatattttaaaagttacttagtattgcgataataagagtacaataaaatatgagaacaaggaagatttacctgcttgaagaaaagtaaatttgaaactgcctatactctgtcatgctgaaggaaagacattcctgcaacttaattgtttgccacgaggtccaacactcacttgtaatttttgattatatattagataaatagttctcactggaagtgaaggctatagatgctctattgaatataaatttgggttactttaggaagaaggttccagtggctgatgaatccacccattatattctagagaaagtatttttcattgaattttgagctactaagatatgcttagcatttttatttaaaaaattaaacttctctctttctttgtgtgtgtatgtgtgtctgtatgtctgtctgtctctctgtctgtcttgcttgctcaatcaaaagaatttgtgtatgttgtggaaagttatttacagtcaaatgaaaatgtgatttggcaggttgttggtttttctcatgtaagacataagaatctcagatatagcagttacataagaatcacagatacaagtgtttattgtgaagtatttcattatatatttttttcaattagaaacttttcaagtttaaaataaccttcaatgataattttctaaatgtcaggatttaagcataatctattgaatttactaattcggtcagataatttttcagaaattctgaacctttagaagaattggctcttaaatcttttaaaatatgtcagtatttcaaaaaggtttgcaaatactgataaacctttgactctggccactctttacgcttttgtgaaaagtgatctccctgttgttattgcatggataaggagcgaaagatacttttaatactaaaattccttttatagctaatgtaaaaataactcatagaaaaaggttacactaaagtgaaagaaaaataaatgaaaactttacacagaggcttagaaagccaccctcctaagtgtagtgaatctaaacaaatggtcagacaattcaatttgataccaatgagacatacttgactttaaggacctaagaggagaggtcaactaacagagattttagatagatagatacaaacaaacacaggtgatagacagatagattacagttctcctggatgtataaatatggtggcttcagtcattattcttcattaattttcttgcacatgacattgcttcgtgttggaaagatccatataagtgactgttaactacacttctgcactttgtacaatacttctgatttggggtgacatttctcaattcctatcatactgctgagcagtgcttgctggaagggatgggcataatttctgaaacatgcagtgtatattttaacagttttattcctgtataattgagatacaataaattgtggatacttaatgtatagattttgagaaattttaacgcatgtatacgcctatgaagccattgagataataagtataactgtcactccaaaaagtttttttgtgcccatttttaatcccttttccccttcccctcatatgctagactacccttgccttaggcaaccagttacctgttttcaatcagtttatatgcatttcaaacattgtatataaatgaaatcatacagtgtgcacagttttatgctgttttattttgtgcaaaataattattctaaaatcagtctacatggtgcctaaatcaatagtttattccttttaatgctgagtagtatttaatggaggatataccacaataatttgtttatccatttacctgttgataaacatttgtttttttcccctatgttttggcaattaaaaatatagctgctatgaacattcaagtataagtctttgtatggacatatgcttttatacctctgagggaaataacttatgaatgcaatgtttagatcacatggtaattgagtttatactgtttaaagaaattgcctgatagtttcccaaatagagtgtttcttttcccatttctcccaacagtgtatgagaaatccagttcctccacattcttgaccatacttaatagggttactcattctaattttaactatttaaatttgtagatactgcgatcacagtgtagtttaaattttcatttccataatgaataatgacattgagcatctttacatgtctttatttgtcatctatgtatcttgtttactaaaatgccttttaaaatcctttacttattgctcccccattgggttttttttattgttgaattttgagagttttaaaatttgtatatatatatatatatgataccctaaacatgtatttgataaaggatttgtgtctagtatgtatatattatatatagtatatatataatatagtgaatatatataattatatattatatacatattctggacacaaatcctttatcagatacatatttttatatatagtatatatatgatataatgaatatatatacttatatacatattctggacacaaatcctttatcagatacatgtttttataaacttttccccagtctgcaacttgcctttttttcttcatgatgtctattgaagagcagttttttattttgatgaaatgtaatgaattgcttttttcttacatgaatcggaaagaagcacgtggttttaatagctatctgaaccatcactgctttaacattttgccccagcctctgtttttcatcagccatgtaattttgtttttcccaccttgctgttttggtcctctaatgaaggggcaataaaacaaaagaaagtgggttaaaagtaagcttaaaatgaagggtggaaaaaagaaagggacagaaggaagagaaaaattagtggaagattttttaggccattatagtcttgcttcaatgattttatagattttgtagggtagtatgatattagagaaacaaaactttattcaaatttatttgatcatatgtaatacaatgttcacagagaagatacttataccaaaacttcttgactgaactaatttgcttccatggttcacaaactgatgaaattccagtcatacagagattttccttacagtacgtctccttagcagttggaggcaatgaagcatggagtcaaaggatgatgcaaggtgggtgtgaggggaccaattgcaaagacagaaaatgctttgccagatttacccattactatggaaactggcttttggcagttttctgagggatgagagtttaggtgattaatgtgcagtatctgagctctatctctttaggtcaaattaaatgttatgtaaggacaagtgtacttcaaaacatttatgaaaatgcatattatgaaaaaaatctattcatggatttcaaaatactttttgcaccaaaataaactcatgctaacttgacataacatatgtaaacaggacctagtttgagattctaagtaggatgagacatcatttgaaagagacccaatgaaagcaatatgaattctgctgatattgaaataagagcaaacaccaaatttacggtgaagctttagcggaaaaaatggtgaaatcattgatgctttacagaaagtttatgggaacaataccccaaagaagtcagcagtttacaaatgggtaactcattttaagaatgtacaagattatgttgaaaatgaagttcacagtggcaggcacatcaatttgagagtaaaaattcatcctgtttgagtcctaattcaataggacctacagttactggcaaaaacaatagccaacactatagacatcttaatttgtttagcttatagaattgtgactgaaaagttaaagttgagcaaactttgtacttgatgagtgccaaaactgtcacacccagatcagctgcgaacaaaagcagagctttcaatggaaattttaaacaaatgagatcaagattctgaagcatttcttcaagtaattgtaacaggtaaaacatggctttactggcaaaatcttgaatacaaagtaaattaaagcaagaggtagaagtgcgccagttaaagcaaaatatgatagcaaaggtcatggcaacagttttttaggatgctcagggcatttagcttgttgattttctgcaaggccaaagaacaataacatttgattattaagagagtattttgagtaagttatccagagcttcagcaaaaaaaatgcccaggtaagcttatccagatggttcttctgcaccatgacaatgctcctgctcattcctctcatcagacaagggcacttttgtgagactttcaatgggaaatcattaggcatctacgttacagtctggatttgactctttctgacttctgcttttttttcctcatcttaaaaaaatctttaaagggcagtatttttcttcagttaataatgtaataaagactgctttgacatggttaaatttccaggaccctcagttttcttagggatgaactaaatggctgataccaacacttacaaaagtgtcttgaacttgatatagcttatgttgagaaataaaatttatataatttttattcttgttttaattccatttttccataaactttttgaagttccctcatatgtgagtgatttttatatttttccaatcaaaattgtagttattctgtagtatattttgtgatattcaagcacaatttaatttataatttctcatattatatgccagggaaatatatatgcctttgccacttactaactgtgtgatctaggcaaaaagacaaccttccctaagcccaggttcttcagctttaaaatgggcccagtgagtaattaactcctatgtttcttgcaagagttaactaagatgatgaacaggaagcatttagcatatgcctagcacacagtaagcattcaataaatattttaaaaattattttcaaaggaaaacccattaatataaaattatgtttttcagcctttaaacttcaggcttttatatgataatatatacttggaaaaaacttgattaaaaaagacttgtatactagaaaatgttttactgactgtgaaaaaatgattttgaaaaatcaaccacttaatgtttagcaaagaaacaagtctgtttttcaaaattaaaacttgtgctattaaaaacataatgggtttaattgctattcctattagattttttccccctcatagtctattgagacaaactgaaaatctccattaattcaatgatgctgttatcttaatgtggggagttgcttttagatactagtattattactgtcatatttatagttttaccaaagcagtctaataattttcctattactttgacaaactcaagcaccagcaaaccaagttttatatttatttctgtttcctgttggaacaattgaccttaccctgaagagtggaatataggccaaaaacatagcatgtacatatgttgtgaaaaaaagttatcatgttttggaaaatatattattctcataatcattatttgctgcatttcatttgaagatttactgctgacaatcaggttgctaagtataatattattcattataatatgtgacaagaatttgagtgtctcttccacagtagctaattaacaataaaaaatatacgtaaaaggaaaagaaaaaaatgtttagaaacaaaattaaattgacattgtcaagaaaaaggtttttcatgagaaaaatatctgggcaaattaatggcatacttctaagatatattgtttaaaaatgttccttcaattaaaacgtgaactactgagtaaacacataattgcttctgtagttctcttcaccaatttttattttttgtgatagttaactatttctcattctgttctataatatacagtcttgtaatactcatatagggcttttaaattattttacaaatgaatgcccaatttctatttgttaagggataataaaacataataaactttaaatgagtgagttaggggaaagaaaaatatgctgagtctataatggactgaaatgaatgagaatggaaaatatgtacttttaatttgtgagagcacagatggtcctggagttataatgtttctacttatgacttttcaactttatgatggtgcaaaagcaatacacatttaggacactccttgacttatgatgggagttatggctgtataaacccattgtatatttataaaatatggtaagtttaaagtgcattgtcaacttatgatattttcaacttatgatcattttaccaggatataagcctctttgcaaattgaggggcatctatacttgatagtatttgaaatactgattagatttccttattatttaagccaagcatattgtgtaacatatgtaggtttatctaaatattggctttatctgactgaattgttttcttaatttcctactcaaattgttcattgctagtgtataaaaatgtaactgattttgcatgttgattttgttcatgaacatttgctgaatgctttaacaagtttttatgtggaatccttaaggttttctgtatacagcatgtcatataaaaagaaaaaaatattttttctttctaatttggatgcctctattacttttttcataactcctttgcctagaacacccagtactatattggatagaagtggaaaaaatacaggcatccttgtcttgtttctgatcttagaggaagagctttctgtcttataccttacatatgatgttacgtgtgagtttatcctacattgccattattgtgttttggatgtttccttctattcctagtttattgaatgtttctttttaatcataaaagggtgttgaattctgtcaagtgctttcttttttcttttcttttttttctttctttttttgagacagggtctcactctgtcctcaggctggagtgcagtggcaccatcctggctcactgcaaccttcacctcccaggctcaagtgattctactgagtagctgggactacaggcgggtgccaccacaccaggctaatttttgtattttttgtaggaacgggattttgccatgttgctcaggctggtcttgaactcctgggcttaagctatccacccacctcagcctcccaaagtgctgggactacaggcatgaaccaccacaactgacctgaattttgtcaaaagttttctatgcattaagtgagatcgtcgtgtgtgtgtgtgtgtgtgtgtgtgtgtgtgtgtgtgtgtgttttcctacattctattactgtggtatattaaattgattgatttttgtatgttgaatgaccattcattcattctggaaattaatttcatttgatcatagtgtataatccttttactatgttgctgaattcagtatgccagtgttttgttgaggatttctgcatgaatgttcacaagagatactggactttagttttcttttcttgtagtgtctttgtctggtttggtatcagggcaatgctacccttctagaatgagttagtaagtgtttcctcctcttcaaatgtttggaggtgtttgagaaagattgatgttaattcctctttaaatgtttggtagaattcagcagggaagacatctggtcttgggctttactttgttggaaggttttttattactgattcaatatcctcacagttttgtatctatgcagatcttctagttcttcaagagacagttttcgtagattatgtgtttctaagaaattttccatttaatctaaagtaatccatttttttggtgtataattattcataatattctcttataatcatttttattttggtaaaattcatagcataaaaacatatttatatatgtatatatatatataatcttaattcatgtcactagtcatgcataccaagattgaaatcaagtccctgttgttttgcatttatgaataatatttcaacagcatctttgtatataactcttcactgtgctagtttacctgtagggataacatttaatatacaagttatttataggataaataacaaaattgatatgtcaaaggtgatatgcactttcaagtttgtggattttgcaaaataactctccaaaaaaatacccgttttctctctcactaccagtgtttgagatcagggctgtcactcaacatttttatctaaggtgaatgttaccaaaggtgttaagaattgccaatttgaaagaaaaatatctttttttatttttggaggggagtataagtaatttgaatctatatttccatataatgtgcttattaaattttagtatgtgttattttagctttaaatattaaactacaacttttactctctacctttaatgcattctaaaattttaagtagcatgacaatcttctgttatttacagatttgcttaggtcagtgtcaggtatgttttgagtcatttttggtaatttatgttgcacattccatccagattttagaactaagcctagaataatattagtatgtgtgtgtaaataaacataaaaatatacaaatatacaaatacatatctacacacccattagaaagaattggttctcagatttatgtgagagttgaacaactggattaatgtccagaagtaactgagaaagaacaatacaccatgtgcaaaattattaaatataggatggtgatcttgagtctagtacatgactacccacggatgatagcaggcagcatagtctaatgtcatgcttttcaaagaagcctggaattttgagggagttgggaggagaaatcttctagcagaagcaatacagagaaagaatacttcccagagttccatgactgtgggacaatgagaggactgcagtgagaaccttcctgtggcttctttgcatacaatttcttacagtatattcttattctgatttaatttattttgcaactatagaagaaattatttaatttcatggacatgtacagtaaattattcacatttagtttcataatagcagttatattccatgtaaacataaaagtgatccaataatggaaaaatgaagctgatagtgaatataagatgtcacattgtcttgtcaagtctctatcctctgtcttttaaaatggaaaacaaaagcagcaagtgttctgttgatgatagtaaatgttatgtcttacaagtattcaaagcccatagcaggcatgatctgtgcctggaggaattcatggcctgttcctgtggcttgctgtcactgcattggacagtgaggacatatatgtacctgaggacaatgcatttttaaaaagaagtggatttcaaacatttttgtctaaggcctagaatttaaaaaaatattgattttacattgtgactcaataaacacaaacatatacatattctctattatatgcacagctacaaataaaacagaaacaaaatttgtatgaagcaatactttctttactatgtagaatgtgttttcagtttaatctctgtcctgtccagtattaaagatactggaaacatgtggctatttcaatttcagttaattaaaaccaaataatattacattagccatatgtggctagtggctaccatattggatagcacaaatatagaatattaccatcttgtcaagtctctatcctcagctgcaggtctgttggagtttgctggaggtccactccagaccctgtttgcctgagtatcaccagtagaggctgcagaacagcaagtattgcagaacagcaaatattgctgcctgatccctcctctggaagctttgtcccaaatgggcaccagcctgtatgaggtgtcaatcggcccctactgggaggtgtctcccagttaggctacacgggggtcagggaaccacttgaggaggcagtctgtctgttctcagagctcaaacaccgtgctgggagaaccactgctctcttcagagctgtcagacagggacgtgtaagtctgcagaagtttctaatgccttttgttcagctatgccctgcccacagaggtggagtctacagaggcatcaggccttgttgagctgcggtgggctccactcagttcaagctaccccagcttctttctttacctactcaagcctcagcaatggcagactcccctccccctgccaggctgctgccttgcaggtcgatctcagactgctgcactagcagtgagcaaggctccgtgggcgtgggacccgccaagccagtcgtgggatataatctcctggtgtgccatttgctaaaaccgttggaaaagcacagtatttgggcaggagtttcccatttttccaggtacagtctatcatagcttcccttggctaggaaaagcaaatccccaaaccccttgtgcttcctaggtgaggcgatgccctgccctgcttaggctcaccctctgtgggctgcactcactctccaaccagtcccagtgagatgaaccaggtacttcagttggaaatgcagaaatcacccgtcttctgcgtcgatcatgctgggagctgcagaccggagctgttcctatttggccaccttggaacagaccccaaatgtataatttcacaacatagctaacatacagttattagtagtatgttttacattctgttttacacagtctgtggaatataatgtatatttcacacagcacatcttatttaggactaccaacattttaattgctcagtagtcacatgtgactaatggctgtcatattgtacaggacatgtctaaagttacaactttcaggacttttggtcacctgcctaactgtctgtaaaaatatgaaacacgtgaaacatctgtattgcctgtcaacacacgaaacacctgtatttctcacctccccccagaaacaagttaaaatattattttttttccaaattaggcatttctttcttttagatatctgtcctcttcaagagcagtgtgaccaacagtatcttactgtttgggaccatctcctaaccaggaataataagaacataaataaagatgtcatttattgggtatttgctctgtgcttttggctaattgttttccatatgcgtttcatttcaagttggttttacatacacacattattatgtcttatttcaagatgattttacttcaagctctctctctaaggagaccacactccaaaaaaatagaatttattaaaaaaaattcaggaagagtttgttactctcaagtaaaaactaagaaaatattggtgtttaattgtagttctacttgtctttacaattaatgaagtgtggatactaccataattcaactaaacagtatttataggcattgctgtaaactatttgattttgatgcatggctagaaacatacagttttgtgtgcaaaggtttgtttatgtcaagctggtatttagaggtcagggaccatttctgaatcatttccataagaatataaactttaatttaaaaattaataccaacttatataggtcaactttagtataaaaaaattccagagtgatgattttttatagtaataacttttgtttttttgttttgttttgtttttgagacagttttgctctttcacccgggatggagtacagtggtgccatctcagctcactgcaacttccgcctcccgggttcaagtaattctcctgcctcagcctcccaagtagctgggattacagatgtgtgccaccacgcctggctaatttttgtatttttagtagaaacaagtttcatcatgttggccaggctggtctcgaactcctgacctcaagcagtccaccctcctcagcctcccaaagtgctgggattacaggcatgagccactgtgcctggcctcactaataacttttataacaaaatgtttaacattttatatattaaatattttcaagaaatttcatgcttgggatattgtgatattatataaaataaaataaatattattttaatggggtaataaatagagcattaaaatgacttaggaagaaaataagaacagttacccaggggcaataagtattctgaaagttgatgcatttatattattttccactttctaaaattatcttagaaaagttgttgaaaaattaccattttaatggagattttgaaaacatttccttaaactctttccttgagcttttccttaaaatgttctgaataggtatgaggtttaattctaacactgacatctagaattaattttcactttatatttatatatcttaagctagagtaactttaatatctgtagcttaccttttgtttcagaaaactaaaccctgattaatagggcatcttgtacttatgtgttgtaggtacaattacattttctactacaagaagatgtactacaagaaggaaacatgatgattatgaggaagacacagatcaagatcaagccctctcctgtcttgattcaataacagaacaatctagcattttggatgatgcagacacatgtaagtttattatgacagagtttcactattagtttgcataaatccaaatcatcattcacttttgaatgaaatagatagtttacacgcataatacatatccaaatttgtattgcatgtttccataagaattttattatttcagtattaactatatgtagcatatattctggagttccactgctattaatgtcaatagtatcaaaatacttcagctagaagggtgcccactctttcataattgaaaagctttacatatttttctgtcactatacaaaagcatacagcaaatttctaataaaatgttaatgagtatattgttttaataatgtaatatgcattgcttacttcaatataagagatactagcaatcttcctcatatgccaaagaaactaaacactatttttccccctatattataaagctttatttgaatgttgttaaacatcatgtctttttagtacaagttccaagtaaaataaggtgatgaggagttggaatactcagggcaggtttcctggaaatgggtgaatgagtttttcttttatgggtgagtagcagggatgcaaggccttagtaaagaaaagtggttcaacagggacaaacttgtggagacattttaaatgttatacaaaagaagaaatctttattgaatgaattcgtattagatagcattcttcacagaaacagaaatgatggagtgtgtgtgtctgtatttgtgtgtctgtgtgtattgagagagaaagatttgcaattgacaccattgtgggagctggtaaatctaaaatctgcaaggcaagccagcaggctaaaaagtcaatgtcaatgttgcagccttgagtccaaattccccaggataggacaggcaggctggaaattcaggcagtctttctatgttacagtcttgagaaataattgcttctttttggaggaacaccagtggttgcacttaaggccttcaactcattggaggaggcctactcaatggaagataatttgctttactcaaattatactaatataaatgttaatcacatttctaaaatagcttcacaggaacatctagactagtgtttgttcatacaactgggcagtatagcccagcaaagttgacacatgaaattaagcatcacagaatccatggactaaagagtagtatttaggaatattcaaaatgatttgggaagagaagttgggccagttagactactacaacagcaaattgagtttaaagtgaagacaaccaggtattttatggtggtggtggtgatggaaatatagaaatatcactaaagatgagaaatatttcagagactagcattggatgactgtccttatagaagataatgaaaaagggcattgattctaaaaaataataataagagttcgtttgtattttggtcaatagaaaaaaaaagaaattcagaaggaaagaaaaaagttttggagattgtaacacttagcaaagttttgtacttcatgatgttgatctgacatcaagatatttacatagcaatatccagttgccaattgaatctttgtagctgaaactaggaaaaaaaaaacaatattaacatgagttgtaaaggtttagggtctctttcagtgaaatcatgcaggtgagacaaaggaatagataattgctgtagatgtgttatgttaaaagttaaatcctcattaatatctagggcagaagaaccatgaaggaaaaccttcatgagggttaaagtgttcagaagaatttgaaggaaaatcaaaatattatgattttatgttaataggctaaaaaagactgatctctaataaacatactaacctacatattaacaggttgaaagatagattaaaagctaggaaaaatgtacctgacaacattaaaggtatccctgattcttcagacaggtcttttcatatccttactctcagacagaattaacttttcccctataataacatggatccttttttaaagactgctccacagtgtatttattttcaattagagaaatcttctagctttcctctcatcaaagaaatgaaagcaacacctaaatcagaatgttttaaccttccgaatagggaaatatgaaagataatggtaatacccatttttaatgagaatcagatcaaaagatgcaattgcatgcattacaacagaaatttaaattgataaaaacttttttaagagaacatttatagtatatttaaacttttaataattttttatctccttcaatccaatgattcagtctaaggaatttgttagaatattcaaagatatacaaaacatatgacatttaagaatgtttcttttgtgatatattgaataattgaaactaaagttttaatagtgagtattttctgaataatataaatgtgtatattcttatgtacatatgaatgtatcaattatgtatattgtatacaccccagtatatttatgtgtctatgtctatatatccatatctttcttgatattttgagcctggaattttgtacaaatatattaagtagctgtcatttagtcatgaaattatgaagaactttcattttcatactattcaggaatttctaaaatcactatagtgaatgctattgattttataattagaaaaatattttaatttaaggctcagagttaaaaaacaatcactattttgttgttgttttcatcaataaatcattcaccaatcccactctaatcaataaattaatactcaatgtacatgtctagtactgtaggaactaaatcagctacatcacaacactgccacgtgtgatagtcacagtaattataaataacaggtgttattgtccctgcgatggttaattttatgtgtcaacttagccaggccacagggcccagatacttggtcaactttatttttaatgtttctgagaaagtgttttttggatgagattaacatttgaatccatggactctgaataaagcagattaccctccataatgtggttgagcttcatccaatcagttgaaaaccttagtaaaataaaatctgacctaccccaatatacttcagattttggatttaccaagcctccacagttgtgtgagccaatttcttaaaatctctgtctttctcgctcttctttacacatcctgctagttccatctctctgaagaaccatgacaaatatagtccctgttccacaattgggcagactcttgagattctttgccaaaaatcaccaactaatggtggtcacattgggatttgaaccctggccttataactctgagtcgttccactgatctttgcattaacccagagtcatgaagcatctcctcagtcatagctactgtttatttccagaattattttctctgtgagttcagtgtgggttaaaatattggaaaggcccagataaaatatgcataagctacctagaagggaaaacacttttcattttaagaactttgatttattttgggagaagtcacatttaaatgtcataaaagcacttaaagtgcttttataaaattgaaggagcaaatgtgagcagagccttccttaataatctctcatcagtataaatttggtaaccttattttctgcacatttctgcttttaagggaatgaactgatgtctgaaaaataaacaagtacaggagtcagttcaaaatgtggaaataaatttgccctcaagaactcctcatagttatttggaataagaattcaactgggtcttattaattgtaactatttttttctctttctccctcttactagctgtttacgttaaatatctggattgttctcaggtccaccaatcttacaagtattttagatacctaaagtgttgaaacaggatgcaaaatagtacaatacagtatggtacagaacagtgcagtgcagtaaaatacaatgtcatgcaatagaatcccatacaaagctatgaacgccatacagtgcaatacaatacaacacaatacgatgctattcactgtcatacagtgccatacaatacagtacaatgcaatgcaaaacatatactcatgaaaaaccttttcagtagagagaaacactgagaattccactagtttgtgcttcttatttcatagatgaggaaactgaggcccaaagaggttagcaatttacctaaataagttaatctagcataacagttcttgaaatcttttaaacatgacaatactgatgtgaatatgtatacaatttactgaaattggaggacaatcttaagccatgacctagttcaacacaggaaaacaaaagaatatcaaaatgggaagctgaacagagaggaaaaacaaaacaaaacaaaactgaatttgacagacgtaaaaaacctttttatgaagggcctggttgatgaggattccagttttagcatgagggagtatggttttggttatcatcaggggcagaattgcctgctttttaaaaatattaggaaagcaagatataaaaataattgtctcacgacttagtctatgtccctttcagaatttccttgggctaaattcttaggatcctttttcacattttcaggaaacatgcaatctcattttcctgactttctccttatactagattcttatggtcctggaaatgtagcattgtaaattgtaatgacttatttagatatatctatgtacaaatacatgaatagtttgtcaatgagaaaaaagattggttattactttttgaaacattaatccttaacttaaaagtaaaacattccgaaattcattttatggaagaacttaatgagttactggcataggtatagggccaggaacttgtacaggacattctcttggccatgcaaggatggagcttctcttattcctcactaactgtgataaaaacagcttctcaccctttcttcagctgtcttgacaaaaagtccattaaacaaaaaggttgaaaatgatgtctgttcatgattctcaaatgtgtatgttaagtatggtattctgaagtctatattaaaaagtgttttgttttgtttttcagatggtaattttaacaatttaagattctggtataatcttgagatccatagcactcctggaccacccatagagattatggaaatgacatgtattgctctggtaagtgcccattgcatgttcatagactctgtcattttgtgagcactcagaccttttgttgtatagtaaattatttactatcccttaaaaggtctgtatcagatgattgtattaagataaattagtcaatcatagcaattttatttttaaatctagtactacggactttaaatgcttttggaaaacatcttttagttatatgttatcttatagtgactgcattgattagcattctatctgtttcaagagttactagagcaaacttaaccttagtctacatgtttgttcacacatagatgataaaaacaggattgtgctactagactctttcagcattgctttttcctggtttctacagcagacctttcacttggaaacatatttggagcaactggcatacatttggggtttccattaatactcggaatagattttgtctgatgtgaattactaaaatgttactaaatttgtgtcaaaaattatttaataaagttaaatattaagagtcttattttaaatgaaacatgaggacaatattgctattaacaatgttttagttaaatttagtttccttattgttagtactcaaatatttaaattgataataataaatgttatttttatttttaaatatgtggatagatttctttatagaattgattacttagaatcttgaactttggttccaataaatagaaagtaaaaaaaaaaaaagatttaaaatactataaatttacaaattgattatttgcccacctgatttctgggtaaatctccatttaggcatagaagatgaatgattaaaattttgaaatgtgctcaagtatagattgcaaaagcattatcttctaagtggaaaactatttaatatgacagtaggatcatttcactcaatgaaaatgtcttatttctgtgaattggttaccactgcagtgtaaaatcttccttaaaggttactttaaaatatacattaaaatgtatccctttatcaagacgtagagaaaaacatttaaataggctttgaaaaaattgagtgcatgatgtagcacctcagaaaaggagaaattggctttcttattaactatatgcttaaaataggaatagagatgacaaaatatgcaaaacaaacagaagtaaatacaattttaaaataaattatagatggtcaattgttgcattttctcattaagtggtgtataaagtgccttttttttctgcaagagctattagcccttcaagaaaatactgatagaaattgagatttctatagctctcaaccttaaaaggtgaagactgtcacacaggctgagaaatacacaccatcagggtactttatgtgcatatttaagaagattgagcaaaaagcaaaaacaaacaaacaaaaaaccaaaaccaaaaccaaaaaaccactacttatctctttgaatgagaaatttcaaatatgttttcatttatgaaattaaatttgcatataccctttcaggaatatattattttaataaataatgtacttttgaataatggcccttgttcatttttcatcaaggacttgcccctccccatgtatattataatgtaatcctaattcagtttgtactgatttcctataagttttcaatttaaacctctttttgttttggcaccacagtgggatatgtgtaactcgtcttacgcacatatatatttctaattgctatcatttttgcttttattattcgttatgaacagttagcatagttatttcataaatatacttaaatgatattttttcatggtctacttagattaaaacgcaattatcgagtccccttttcattgagtagttttacgttataaggcaggaatgaaacttcttaacacatgacagctgctagatagtttccttgttaccataggcaggtttgctgtattaattaaatgttcacatttaactgtgatttgttgagaagggacatctttttcaactaagtttaccaacttaggctatcgtggctagtgatgttgccaaattattaagttttctcacgtttctagtcgtaattgtcgaaggtaaaaatctattccctctttaactttcagacatgaagatttatttactagagatagtatgatctcttttaaataatgccatcaaatgaaacctttgtccattatttgaagaagatgctttccaactactttcagaagtatactaaaattgtggtcctcacttgtatattatttcctaatattattgaatgcatattctgttcagatgaatcatttgagaaatactttatttaaactttatacctccagatgtggcaatggtgcactcaagatactaagccatctcttatttttttatctgcatctcagtttttattacattcaactcaaatttccacattttttctacagatgaatgattgatcagaatctctctaaaatagggttcatgtaagaaatacttacagtcttgaaacacatatatttggttatttcttgctgcaggttccaaaaccagattacattctcagtaaataatacttgcttgttagtagtccattctctgttagtataaagtatttaggatttcctttggaaattttaacatgtaatagctgctgttccattttgtttgatctcaaaaatctcttgtatgtcatatagtttggctatgggagaatgatgacaataacccgctgtctttccactgacactcaataactctaatatatagcactgagctataaatattttgtggaaacaaaacttaagtgtgtgagcaactctttatataatttacattttaaacagccatagccttcaaaatacttacttcattgtcagtgaaaattgcatgatcatttatttctttctgagcttttaatttataaacaaccttcaatgaaattcactatattgttaattaagagatccagaaatctctccacaaactagcaaaagagaaggacagttaaaaacaccgttaatcctcttggtgtcaaacataaaagcatccatacaaaacaacacaagtgagaccaggtgcggtggcttatgcctgtaatcccagcactttgggaagccaaggtggtaggcttgcttgagctcgggagtttgagaccagcctgggcaacatagtgagactttgtctctagtaaacaaaataaaaatttaaaaaacacatgtgagttgccaaccatttttaaaaagtttttagttttagcctccataaattcaaaaatatattttgagttactgttttcaatgtattttcttctttcatccttttttttttttttttttttgatggggttttgctcttgttgctcaggctggagtgtaatggcatgatcttggctcaccacaacatccgcctcccgggttcaagcgattctcctgcctcggcctcctgagtagctgggattacaggcatgtgccatcatggccagctaattttgtgtttttagtagagatggggtttctccatgtcggtcaggctggtcttgaactcccgacctcagatgatctgcccccccgcctcagcctcccaaagtgctgggattacaagcgtgagccaccgcacccgggcctctttcatactttgtatactttatttttctataggaaagatcatatatcataagtgttgtccatgacattgaaatttttcttcctcatgaaatgttgaggaagcaaaattagcattctgcctttaatttatcctaagttgtaaaaaattcttaaatactattttttaatccggaaaaaatatctcatggtctaatttgagttaaatacaaaaaatgaagatgtagctagggaggctattttgattaatgttgaaaacactcatataaaaaatattctataaaagttagaattatgataaaatctcatctctaatctgcctatactctatttttaaaaattttaaagcacttgttggctcccaaaagatataatgttcttcctaaaattatagagctaatatacttggatttaatatctacattaattgccagaatattttctgattcatttacttatttctaaattctgaattgattttgtacataatgtctgtggctttaaagatcagcaataattagccactttcacttcaaccgagagtggactcaaggccgtgcctagagttaaattgtcaactgtctgtgcttcactgaagtgcctaattaaagggaaaaggttgtgtgtgggggagggtctgctgtccaaataaggtgctctgccaaaaggaagggtgcctttattctctctttctctctcagtctcccccagtcgtcccattctccctccacaccctctcttcctccctccctcttctcttcctcctccccgcccctcgcccccgcaccttagttctttttattttttcatcaaagtcatctatgctggccaagctctgtgctctgaaggctgattccttttctagttttcacacatacaacttttccagtaatgactctgtataagaattttcaacaaacaaagcttttcaggaaatgtttattccaagttaaagcaagaatgctgacctgtatttacagagtatctaggtagtcataatgaattctactgacactctttgttcataattaccaacaatgctgttctggttagatacgatgttaaccagtgtgatttgcagaaatgacatggaaatagagatttagctatttactcttaaaaacagagagtgtgataaacagctgattttagaagctgaacttaggtttgtctttactttctggtaaactcagtcagcttcagtttcctctcaggtcagattcaactccttctcagtgttctcatgctccgttctcctgggtgttatggaggggttaaaaggaaacttagagggcatcctgactccaagttcagagatggagggaatttggtccttaccatcttgtcctgacatcagcaatataaaagtcttactggctagtcattgaatatcaaggggctctccccatcaaatttcatgtagcccctaaaggacacagcagaacatccttaaggctttctaaattccagtgaaaagtcactaaagtagctgagataggacaggaatttaggaggaagtttaagtcttgagtaaagtgtgtgttttctgtctgtcgccaccaccagctgaggaaaactgaatttattctttattggttattaacactggctaggcagattttctccaaaaactatggtttgtatcagaacaatagaatcaaaacaaaataaaataaaatatctaaaacaagagtatgttggaaaaaatagatgaactttcttttccttgcattcagggtatagcaaccccacccagtgtgcagtgagcttagaaagctttagcattggaaattaggtgaaggtaatggagtgaggcgacctgggttaatatggcaaactatcagcctattgtacctgatgaggaaaagctagcattagctctgatggaaacaatctaatttgtgattttgtgggcaagttcaaattttacataatgagttaagaagttgttctaaaactcatattgtaccttggaaattttgagatgaaaaattataattgttttgagatatctctgtatttctgagtgaagtagtgtttaggggatagaaaggaataagtcaggtaagaaaattataattgtccttccttctcgtgtaggtctttaagtcaggagtatattaattagttgaaatcaacatcacagctatctgaaagaccattatttcaattaaagttcacaaaacattccaaaataaaacaatttttggctactctgtcattatgaactattcatgcctctgccttcttccgtaaatgcagatgaagaagaattgactgaacatgacattggattcatttatgcaagttcaaacacctgacatgcaaaaaaaaaaaaacatggcaaatacccactcactgtgtcaagaattaccccctggggtaccccataccccacgattattaaattatgtgtaatgtatctaagcactgtttgcttaactcgtgacaaacactcttcaaaatggctggcctacatggtcattcagagttagcattttaataattcacacacatgcatatacatatatatgtatacttacatatatatacgtagagaataaatacatagagagtacatacacacatatacggcgggggaggtggaatactatcttaaacagttaagcaggaggttacttcctagggatcggtccttgcaattagaaatatttctatttttaatagttttcttttctctctcaaggttatggggtgtgtctgaatacaaattaataaactttaggctcttccagtgttttctggctttttcacaactcccaggtgcctattaatgcatcttcaacatacatgtcccccagtctggcattagcaaaccaccttgattgcatctcagcattctatacatttcaagtcatatggtggaggattggggattggggtgggtataaggcatgacatcattagatacagtgttgtacagatggaaatagcaaaggaatgacgatggtgtttctaaatatagctgtctacgtggtttatgtgagttctgacttttcaatttaggaaaattattgacccagattataatgatcacttcctctcaattacatgatactttcaaaatacccattagttgtttgtttactgacttgataatgttttcaaattgaataaaattaaaattgaagatttcctcaataatatgccttacttaatattattgtatgttttctcctcagaaataatccttttataatgaacttgtgattatcttccgtgagatggtatggtgaaaatacttcatgctagtgcatattgaattgtcattgactcaattaagtggttatgtggaagtaaataatctttatttattctgaccaagcaggaaatgatgaagtgtttattgcactcagtgaattacatttttcctcttagagtaggtatgaactggcaaccaagtgacaaagtgataaggcaataaagtctttctctcatctgaaactgctgtcttcaccctgtaactttcaagtaaggaggcaggctgaattaactggagacttttaaattccttttgagttagatttttacaaagttgctttattatttagttaaaagttgtgattatccaaaatatcagacatatcaataattatatataatatgtaatatgtaatgtacaatatgtaatacataatatataatgtataatatgtatatacatatacacaaacactaaatcatctcataaattgcacattttattttctaatgagtatttactgggtatctctgatattcctgccactgttctagatgctaaggaacagtgatgaacaatacaagcaaggcccctatttgcatggagctaccattctagtggagttagaaaacgaataaaataactgaaataggatgtttcctgggaagttctccttttatcctggattttcaaatgaagtcacaaacctgggaactgtagataattatatttccatattatgaaagtggttgctgtcctgtttatttaagactctctaaatatagtattcagagtatatctagctgatacagcaaataaaccctaaatttgcaatggctaaacacagtaaaagtttttaacaattgtaacattctagtgaatgtgtccctggttggtgggtggcatactctgtgttgtgattcagggagcaaggctcgttccatcttgtgattccttcctttttagggactcagaggttcctacgtatagctggagaaaaagaaagcagagagaagagaatttccaatagttttaatggccttgacacacaggtgacacatcactttcactcacatacaattggagaaaactagtgacacagccatgcccaggtgaaagagggtctgggaaatggaatctctagttggacagccactgccaagtgacatcttcatgccaagaaaggagaacataggattttaatggagacatgatgtttctggcacatcaagggaggggaggaatctttagcccatcacccatttacagctcatatctgtgatggccagaacaaaaagacagtgggagtgtcttctttaaggaggggaagctgatagtttaatgcccctggctcttggtgagttcctaccaacagaatggaccacagagggagggaaggtggttagagtgagagcaagatgcactttcatcggcacaagtcaagatgtagtgggccaaagtgaatttgacataatgaaataaggctaagcttgagcttatttgaaaggacccagagcaagaaacattcttctagggtgagaagactccaggagagtctacatgagggtaattcaagatagaagaaggcaaaaggaacttatatagtcacctggataagatcaggtagcaccaattaagtaagtgggtattgttcttctacctgtcatctcatttcatcctgcaacctgaaagagccagccacgtcagcaccatgatcataagagaggaagctggagcagagggttgaaaagagcaggacatgtttacctccttcctcacaggcagtgtgcaaaattcccagacaggcctgagggtgaggatgaggtgccagaaagaatcaggagaagacttcaattgccatgtgagaagaaagtgttgattgatttgagatttctataaatacctcaaaattagactcttctggcactgggagccagcagtttgggagaccgaggcaggccgatcaggaggtcaggaggtcgagaccatcctggctaacacggtgaaaccccgtctctactaaaaatacaaaaaaaattagccaggcatggtggcaggcgcctgtagtcccagctactcgggaggctgaggcaggagaatggcctgaacccaggaggcggagcttgcagtgagccgagatcatgccactgcactccagcctgggcgacagagtgagactccatctaaaaaataaaataaaaatgaaaataaaaaataaataaatatgtatgtgtataaatatatatataaatgctgaaaatatctaatatttgttttaaaagtgtgtaggtattcaaacttcctctgaaaagctttataatttgcaaaattcaatacaactgtttttatatattttaaaagagtattcctcttctacatgagtggttaaatgttttaattattttcaatttcagcatcttgtgaatgtcttttctgttttaaaatttttgcttgtatttcacgggattaaatatgcattgtttagtcctcttgtaaaggagtctgagaaatggaagcaatttctttaaacagccattatgtttgccacaatatttctaagtaccagccagaaaaaatattgggataccttataaaataatgctttccatcattaaaccgaaaagagcgcatgtgaagatgaaagaaggctttagaagtcatcatgtaatgttcagccattactgttttacttgagtttcaagaaaaaatcagtcaaaactgatttatgtttaattctgaacacaaattaactttaaaagcctactcatgaaagtggaggaatatgccatttgcaaaacagacaccaaccaagtatttcaaacgtttttatagcgtattcacagaattcagtggactgtgtacttctcatttagtaagagttctttataaaataaaatggaatgggaggtggcaggataacttagccaaaacaattaatcttgttttaaatataatcttaatgttttattttgtatgttattttctcaaaatggttatgcatttctgtaatcatatagctaacctaagaaagttgtttcaagaataaacatcaattttgatcgtcttataaaatgatggataacataagtttcttctctttaacttagtgaacatatcaaatactttaaaaatgtaattttacaaccttaagaaatattgatatttagaaaagtaatcttccctaaaattttgaagatattttggcaggtggatatttaaaatacaaattattcattatgttaaaggtgtcatttaagatttttttctgtttaaacctagaagaaaataatatccaaacaataatgtaatttagaaatcatttttgtaatattatagttacatttgagatactttctaccatcctagaaatatagtacagttaattagaaacttaaagcttttgactatagtgaaacatttatttctattgagtcttgctattttcaaaactctgaataatttgattccagagattttcaagagattgcagtactggtagcgctaagcattcaacaattgctctctggaaggctgctctgtaaaggattttgaggatgtgtccagatctactgaataagagtgaaatgatcagttaatagtatttgccatggatattgcaaggatgccaaggaggagctgtgatttaagtactccatagacaccatccgtatctcccactcttaagatctggccaactgtagaatattatgacacttttgtaccacgagagcatggtcttgttagataggttgtagtttacagagaaaatagtaggtttaatgtgattttgtttcattttgttttcaagacttatatatgtaataagacttcaagtagttctatattccaatatttattcctctttagaccagaatctaaatctaaatttaatgtgtaggtcacaacatgtgagtggctcaacatgtgagtgggaaatagaatagaataaaaggtagtagaaagtatcagaaaatattacatgtggtaaatgcagggattgttttgtaaaacttttgtgatatgcgtatgtgaaccatattgtgatataaaacaaattattgtgggttgtggttaaaacattttgaaactcagtggtttagattctagcatttttacttctatgacaggctataacattctgttgaacggacactgatcttctctgaataatgtctgagtagtagaccaggacaaatgtctaggccaaatgtgtcatttccatcttctgtcttatgccctgagtaaaatctctaggctcatattgggttgatagtatgtgttaccttggcatacccttttttctagtggttgttatttttgaccattggaaattatttagtggccaagtcctctatcaactttataaaatatgccaggttacccaggaaattagtcactgttcagtattttacattttacacttttatttttccttctttataattataagcgttgaatattttgctgtagaagtttaaatgcccacttattttaagaattcataattctaatgtctcctgaaaccattgtagaagactatttttcattgcatttataatcaacactgatttctaataagtgatatctgctctaatctaattgttaatttgtatatattcttagtttccatctttcttcaccagatgttgttcaccacactaaatgttgtttccattcctctaaaatgtagcatccttccaactcatttatttattagaggtgatcaggcaaatattctgagctatgtcctctgaaacagccatagacaaagctgtaatatctgccttgaagatatgttcccagaagcttagtaagaattttttgtcacccctgtaacatgatttgataaatttcataacagctccatgttctaaagtacgtttattaccaagctttgatttataattgaaatgctcaaccttctccatttctttaggttaaaacatttaggcaactggaatttgttaaaattgagatgtgtcctgtctactaattatctttactacatttgcttcaattatagcttttgacgtagtggagatcatggctgaaatgggatgctttataagtcattagccaggatgggtcagtatgaggatcaggaaatatcttagaacttaaagagtgccttccagggctaagacaatgtaccttgggggaaggacaggacgaacaagaacagaaggaagaaatctaaacagaaagatgtatcatcaacataatttgactttttagtttagattgtccctgctacttgatgctaagatacgttgctactttaagtgtttcctttggatcagcagcagcagcagcatcatgtggaaactttttagaaatataaatttcagaccccatcccagagctactgaatctctgggatgaagaaaggctgtcggggagaggtggataaaaatctgtcttttacactgttggtgggactgtaaactagtccaaccattgtggaagtcagtgtggcgattcctcagggatctagaactagaaataccatttgacccagccatcccattactgggtatatacccaaaggactataaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaacgatgagttcatgtcctttgtagggacatggatgaaattggaaatcatcattctcagtaaactatcgcaagaacaaaaaaccaaacaccgcatgttctcactcataggtgggaatggaacaatgagatcacatggacacaggaaggggaatatcacactctggggactgttgtggggtggggggaggggggagggatagcattgggaaatatacctaatgctagatgacgagttagtgggtgcagcgcaccagcgtggcacatgtatacatatgtaactaacctgcacaatgtgcacatgtaccctaaaacttaaagtataataataaaagaaaaaaaaatctgtcttttagcagactctgctggtgattcttatgtgcaataaagtttgagtaccattcctagagtaaacactgaaaaatggacctcatagaaataatgataccagtgaaaaatatattttaaatgtaattttacaaatagttttcatccatttagttacatggatctctgtgtggtatttgctgttgaaaaaaaataaggttacaatttatcaaggctaatgaaagaaaacatataagagattcaaagctagtgagatatattcaatagtgtatcaaggtaaaaaaataaaacaaatggccttatattatgtaataatttcctttacatttcctttcatagtataatgactccatgctgacactaaaagttgattacatatttgttgtataattctaggacagcacttgcattgaaatacctctctctaatccaaaagatagaggtcttcacttagaggtgcagttaacgagtgctgcccttaatggggataatgaaattatcctgagtccactacagtgcaccaaatatattgtatggtattctccagcaactacaggctacagcgatgaaaggtatggtttgagtgtggcattatatttcattgttgatccttagaaattaacctttaaaatttattttttcttatactataatcattaaaattacacttgctcatagttttaactttgtttaatactagtccctgaaaaaatgtactgacttacagttagcttttgcttgcttcagtgcaaaaatagtatttatcagaatatcaaattaaataatttctacatttctccttttatcccctttcacttcactttttactaagtaaatctttatggatgcaaaaactgaacaaatgaaaacagttgcatgaggactagggattaaactttcaattttcttgaggaaaattaacttatatatttttcttcttaaatacaaataattcacttggaggacataaaggaattaaagtaattaattacagtcataatgtcctacaatacatatcttgaacttatttctgctaactgaaattttgcatccattgaccagtctctccccaaagtttgtgtcccctccacctcccagcgcctggtaacaataatcattatactttctgcttctgagttcaatttttaaaaattctgcatataagtgaaatttgtctttctgtgcctggcatattttatttaatgtaacatccttcagaataactcttattggtgcttcaagtacagtatcctacaatagaaaccagtaattgttattttaatgagtcagtaaataaatgaatacatctgtgaaattttaaaggacaaaaattattattctgcgaagcatgaaaataagaatataacatgaaagatactattctgaaaaaattattattagaaatatgggctggtctttttgccccaatatgactgcacaagctttgtgaacatatactgaatcttgaattttctttatcagcatacattaaaaaaatttttggctaatacttactgtctgcctactctgttatcatcattggggcgtgtattttacatatataaacataaaattctcatagtaactgtaagaggtaagattgattcctcctattttataaatgagaaaattgaagctcaaaaagttaagtgactttttcaagactgcacaaataaaagatgacagagctgagataccatcccagttatacttatttttttttttttgagacagagtctcactctgtcacccacgctagagtgcagtggcgtgatctcagctcactgcaacctctgcctcccagattcaagcgattctcctgcctcagcctcccaaatagccgggattacaggtgaccgccactacacccagctaattttctgtgttttaatggagacgggggttccaccatattggccaggctggtctcgaactcctgacctcgtgatccgcctgcctcggcctcccaaagtgctgggattacaggcatgagccaccacgtccggtccccagttatacttgtttagactgtcacaagctctgcttccctgggagttgaggatgtgctgatcataaaggaagttctctagagctatatgtcacttgatagcattcacatgaaaatgcacatgcattcaactaaaactaaatttgacttagtcacagttaaaaagcagggcttttactgttccaccttctgcaagatatttaaaatactcatgtttaaacatttttattgatccaacaggcatttattaaacagatattaatgacaacaacactgcttttcttgaataatgaagtgattttctcaaccaaaaatgaagaattaaaaatacatctacaaaaagagtagtatgtgttacagagtagttgtcaaatgttgtatttaaaaccaactatttatactagtttggggtatactacttctgcccaatttattacacaaactaaaactgctgacaaaattttgtgtatttctctccaccagcattatttttcagcctgaaatggctgaagagttctggtatttactgaagttaactattgaattaccaaaaccaaccacaatgccagaaatacagtgcgaccttggcaagtaagttctacttaatagataaagttattgcttgcaagaaaaatagttaatctattacaatgttgttataatgcattcagtttctaaaataaagaataaatatatctttagtcattgattttttttcccctagggaaggtttgatatgtaaactaccctgtggaaaacttgtcaaataaaaacaaatcaggacttagcaaggaaagagtgttattcaaaaggattattacaagggataaaaagggaccattgcaatagggaaagactcccatcttagaagtctacaagggtttacaaaatcaaacagaaaaaagttcatcttttataaagtaaaggaaggtcaagcagatatagacagaatctttggagggaaagctggacaagcaagggaaaatggccagtgatgtctaacaggaagagttttactgtggtcagctaattcccaggagaagctgacaaagggtcatgttactttgtgtgtctgcatgcttgtttaggcttagggacaagcagagttcaggggctggtgggaaggagagaaacctggcaaactttcctcaaggtgaagcagaggtaagcaatgaacaactgtgaacatttggtcagtgggttaatgccgtgatcccttgagatatgaccattcctatttaggtagttgagttcctactatttatcaagtttggtgctggtaaataggggtaaacaaggcataatccctacttttaaagagtatacaccgtagtgagcaaattagtgccttttaactaatttctctcccttatcacatcaaaagagtgttgcattcttccagtaccagctctttagccaaaacaatgacatttgaaatttttttcttacagtagcatagatatctagtatgaaaatattttattcctatttttctaaggtattgtttatgagaaaacttgggaaattggtaatatacgaagcagatgcttaccaaaaaatgatgggaaatctgtcatgatttttagtgtattttattcactataattaatgaagttttggttattttcattgaatttcttcatatgtccctggtgaaagaacaaattcatgatttacagagacttgttaaatttgtagtctagaatcacaaaactgacatataatgttctttttaaggtgaatcattttatacatatactttatataaaaacaagaaaatggtgctttatttgaattatataatttgaatttatgaactgaattctgctcagcacatattacctaattttcctctgtcacaaggccatgacattgtgaaaaacaatatatgtatggtgatgattccattctttttattacagatttgctacctaaatattttaatcttactctatattgtaagcaagaaacagtaaagagatatgaaaaactgtacatagataaaattatgttattatgttatactttacagaaagaatgaagatgacaagctggatgctgtacattaaaaaccattagaattgatagttgagaattatgaacactcatttattatttgtttagagcataaatagtcacatattttgggcatttactcatcatcaatttggatcttgttaatgttctcaatgaaaacttcgtgcatttattactctgttattacgactagactgtgttagcttttttggctggatttagcattataaaacaataagtaaacattattcctaaaactggaatatattctaatatctaatatgggataacattaggtctcaaaaatagagaaccaaggattaaaatgtcattagttcatacataattattttgagtttgaaactaaaagaagtcattatattagcttcctagggttgccattacaggcatcataaactgggtggcttaagaccacaaaaatgtattgtctcacagttctgaggctagaagtttaaaatcaagggttcaccatgaccatgctccttctgaaacctgtaagggataattccttgcctcttttagcttctacttcttcttcttctttttttctatgttttagagacagggtcttgctctgtcactgaggctggagcgcagtggtgcaatcatggctcactgcagcctcaaacacctgggctagagcgatcctcctgcctcagcctcccaagtatgtaggactacaggcaagctaccatgcctggctattttttaaattttttgtagagacaggttcttactgtattgctcaggcttgtcttaaactcctggcctcaagtgaccctccagactcagcttcccaaagcattgggattacaggcatgagccactgtgcctggtcttttttagcttcttctgcttgccagcaacgtttggctttctgtgacttgagatacatcactctaatctctacttccactgttatatggccatcttctgtgtatcttcacatgattctatttacaaagacaccagtcatactggattaagggcctgtcttattccagtaagacgttatcttaactagttacatatgcagtgactctatttccagataatatcacattctgaagtactaggaattaagacttcaatatatcttatggggtgacatattttaatcctaggggtcatcaagtttatggaattaacactaaataagtttatgaataccagcaactttactagctttttttttctcctaggcatgtcactcagatcattcctttagttaattgtacgcatgaaaccttaaaattgcaagtaacaaacagtaatcctgaaaattttgtcctggatattaacagaaaatcacaagtaagtaaattcagagagccatgaaatttactgctgctagatcattttccaattctgattttgggacactggtggagtattatcacttgaattattactaaggatttaaatttctaaaatttaagaattgaattttataggcccagcggggtggctcatgcctgtaatcccagcactttgggaggctgaggcgggcagatcacttgaggccaggagtttgagaccagcctgcccaacatggcaaaaccccgtctctactaaaaatacaaaaattagccagacgtggtgtcacgtgcctgaaatcccagctactcgggaggctgaggaatgagaatcacttgaacccaggttgcagcggttgcagtgagctgagatcgtgccactgccctccatcctggacgatagaacgagactctgtctccaaaagtaatcaaaaaaaaaaaaaaggattttcttttatatacttctccccttgaattttaatttatctacaaaacaatatcatgttaatataaatttttaaaattatatatgctagaatcatgctcatgattacttcattctaataaattggttgcgttttctttctcaccattttagtaatcggtttttgtaatagtttccagtattatgattattaactctattgtcattatatgttgccagggttccaagggaccagttgttttctagcctttcctgagttcttgcccatcccccattcctcacccctgacacagacacacactttgagacaatgctgacaactctagccctctctgcttctttctctgcccaactttctcattcttagatcctggcagaggctaggtccagtcaatgatactaaatcactcttctccttcctgcaagttacaaaataagatcctaaggtttagcatgactatctctgtttctaaagcataggacaccatttatttgcagtgagtgtcatactttcaggtaaccatcaaaatgataattacaatagactgtttttatcaagggacttcaaagtaaatcatgaagccctgctagtagatatagtatttaaataaaggcttttactatttgttgtttaacgattgtttaacaaatctacactttgatttctttatttatatcttaacatctgtctcttgtcagttactggttgccaacttatgtaatgatataaaagtagttcttagctatcataatatgtcaaattagaaatcactaattactatattgctaaaattggtgtatatgctttaatcttagaaagcgtatattaaagtgtacacacattattatatcattcaataccacatttttccataaattatatgaagtctgatattcaggatataatttatatattactgaaattcctcattagaaagtggtgtttttgtatcctttatatctctacttttagagaacagtctaatctgtggtccaagggaaaataaatgtaatattttgcacatccaaagttacattacataatcaagaatataaactctgttttaacatttccaaccatggctttctagtccattaattcttctattcatttatcaaacattattgagcactgaatatgcaattaactctaatattagaaaacaactcaaaaagctatttatgagaaaaatactatcacattttagaaaacaaataggagcacacattaattataatgataataaatgaaaaatatatagagagaaatatccatctatttatatccatggagagaataaactatttttccaaattttctaagttgaaagactatataaaatgcaattttacttattatttttgctaagtctgacagtgaaattaattaataatcctaaagtgtatattaactgataatcctgaaacattcaagatatcagagagcaagccagcctgagataaaaatattagatgtagataagctacaattgtgtaataaacaggtgactctgttctaaatataaaatttagtttgcatttgcatttcataaataattatcacagtttattgggcatcaactgctgtattcaagaaggattgaaagatactgcttaattgtaattttgccttttcaaagtttttctggcaaaatatattagtgtaaaataatagacttccttttcatacatgtgccactcatgctatcattttgtaagtgtttatcttcaaattaaattatttccagtgtagcattttgattacataatatactcaagcccttattatattgtgttggagtcactggcttctttcacagtctctaaagaagtaacttaaactaatactgtacagactcaagttatcctagcaggtcacaccttgaatgtgtaggaggaagaggaaaatttccttgcacattaaagaagcatgtcttacacctttgcttagaaacagttcatttcttttgaaatgaacaaaagtaacaaattaagttacaggtggtttgacatgtaccttgggatgggcaatatgctatgggatcttacataaagtgtatatgtcttttattgaaggttcgaactgagctttaaaaattaaccctgacttccttgtacagaatgagtcctccaagtggtgattatcttggataagaacatgatgtgatcacccccaaacacggtttaacatgggccctttgaacaatattcaaggagcaggcatactgagaacagataatgtgtgcaagacaacacattaatcacacaaacatcgaccctgcatatagctagtacacaaagataccaactcaagccaattgggtattaatttttgttccccctttgctttttccatttacacagctgatcatatctcctcactccaccacagaattacctgttctcttttatccttctgcacttggaagagctgatcatcaagcttgcatcaacttctactgtactcaggtatgatagagtattcttggaccaaaccaagttaattaaattttaaatcaatatataaataaatataattcatcattcactcaattatcatattttgcaagtaaaacaagttaattataagttaattaaatgatttttgtaaaataaaatatgcattatgtacatgcagacatctgaagaaggtatttttaaatacatagatcagtggaataaagacaaatatatacccagatttaaaacacagatatttcaatgtacatatcaaatcactggcatttatgttaattttctgacttgagttttactactcaactttccataaacttaaatataaaatatagagtgcaatttgtaaatatttgttattttttccactgcatttcatctgaacagtgttcctaaatattaatttttaaaaacaatagtttttcgcttttgacaatctctaaatatgtcccatatcattctaagaattatcccaattcattctcaccgtagtcctataatggaagtactgttatcaatcctactttatgcatcaggaatctgagacacagagaaattaaaatcaggcagccagtaaaaggttgaggtgtgacctgaatccaggataatctggtttcaactcatcttcatgtctacttttcacagctacttagttagccaagtgattgttaactctcttactaccaattaaaattttatgtaaaattttaccatttatattatttttacttcttcaaatgttcatggggaggaatgcaaatggaggaatgtactttatatcttagaagacatcaaggagcttacaaaaccctgacatctgaggggcagtggaatcaaatataatacaggcgtctccatgtcagtacagggcctatgggtagctgaagtatcttcatttccaaaaaatttgtaatttatttttagaaaatttgttttgaggctgttaacttgtctaaatatggtaatgactaactaacactttacctgagacaaatgctatagaaatatgcttctttttcaaaaatattaaaggagacaaacagtgatccttctcatacagaaggaaatatataatggagattattttctttcagacaagtaattttaacaaagctgttcttttaagcgattgctgcatagcaggattagaaccccttcatcataattattgggggcaatttttttgcttgcatttctggtggaaagcatatctattcaagggcagtcttagaactcagcagggagataatcagttctgtatcttaatagctttaaaaattcctagcctagaagttgaatgttaaattctttatcaaacacaaaaaggctcaaacaagaaaatattatcaattcaaaccttctatgagtcagttgaacactgatggttaatttcagtcactctgagtatctccttccaacttgtagcaaatctataaggattcagccatgattagacttcaatcaataattcatgctttcagctatcaggtctagacctcctcaaccttctcaatatattgctgtaacctttgtgatttttcttgccatatttatcattgaatcatttagttcttcctcttttatttaattcatccagttgacatcttttgcaagaaaaactagttcatcataaagtattaattgaatgaacttttgaaaatgtggtatgcattatgtatgaacaggcatctaaagaaaatattttttaaaataaactttagagtttatttttctaagtctgagtttggaataacatttaccattagggaaatagccatatagatttccatccctctcttgatttaactgattaaatctatctaaactgacacacacagctgattagctgatgaatctaaagccaactaatggctgttcttatagggtaaactttatttctgatggtacctctttgctggattgagggaaatggctatggttcattatctgcttcatttgtttctggtttcaattcatgtgaaaaactctgcaatgtaaaaaatctaaccattcagttatgattagggtttgggttaagttcaaattgtttgtgcagattttgaatcctgtgattaatttggtcaggacatcacaactgcaaatatcataaacttatattttatgcaaccagagtctctaaattaaattatgttactacataacagaataagaggagcagtagtaagcagcaaatgtggtaaattataacttctctttggtttcgaagattatgttctgagattttctttcttggttttcagatgcttcctttttattttcagataggtgccttgtttatttcattcctatttgattgtatgatttgtttcatctaaaggtcagaatagcaaaaattaaggaagaagttataaaatcagtggttttacaatccagcgtgagtctgtgatctttgtagcctgtgcctatggaaagttctgattcttcttaacaagttttaattctctggagctcagtgtgcaaactagatttgctatcctttatatccacttgttttctctttcagaaatatcaaaattgtatctttaaaagttttaatgtctctcctttagaagaagattgagaaaaatgtgggctgaatatattaattgttgagtgcatatgtttgctgggttactttttaatttgccgttctgaacccaagtgaataatgtaatcaatgctaggaaaagtgttggatgtcagtgttcaataatcgtgggatgtggtttaacatagaaactccagtactctatgcgacttgagaaaacatgaaaccatgaccttctttttgtcacttggctcatttacaatggtttaaagtaacacgagttctcccatttaagatttcttttataaaatatccaaatagtaaataatttacttaaaccactttttaatttaattgaactctgatgcttgactttaaacagtcaattttgtgaatcaagttaggacgttattattgaaaatatagttaatttgtattatgctagtcaaatctgtgactaatagtaatatagtcatttgaagataatatccagatgaaatatgcctttaattctctctactaaggaggcaggatttttatgagttttctttcactacttctccttatttgaagtaatcttcaagcaagtttccctctttttatcagaatttaagcttggaaacgtctatatagtttgagagattataaagtaggacattgtttgtgatccctttattcatctgcacattaccaaagtgtttgttgcagaagtttaagagaccctggaactgagtcacagtgtactgtactctgaagggacttttatcctaaaatacaaagagattttcaaacagagctttacatgctaatgaaacttagataaaaataatagccacattcaatctccttcacataatttttgattcatttatccatatcatgtgataacagataatgcactggactcgatgatggagataaataatatggcatgcaattgtacatacttccttttattggagcttcaatctgtgcctcatcttctttgccttaatgtggcagctatctgaatttcatttgaaattcacccaaagagtttggaaactacatgcagtgtttggtatcaagtttgttaaaaaaaaaaaaacttgaacagaagtgccaggttttccattaaactttctcttttatgttgctataataactttatgtgcattgaaatatgtttgatatttgaatattgcacttttgccctcttctgcctcaaagtaaaaatacatagaattatttttccataaaattaaaaggaatttggaaaagaaaggaaaaataaaacaatgctttttaacaacaaaacttttcttatctgtccaaatttttatatgcattatacttattaagtattgcaaataaaatatatgcagttaggacacataagttacgaatacttatcttcaaacagtttacagaatggaaattctacttatctggagtaggactatttccccagcctctagacacggaaagaataaccacacgcattggtcttcagtcaactattgttatacctttcaaaaatcccacaatggaagatgtcctcattgatataatactgacaagtaagttgtttttcttatattttacatgttattttataggtatttatcagacttattttatcatagaatcaaaacattttagaacaaatgaatactttagaaatctgtaaagaaaattatcttataaaagagaaaacaagatttgagagacgcagtattttggctgaaatcacagctcataatggtacagaatcagaattagataactatataacaaatcaagttcttccaaatttggtctataaacccaaatatgtaaattagtagatttgtaagattcttatgatattattcaaatatgccaatgcttattcctcaaaactttatagaaattctgatatggtgattttgtttcctttttgcattttcttaataaagagacaacatatttggaataaattgtggcttcaatcagccttgtcccttttttatgccatattgagggtatatgtttttaattagattatttgaagagtttgatcactttatattaaacaaataaataatgtgagtctgaattaaaaattaactcagcatgagttttttgaaacacattttcaatctaatattgagcagtaccaatttatcttttcaactattattactacttctactaaaactattattagtgcaattattgggttaaagttatatattttatggttttttatataaatgaccaacttactctccagaatgtttatacttttgcaattcatgctgcaattagaagtataatatagacattacctattttccagaactgtgtaagccctgagtaataacattgtctttagtctccatcaatctgattgaaagaacattatattgtattatcattgcaaattttttatataatgttgaagctgaacatgtcatttacctgttgcactttggtgcttttctatcatttcttcatcttcttggaatgaaataattttaaatattaagaaagtaatgtcatctcatgtaaaattcccttataagaattttggctgcgatcaggagaggcatgtggtgtttaataaatgttgattgcaagctcaaggaaattagcattttaagatggaaaagacttgagcatatgtataagcagaagggagaagccagggttgaacaggagttaaagatataaacgaggtaaggtttaactgatagactaagggtctaggagggttgggatcagaacagaggtaaaggaagagctgaacaggagaggatttcttccttaggtgggggtaaaataaaacaaatatgggtgtcaataaattggtaggtagtggaagggctttggaattaggagcagtcatatatttacatttttatctgctgaggaagagagatatagtagagaatttgaagagtggagtggtggtttgaaataactgttggagaaaaaggaacatggagctgacaaaattaaatataaaagttattgtgtttggctgggatttaaatcataaatttagatatgcaccaaaaaaaatatgtgtttgtgacgtttataccaattgtagggcacagaatttttagaatgtcagcatacaaggcgtatcaatggatctttccagggaatgaaattttcaggataggtgcagccaaatgactttataactatgagcatgttataaaaacaaatttggattaagattttaacattaaaaataaattttaaaataatgtgtgactttctagttttctaacattgctgtacatttctttctgctatgtaacaataaaacatagcttgacaattaaaaattgatcagtcttttgcagttcaaaacagtctcttttaagtaaactcacttgctcttgggcaaatgttcaggctttgtttctcccccttcttccttaaacctgaggagatatgagacaaaggaagattcacagacctttaatatcttgtttctctttctctgtctccctatcctatgtgaaaaagaacttctttccccgttgttgctgatggcatctccctttctgttatattcttatccttctcccttttgtggtatcttttttaggcattatctacgtatctacttgtgcttatagtccttggtggctaagcctcacaatttgatctacagaaaaacatggtctacagaaaaacatgactgatgagaagaattaaaatatttaatatatatgcaaaatatactcattaaaaatagagattaatactatattagttcatttttgcactgctataaagaaatacctgagaattggtaatttataaaggaaagaggtttaattgactcacagttcttcatggctggggaggcctcaggaaacttacaatcatggtggaaaaaaaacaggcatgtgttacatgacggcagggaagagagatcaagtgtgtaggaggaaatatcaaacacttataaaaccatcagatctcatgaaaattcactcactctcatcagaacagcataggataaaccgccccataatccaatcagttcccacaagattcctcccttatcacctggggattacaatttaagatgaaatttgggtggtggggacacaaagctaaaccatatcaaataccttctcatttaaatatttggaaatgtctttagattatttcatgataggagtaggcaatctcattttgtcttttaaaagaagatgtaaattttcttacagattctacagaattaaaaaaaaattcttaggcaagttgataacaagactcatctcaccaaatggttccttgctggtgtgaggaatctcacagcttttcagatcctgcatcctgcattcctcatttttctctctctctctctcctcattagctgcaaatcctggaatgatttcttgcccttatggatagcatggcaacttgtgcatagcttgatttaaatatctgtcacactcattgtagctaatatttgttaatcccacaatatttgtgagatctttgcagacatgatctattagtaacttgagcaaatgagacagaagaggcttttgatgcttgtctgctgaatgactggaccataaataaaatacccaaatttctaaaacttagagataatacggtataaattaagtaccaaagatctttggaatatcaaaagacattatttctgggagaagtaataaaaatagaaatagccaagacattagcaggagaaaagacagagaattgggcaatccagaagtttgatagtgagtttgaaattctaaaaatgctgccttcttggaaaaagtagtgaatttgaagatctttatatattttatatatttctaactctgtctgtgtagtgatggaagaaaaattttagctgtattaagtttaacagagtttaattgagcaaataatgattcacgaatcaggcagcctccaaagccagagtaggcccagaaaccagcatagccacgtggtgtaagatttatggacagcaaaaggaaagtgacatacagaaaacagaagggaggtgcaaaaacagccgattggttacagctctgagtttgccttatttgaacatggtttgaacacttggcaacctctgattggccaaacctcaatgattggcacaagagtaggcttacagtctgtttacagttccatatagcttatggttctcaatgtacagagaaacctttaggctgaacttaaaatatgtaaggaggcagttttaggctaaactttttaatgctatctatctatctgcctatctatctatcatctatctatttatctatctatcatctatctacctacctatctgagagagagagagaggcaaaagagagtggagatatgctaggatattgaaaaagtcttaaatactatcataaggaatccaacttttatcctttagataatgagagttttcaaaagattacctgtactttataacccgcattttgaacgctaactgtagaattatttgtggatgacggatatggatgggttgggggaaaactggaattgagaagcaaagctcagaagatttaagccagtaacagtggaaaagtccatgaccacaggtagcagaaaagctcacagtatatacctagaattttccctaaagcctgagaatctgtttctttagcaaacatatttaatgtttcatgtgtccagactactttttcttcagacaactatactatgttgcctaaaagtatgtttctaaaggcttacctgtattcctgatatttttaatactcaagatgagtgttttgttatatccatcttaaaatagtccgatgctaaatattattgtggttgtgctatttggagaagaaattgagcaccttgggcacacactggtctgtgcattacaacaaacttaccattatttcctaaggagaattttggcaccattcacagggaattacttagtggagtggcttgcccttcactcaagcataaatacttgttatgctccacaatttgcacatgagggtgtgaacccgacctttaacttaactttcagttagggcatatggtgcccttgtaatttaacaggtgatacacagttgtgattgaatctggggacacataatagttatcaattataaagactatactgagcacttcatgtgtgtgattttttaagttatctcaggacaacaaatattcaactagtatttatctgggccattgtccagctaccaacacctgtaactcttggatatttcttctggctgccctagtgagttaatttttcctcaacctatggatgacaggaagtggtggaaaaatattacagttcccattcccctgagcagtatacctttgagatgtgtgttctgcactggctctcagagttccctagctgccttgagcctcatgtatccacagtagtaacttcctttataatacaccattcattggagtccttctaatctttgtctcacttttgctcttccctactggcatttcctgaggtcacgtcccaaataacagcttctgaggaaaccccaactaagacaggaaccctctgaaattggcgttatatctgttttaaggaggataaaattgattaatggagaggcttaacaacttgttcacgatcatggagctattaagtgaaggaagtaagattaaaaacccaactctgcaaagccaggtttctgtgtacctttgcacatggcttctcagtaagcaggcagaacaatttctcactaactgttcacctagttatatataaaactgaaaagctcaaatggagagatagtaaaggattacaggaaagacttgcaatctgtttctgtgagtggtctgaaatctacttaacagattaaataggagccaaaagcccagtacttgaaatcaactacaccctcccccaaccacattaagaattgtgttcagtgaatttcactgtgttgtgatgtcatttacccataacaccagattgcatagaaatattctaaggaggtcatcatgatgttggtggagatgttatcaaaggatttcttattacattgcaatcttttttaaatgaaatctttttaagaatcagctgttagtatcaggaagaatggttgcctcttttgagcaattgtctggtttttgtactgtggagcctgattatgtcactacatttttcctcagtatattagtttctaagaaaacattttggcttattccaagtaagtgacatgaccatactgtgtctcatccgtgactgcagatggtgtccctaatcttgtttcaactttctaaaaaattattctaattcatcttttttgtgttttatatttttgtgacatacccaacttaggaatagaactcttcacgcaaggagacattcaacctgtaacaggaacagggtaattttttgttttgagacatggtctcacttggtcccgtaggctagagtgcagtggcacgatctcagcttactacagcctccacctcccgggctcagatgattctcccactccacccttcccagtagctgggaccacaggcatgtgccagcatgcccagctaatttttcgtattttttatagggacgaagttttgccatgttgcctaggctggtctggaactcctgacctctagtgatccaccttccttggcctcccaaatttctgggcttatgagccactgcgcccagccctcagagtgaatgttggaattcacatggtagaattagttatgaaaatccctggaggtcctctgaatcttatctaaagtacatccagagttgaacaaatatttatgtaatatatgtagtaatcattgcaaatagccaatcaggataagcatggttttatacttaagaagagagacaaattggtgtaagaaaatctcccagaacctaaaaatccctcccaaattcagacatgcaacttttaaaatatttgaattaagaaataaatagtattgagaaatttgagactttttggcagggaagttggggtatcaaatatattaagttttgtgttttttttttctttctttttgagacggagtctcactctgtcgcccagactggagtgcagtggtgtgatctcagctcactgcaagctccgcctcctaggttcatgccattctcctgcctcagcctcccgagtagctgggactacaggcgcccaccaccacacccagctattttttttttttttttgtatttttagtagagacggggtttcaccgtgttagccaggatggtctcgatctcctgacctcatgatccgcccacctcggcctcccaaagtgctgggattacaggcgtgagccgccgtgcctggcctatattaagtctttataacttagtttaattgggttatttgtcttagtttattttgctcatattaacatattgttaatattattgtactaataaaaatatattattgtacaaataaaaagtaaatgtagaataattataaccatttttgaagtgagtaatctgagactctacttgcttacaattattttatttttagatgctgataagatatcttaacatttggaacttgttttatctgattcttgattaacaacactccaaattcagtaaacaatatttgagagcttataaaaattcatattcccaggtccacattcatttattctgattcataggggctagggtgaggccctgccatcacaagctattccaatgcaggttttcagaagactacacgtttagaaacactaatctatacacaatgatctcaaaacatgtttcccttttatcgtataccactgttagtaaatatcttttggcatttccttcaatgtatatatatttacatttgaaaaataaccagttagcactatcaactcatatttttaatgtaagtagagcttatctttttaatagagaattaataaacattttgtatctattggtttgaacttgttaacattgttaacattggataaatgttgtttatttgtgcatatttatatacaggccatccttctgtatccataggggatagatttcagaacccccaaggatatcacaatccacaaatccccatgtccctgatacaaaatggcacagtgtgtgcatgtaacctacacatatactttcatatattttaatcatctctagattacttagaacacctaatacaatgtaaatgctatgtaaatagttgtcatagtgtatgatgtagggaataaagaccaggaaaagagtctgtacatattcaatgtagatgaaaccatccattatctttttgaagattttcaatctgcctttggttgaatccatggatatggaacccatggatacagaaggccaactgtattcatcaatacaatctatttttaaacagcaggctcaaatagactcttaatatctacttgttgagtatttcactcttaatatctgcttgttgagtagttcaaattaaaattccaagatttttaaaatatagagatgtggtcttgctatgttgcccagactggccttgaactcttggcctcaagcaatcttcctgcctcagactccccagtagctggaattttaggcacatgccactgtgtccacctgaaagttccaagaatttatgagtttattttttaaacatcatagataaaaccatttatattattaaatatgttcttcaaaaatgccatttaaatctcattttaaaatatactttgaaagatattcatcttataagtttcctattagaggataatttttattctatttccatctccaccgctgtttttcttcttgaatgtgacattgaagtgtaatatctctttattttttaattaggtgtggaacatcccaggaatcttgtcatggatcattgctgggatagcttcatctatgagagttctgccttcagatttagttctccgagtgaaatacaaggtacaggatttctaccttacattctatcattctgtttgttgttgcatttcagagataatgaaatatatgtctgttgccttagtaaatatttaacacaaattaaaaatataattttaaaattttggaacaaattttagtaagttgatagaaaaacatggatggtaaaacatatatatatatatatattacatttgtattatttttaattcctcaggacataagtaagatttgccaagtattttaactttgaaattttccatggttgaatagcataccacttaacacatggttatatgagtcaagaaagatttcagaaaattataaatagtgtgttaaaactactggtactaataaaaagtagtatattgatagtaataaaaagtagtatcagtagttttaatactaataaaaagtatcagtagtttcaactactgttttactgcgaatttattacagggtataaatttttgttgttgtttggttttgttttgtttttgagactatttttgttgttgttgttgtttagttttgttttgagacagagtctcactcttgtcacccaggctggagtgcagtggcacaatctcggctcactgcaacctctgcctcccaggttcgagcaattctcctgtctcagcctcccaagtagctgggactacaggcgcacaccatcccgcatggctaatttttgtatttttagtagagattgggtttcaccatattggtcaggctagtctcgaactcctgacctcaggtgatccacctgccttggcctcccaaagtgctgggcttacaggggtgagccaccacgcccagccaatatctatttcttctatatattaaccaccccacctgtgtattgatgaataggaaaaattctaagaactaatgaagtttcttaaaaatctaacgctaaaaaattatgaatttgcttaacaataacaatgttttaaaaatataaaacataattgttttggtaaatatgaattatcttaacataattaatacaaaaatactgactgaaataaataaccactactaacatttcagtaagaatgggttaattaagttctcttaaattttctgtagccatagccatttataaaaacatcctaaatgtcattaattgaattcatttgctacaacttcaagggacaggtggatgttattattattctcactgaattatggagagtgcaattcagaaaaattaacttacacagaatcaaaataattgcttaatggcatacttgaatctttttgtgtttcaaaatttttctttctatttctttgcaatgcattaaaaagagtatgaacaacagttcacaaaagataaagtacaaatgggcaaaaaatggtttaaaatatgttcaatgtcactaataatcagatactgatttttaaaaatgaccatctagattttttccctttttttaagtttgtttttgtcttttaatggaactacaaatgctaatgtttctatagtgaaactggaataatcaaacaatactgatggaaatacaaattactacatagtttttggaaagcactctttgtaatgtataaaaagaaactttgtaactgtcattcttttgacctagtaatgccaattctgttggttgcaatgtaaagtagtacaactgctatggagatcagtttggaggttcctcagaaaactaaaactacacctaccatatgatccagcaatcccactgctaggtatataaccttaagaaaggaaatcagtacattgaagagatatctgtacctccatgtttattgcagcactattcacaatagcccagatttggaagtaacctaagtgtccatcaacagatgaatgtatgaagtaaatatggtacatatatacagtgtagtagtattcagccataaaagagagagagagagatactgccatttgcaacaacgtggatagaactgtaggtcattatgttaagtgaaagacaggcttctcatgttctcacttatttgtgggatctaaaaataaaacaattgaactcatggagatggagagtagaatgatggttaccagagattgggaagagtaatgggtggcggtggggccatgaggggaagagggcaggttgatgggtaccaaaaaatagaaagaatgaataagttctggtatttcataacacaacaaagtgactatagtaaaaaataatttaattgtacatttaaaaataactgaaagggtataattggactatttgtaacacaaagagtaaatgcttgaggtgatggatatctcatttaccctgatgtgattatcacacattctatgcctgtatcaaaatatcccatataccccatgaatatatatacctaccagatacccacaaaaattaaaaattgaaacaaagatatattcaaagtatggttaatgtatgaataaatatacttgatgttgcattttttataatagcaaaaaattgaaaactgccttcatgtcaaataatattgttatatttgtggcaactatttatacgtctgcttatacttaatttcactgattcattaaatacgtgagccattttctgtttttaacatttcttccattgattctacactatcaatgtcattccacattttgaaatcaattgaaaattcacctacattttctttttcttctcctttgtttttaatgaggaaatggttacaggtaggtaggcaacttttactccttcaatttatctatattgtgcttttttgctgtgtaatgaaaacctaatttgattgcccctcacttaattagccacttttccattttttcttgaataataattattattttgttgctatttatgtttgcaatgtgacttatctgatattcagatcatatatatacttttccctgcatctgtatttcagatctaatgccagtgccatacagtttaaaccccatggttttgttttcttattttatttctttctctctggtgtctttaaatgatttattttctcttacctacttattcttctagtaaaaattataataaatttttatcaagtcccgcccaaatcccaattattatttaatggcaattacatttggggacaactacatctttatagtatttaaacttctttttcagggccattcatttcctcactattttgaaacacagtatttatgactgccgataaaatctatatttacaaaacaaaaatataaaccttctaataactacttttattttaaatactacaattagtagttatatataatgcaatttttatgcaacaaagagaccaacatttgtgttccattttaagaattttagcttgaaaaatagaaattaaatgtagtttattaattataatttctatttttcttattgtcataaaatattttttcaaatttaaaccagtttcttggtgaatttcttattgtcttctctagtttctgccatgacttgctttctaagataaacaatgcacactggcctatgtagtgtttttgacagttcatgatgtgctccctgctgctctatataataagatctccaaaggggcttgtttattttatagaaactttttgtttgctctgatattttacatgctataatactagttgtaggagtttttctgcttatttgaggaacataaaacattaagagtacaacagaaatgggagtttggcttcttatgtcactattggcataagacattggggcactattggtactataaaaattacctctagggacactatcatgtaacagaaaaagcatttatacccttaaaactaagtgttcctacattaacatagaacattttcttggtgaatatttgagaactgaaaagattaccttatccttgaccagtgtttacctaagtattttgtaaaaacaagaacacaaagaaacagaaacaactaagttatatacacctactatgtagctacaaaaatagaattaaaaacaaataaaaaccttaagttctatgcttaaatgaatttgagaaatacttggctaaacaaagtttatttatggcagggtttcctaggcctttttttttttctctctctctctaatgctatgtgtatttttaggtagaggaagtgatatgtatttcaaaatgtatttggccaagaaatatacttttgtaaatgttattttctcataaactgattcagcagggaagttctaaacttgcaccttctaatttgccatatgatgtgacaatgcattctattcaattttattcaatattaggcagtaagggagactgagtgacaactgttacgactaacatatgttcctcaagtatgaatgctactgcttcatttcataatagcagccattctattcatcatcccagtcaatctgactttacaaaaattttagtctctgtattacaaaaggacatggataaaaataatttctgtaattatttctcatattactttctttcagaaattttataattccttgtgcttataaagttgtttagtaaaattagatctagatgtagttatatgttgacctagattggagctctagccactgaaactatatttttcccattggaaaaagggttcacagcccttttattcctttaagcaaatatatatttctagaaattatttccttggaatgagcttcatactatactatagatagtgaagtacttcattttgtttttagaaagttcactgttcctttcgttatcattcaaaactggtgacaaggactagacaggaagaagaaaagggtctttctgtcagtgaagaatcttaacctgccaggttttcactttgaaatgttatcttgtctacagatttaattaggtcaaataaccaagaacgacacaagagtgtaggtgaattgtgatttcaaaggacatccttctacaaagctaataaagttataggacttgcagtattcttttttctcttttaataggaaataatcaaatgttactgaaacaagattaaacttgtggaaatacattagctgtaacatcgtactgggtcatctgactaacatttaaaaaaagttggaggtttagcattattacatctctagtgttacatactgtagcactagagaataaagtactactttacaaatctacacatagatgtaaaattagacctagaatgttaggaaggcagccaaggtatggggactgagcattatggtcaaataatctgtgttcttcttttgactgtaacatggataagctgtattagcttgggctagtttctatcctgtaagaaccctattttggacattattaaaaaatcagttttacctagtaagactttttgataaacatacacaattgtgtatgtgaagacatttctaaacactaaaactatgtacaaatatatgttattgggattattatagatgaaaataggttaacttcaaaatggacttctacttttcctcaattttataggaaacaagatctttcacctgctgttacatgccaggaaatacattactggaaaagaaagaaatagttatttttcttatgaaatccattttttttctagatgaaataattcctaaacaaatggttttaattttataaactaaaattactaattgattaaataattttggtatcttggtgaataccagttttctagaaaataactttttatgggactgttgatatctatatctacagttacatctatatctagatttaaatagatataaaaaattatccagccttattccttttgacattcctaatccttcatatattttactcttcctcaacatttctgttagaaaagactctccatatttcagttattcgtatgttaccttcacaatttttggcatacctttgtatcacctatataataatttaaaggcattctaatggaaaacggtgtcatttaccatgaacaatagcaatatacaatgtgccaggagctattttaatcactttacaaatattaattgatttagtccttacaacactataagataaattccattaatattcctatgttagagatgagtatgctgagatatataggagttgtgcccaagaactcacagacagtacgtgctggaacttaggtttgaatttggggcttagactcttaccctctacacagtacttctataaaacaccaataaataacttaaaaaatgtaaacatatagatcccagtatcactcgaaagtatcttaaacatcactgttacggaatagttttcctgggaagaagactctgaaaggagggtagtgggtaggaagtgtattagggagtgctctgaggatcaacacaactgagggaagaggatgaagcaggattgagtagggggagaaggtggggacaaaggtgtcagctcacacaatggctagcactgaagctaggatagctcctcagagttgccccaatttgggatgaagatgccaggattttacacatccctccctcaccttccacatcaattcatcattgaatgcactctgccctcaggaaaggagttttaccttggtcaggtgactctcttcagctgaaatttaggtactatatactggcaataatctcaataatctggggcataaaaaagtcatgaagatatagttctcttttacctagaagctttgttgtttacttttcataatttcgttactctccataatttcaagtatggtaagatataggactcaaagttccatttagtcattatgtataccaaattttcctagcagcatttatggttaaagccatacattttttcattgattttttgtgctatttttctcccaagtcaggtaacagtatatgtatgagcctgtttctagactttatttagttcaaatattctattcatctatccttgcagtaataccatactgtccactactacagcttatagtaagtcttgatatttggtaacatcaatacttcaaactttttctcttgttcaggatttttatagttattctagatcctttgcacttacagaagaattttggaatcagctagccaatttccaaacacacacacacacacacacacacacaaacgtgctaggattttgatttgaattgtgctataaagatacccaaaaatttagaagcgactttgaaactgggtaataggtagagagttgaacagtttggagggcttagaagacaagaagatgtgggaaagtttggaacttcctagaaacttgttgaatggctttgatcaaaatgctcatagtgatatggacaatgcagtccaggctgaggtggtctcagatggagatgaggaacttattaggaactggaataaaggtgattcttgctatgctttagcaaagagactggcggcattttgcccctgccctagagatttgcggaactttgaacttgagagagatgatttagcgtacctgcagaagaaatttctaagcagcaaagtgttcaagatgtgacctgggagctcttaagagtgttcagttttaggaattcacaaagagatggtttggaattggaacttatatttaaaagggaagcatagcataaaacttgggaaaattttcagcctgacaatgcaactgggggaaggacactctcttctataaatggtgtggggataactggctagccatatacaaaagtatgaaactggacccttcctttcaccatatacaaaaattaacgcagggtatattagagatgtatatgtaagacctcaaactgtaaaaatcctacaagaaaatctagagaatatctttctctacattggccttggtgaagaattttcagctaaatcaccagaatccattgcaaaaaaaacaaaaaattgacaagtgggacctaattaaactaaagttttctgcacagaaacaaacagaccaacaaacatacaaaaacctgtagacacagtaaacacattgggagaaaatagtcacaaactttacatctgacaaaggtctagtatccagaatctataaggaacttcaacaaatcaacaagccaaaaacaaataatctcattaaaaatggacaaaggacacgaaaaaacacttttcaaaagaagatgtaaaagtagccaacaaacgtatgaaaaaatgctaaacatcactaatcattagagaaatgcaaatcaaaaccacaaggccgtaccatctcacgctagtcagaatggctattattaaaaaatcaaataatatctgatgctggcatggttgtggagaaaaccaaactcttctacgctgttggtgtgaatgtaaattagttcaacttctgtggaaagctatttggagatttctcaaagaagttaaaacagagcgtccatttgacccagcaattccattactgggtatatactcaaaagaaaataaatcattctaccaaaaaagactcaagcatgcatatgttcatcataacattattcacaatagcaaagatatgcaatcaatctaggtgcccatcaaccgtggactgaaaaaagaaaatgtggtacatatatatcatgcagcaataaaaaacaatgacatcctgtcctctgcagcaacgtgaatgcagctgaaggcaataatcctaagtaagttaatgcaggaacagaaaatgaaataccatatgctctcacttataagtgggagagaaacattgagtacacatggacataattatgggaaacaataaacactgtgagggtgggagggaagggggattgagttgaaaaacgactcattgagtactatgctcactacgtgcatgatgggattcataccccacacctcagcatcatgcaatatacccatgtaacaaacccacacatgttccctctgtagagaatataaaaggtgaaattattttttaaaagactccttatgttgaatatacaaaaatcaattcaatttgaatatagtagtaatagataattggaatttgacattaaaaatgtcatttaaaatacaacaaaaaccctgaaattgttaaataaaaatttaacaaaacacatgcaagatctttatactaaatactaaaaaatctgatgaacaaaatccagtaagcccaaataaataggaagcgtattatgtttattgattggaacacctaatattgttaaaatggcaatgttctctaacttgatatatagatcaaatgaatttccaatctatgtcccaatatgcttttttgtagatattgaaaagcttgttataaaatatatatgaaaagacaaaagagcagtaatgtccaaaaaattttgtaaaagaaaagcaaattggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagcagagattgcgccactgcagtccgcagtccggcctgggtgacagagcgagactctgtctcaaaaaaaaaaaaaaaaaaagaaaagcaaaattggaagatgtacactaacagagttaaggataaacttaaaacctacctaaatttgtattggctaaagatagacatatgaatcaaatgagcacaagggaaagcccagttttagacacacaactataatcaactgaggttttgtgttctcaagaaatacaaaatatataattcatacaagcaagatccacttatggatgatcaaattagatggtgaaagctcaaagacaaagagaatatttgcatcggctcagtgtatttctgtgaaatgtttattaaatacaaacagaaaatactaatattacagtgatgaaacctggaggataccacctcgatcctatgataaagattatcatcactggtaataaaatatatcaacatcatatatcccatgataaagaggcactgaaaagggaaaatagtctctctgataatattctccaaaatatatattctcaatcttatcataaaataatcaggcaaactcaaattgagggatattctataaaataattgacttgcactcttcaaaggtgacaaagtcatgaaaagacaaagaaaggtaaggacttgtcacagattgaaggagagtaagagataatggcagcatctaaatgcaatgtgaaatcttggattgtattctgtgaaatgaaagaacagcagtggaataattaacaaatttgaatacaatatataatttaattatcttgttccaatgtttatttcttcattctgataagtgtacattttcaataataagttataaaaaataagtcagttgaaaaatatcatttctggcattatttcagacatcatttttgttttgttttgttattaaaaatctattgcatagtatataatttctataagatcaagggttttatttttaatttaaggtaaatttgggtaagtaatttgatgagttttggttgctactttacaaaaagcagaacaaggaggatatcaaaactagacagcttatgttcattcctggaaaaatccttgatataccattagaataatgtaaaatgcttaaaataaaagcaaacatgacaagtagcaatagcacagataaattaagagcaagttctggcatgataatctaattttattttgctaaattcttatatttttgaaaatgtgtaataattatattctttattttcaacaaagcattggataaatctatcataatatctttttgtacaagtatgtgtattttagtacattgaacacttatatcccaaacttctgttaaatgatctttacagattttcaataattatagtcactcgcttccttatgctttcaattttattatctatcttccagcttctattaatattcactaggcaaaactagaaccatgataaattagtcagtgattgctgcattaatactgagtagcaaacaaccctataatctgtgtcttacaaccagaaacatttatttatatttttgctcatggatctgcttatcagctgggcattttagatttttgcatcagattaaggactgctctatatatttacacattctgagacatagctagaacatgtttttctcattgtagttagaagatgcacaagagggcaagtggaaatccgatatacctcttaagttctcaacttgtatattatcacctaaatccacattccattggccaaattaagtcacatggttatactcattatcaatgaagatgggaaatatactctgcctaccttaacatgggatgcatcaatgtcaaatcaaaatcaaagcaagggccatgattacataataataaagaggagtgaaatatctggaacagtaacccagtctactacataaggcacaagccagctctctgctctttctacacttgcacgcaaatagctgaacgtggctggaggacaaagaaagcaaaaaagaaagctctgactttacttccgttactaagactaaattgtctgtgccaccatctaaagccagcccctctactcgaaccctagattctgccttttctaatttttcaatgatcatacccgtcaattatccctcatgtcacctatatctacctatatcaatgtttccctcttttagattattcctacagtatataccagcaagttacaatatcaatatatataaataaacactttgatcccatcgtccagttacttctcttacgaatcaaaattcctagaaagagttgtctgtattaactgtctgtacttctttaccaccaattttctaacttacttcattgaagacttaatcctgtcaactttactgaaattgcttttgttaaaaaaatcagggcttccgtgctgcaaaatttaaaggttaatctctttatcttacgttctctctcaatagcatttaatataattgatttttctctccttcttgaaatgttatattcacttgactattttttttctaatctgtcattgttcactcttcctaagtcttcttttctgctcttatatgccatcataactctaaattttggcttgattgtggactcactcctgcctcttctttagttatattatcttcctggtcatttattgcaggctggtggataccatctatacattgtgacttcctaatttatatttccaactataaattctctcctgagttataatagcacattttcttcttcacatggatatccagtacacttctcaaactaaatattattcttgatatatttgccccctcattctcttcctaatttactccccaaagatttctccatatcagttaatggcaccattatttatctagttttatcttgccaaaaacttaggagtcatacttaatttatttttgtctcactgcaaatttccaacacattagtaaatactgatagtaaagccatcaagatgtatcacatttctgaccacttcttactacctccaccacttacaccctcatctacgccaacctaagctgctgcaacagcttcctttatttcagtcttgcaccaagcagtctattcaaacagaacccggagtaatattctgtaacaaaaaataaattgggtcatatcaacatgttgtttaaaacctccttgtaatgtgattttgtaggcttagcatttttgttttaattctcagactcttataagctaaaatatgttctaagccatgcattaggggctatctggtacactttaaatatgagaagttctgttttatgataaacaaatattaagttgctcattatatttacttttgattggaaaaatatatcaaattccaattccatgtagatattatattcaaccagtaaggttaattaaaatatttgattacttccaacctttatttaatttaaagtaaaatttctggaaataacaaaatatattggataagaagaatttaaaatgaaaatcaatccatcaaatgtagttggagccctatctgatatgtcaaaaatttaattacaactgaactaaaattatctttttttttcttttagctgacattcctatgtatatttaagtctaaatgtaatattaaatggatataagttgtcacgtctccatgagtaggaaataagtacacaaatgaaactctctactgtcatcagctttgtgggcaagtcaaaattaattcttacagaaaggattagatttatgttttttcagttatctcaaaaaaggaaaatgatgaatgcattctatgaaaacattcattttagaattttcctattctaactgggcacaaccacacattactttttgtcactgttattcttcctgacttctggtagctataatgggtatcctttctgaagcactgggcatatactggaatccctgcctctatcaaggagaggaagaagccatcattgactattgttcattttattattgcatataaatggtgctgtgatatttgtcacaacttctatcagaaagaaagctagtaggggtaaaatggcaaatgatgatacaattattttgcaaccgagtactcaattcctgggtacattagcaaactctccacatatcacattagtgtgttattagtgagggctaaattttgggaatgccaagcccatatgcagcaaagtatatacataggtttaggtaattagagtgtgttgaataattagtggattattttcaggccatcagcaatctttatatgtaatgtttattttcaaagctatcaattctgtcccatctccaatgtcgcatctccaaaaggtagttgggggtgtgagattttcctaccactatctatctttcttccatgtggaagcatcttattatacatttatctctctttatatctgtcaccatgtgaatactagttcttttgggtcatccttcatctttgcattcatatctatcccaaagtacagtatacatctacctttttttttaccataattctcactcctttcctaatcctaaaactttaccataccattaattcaaactcatattctatcatcagaaaaataccctctattctctacatcaacttatctgaactttctctatactttcttggaacctgactcttccctgagaagatacttctttccctacagcctttctaagttgtggctttttcccacacactcacaatcctgggcgtggaggtagggaagctgtcctccttcttctacgtttctgcttctagaccattctccctctctcctaaaaatctctagttttgatttttcagccatcaaagaaaatgtctctagctccaacactatatttcttaaaatccttgttgacgtcaatatccacatagttgatctcttctataactcttgtactttccctcaattacctgctctttacccaacttagccatgcgtatgttcagattctgtactctcattcccaataacttcaatccctccataatctccatttcaagtgtctcattctcttactcccacctcctctttctccagttcattacctctagtactgcaattctggaacatgctcacaacttgccctttctcatgccttcaactcaccaaatcaatttcatggtccataggtacaataaatctgttgcatatagtctcatcttccttgcttcctcagtatccctttcccctaccttatctaatacttgtaattgtgaatggcgacctcatttatgcctgtctctgttcagataaatgtagctgaataaaaatatacaaatgtgctgaaagggatcacattaaatccatgaccactaaatacaaattgttccctaaggaattcttgcaatcatactacatttcctgagccctctcactcttgacagtttcatccacctaactccttcctcatacctccaaaatctcctacattctcaattttgactaatgacctagagtactaattcattgagaaaaatacaggctacaggcaatcaaatgagaacctccaaaagcttccacaatctcaatgaaacagacgactacttgccaccatatggtctgccttccctcctgttacagtggatgaattcctgttacccttttctttaggtctgtatataattgtccactgattccatctgtgatgactccagatatccttttttatcagtagcttcataaatgtttttgtcttctaaattattctaatttttatataaagttatacaattttacttgtattaaaaattaatgcttatcctcacatcatctcctacaaggtatcacccaattttatgtctctcctttatattaaagctcctaaaaattgatgacacctgaagagttgagtactccgattccaaacctccactttttttttcttgagccagttcagtcaggctatttcttaacactgtatcaaagcaacacttatcaaggtttatatgatctctgtgttgccaaatttaactatgaactcattctcctaatcttacctcacctcaacccctccagcctgaaatagtttttcacttgccttctaggatatcacactatcctagctgttttcctatctcacatcctgcaaagtgttgctttcttttgcttgtgccttttgatctcaaatactctaaaaatgttggagtattacaaaacatggtgtttgtttcttttatggcaatctatgatgaattttatggatctctatctgtgctcataccataggtgatctcatccagactcatggttttagatgccatgtgtatgttagtcattctcaagtttttaattttttttccaacccacaaacattttaaaatttgggcttaaaaattcaatggcctacacattatctgtatttaaatatctaatataaatctgtaaattttacatgtctcaaaacaaaataactctctctctccaaaatactttgtccttcggttttacttgtctcattaattgcaactctgccatgatagatactaagacgagatatggtgtcatccttgctctcacctttctctcacatcccccaatcaacctgtcaacaagccctaccaacctttttagaaaatgcatcctgaatattcctcttcttaacatgacatctacctctaccaaactactttaaattgtcatcttatctgtcacctagtttgataagctaacaaataccccccgcctcaaaaatatatcgactttctaatcccaagaactatgaatattaccttatatggcaaaaatcaccttataaataatgttataatttaccagtgaagctatctgggcctgaaggtttcttctaggaagcttttaaactcataaatagattaatgccctcttttggagggtgtagtgagtttccactctgttggttcccatgacagctggttgttaaaataacattcttgatgtgacaaaattataaaaatggaaaatagattagtggttgtagtaattcaggaatgtaatggggtaggagttggtggtggccataaaaagccaacctgagagattcctgtggtggtggaactttcctgtatcttgactatattaatataagtattctgatttttcttcactataatattacaagatgtcatcattggagataattgggtaaagagtgcatggaatctttcatttcttacaactgtatgtgaatctataattatctcaactatttttgtattagaaaacgatatcataatgagaaaactgtaaaggataaagacatacactatacttggcgtttgtaatatcttatcataaatttgtttaatatagttgctgccttggcatccatttttgtgcctgacataagttatttgaaacccagtcatacaggtggcctagttaagacttcccctccccttatgtttgtttgctattataacccacttgtttctcatctccactgacccaaaacctaaacccaacacattctctctgtctgtctgtctgtctgtctctctgtctctctctctctctgtcacagacacacagacacacacacacacacacacacacacacacacacacacacacacacacacacacactcacattctcccccagctggttgagctccaaggaacttcccattggtcctctgccttcaagcctaacttctctgggacctgtgaataataaatttcttctgttccttgcatttggtttcacctcctcattgtgtctcacctgacacatacacctgaatctaactcgtcacccatcagggctctcctagactgactattttggctaatgtccactagcaatagacagatctcaagaccaaatttgaaagagccataacaataaaaattataacatatctaatttttaaaagataaaatattcatcatttatatttatatgattgctaataaccagagctcaactgtcagagttctagcatcagcatttagaaaagaaacatttatgttttctttccttaggagatataattgctgtgactcgtgtcatgttgattttagttgacatgtataatttagtttgacaataaataagaaaaatattatttgaaaaataatatgtttttgaaataaaaggcaactatttataaattggaaaaggtcttcaaggacccagtgtttagtgacatatgatgatgtttactgctgctttacataaagcatgcccagatctccagataattgtcatggaagtttatcaaattacattggcagctaagcatggtttcacattttaaaataaaccttcttccctattacgtcaaatattcaattttccacccaacttagctcaggtttcaattatatagatttgtaattatgatttatagcctaaagcatgtgagtttccgagctagtcagtgaagctgctgattttattgaaaaacaaaaggccgtaactctcattatgcaaagatgtctgggagcttgcccttcaaaaaaatctccataacctgaaatgtagacctatttataccaccagaatatttctgtgaagagagcagaaactgcatctattaaaatcacttgtaagtgtctggttttattaaatggaacacaaagcacagtgtcatttttctgtcattttatgcagttttcttcaattcagaaatacaggtaaatattataacaaaaagaggactaatacctgcttaggagttatgaataccaggcctttacaagaggtagattagtaggtggatatatatagatggtagagagaaagggaggtagagaaataggtaaaatgtgtgtgagtgatgaacttgtgatgggacatcattttcctttattaaaatttgctatagtcaaatttcctacagtgaattgaaacctgaagactactagtgacatgtaacacttctgccccttttctcactgatattcgtcctattttattaagaatatagaggcaaaacagaggcaaattatctgtttctgtcattacatattaatagattagcttaattttatttgcatccatgtgccttgccttccctcacattacatcagaaaaggactctgtgctcatattggccagtcctccaccagtttactgaatcccatacctactcaatcatgtgaagctgtccaattttctcctctgttttccataatcctttttttttttttttttttttttttcctgagatggagtctcgctctgtcgcccaggctggagtgcggtgtggcgcgatctcggctcactgcaagctccgcctcctggggttcacgccattctcctgccgcagcctcccgagtagctgggactacaggcgcccgccactacgcctggctatttttttttttttttttttttttttgtatttctagtagagacggggtttcaccgtgttagccaggatggtctcgatctcctgaccttgtgatccgcccacatcggcctcccaaagtgctgggattacaggcgtgagccaccgtgcccagccttccataatacatttttaatggattattcttatcagcatacccatgttacaatagctctcagtttaaaagtcacacggctctttatcccctgaccctaccagctgtcatcccatttctctgatcctccttgacagcaaaactatttgaaagcctgactgtatttactgccctcacttcttatatcattatctcacccaagctaatccagttttatacactatcattctcttttactctctgatacagctcttttaattaactaataacctaacattgccagatctaattatccatcatatgcagttctcatcttgctcaatccatgagcactgcttgaagcacttgatctctcactgttttggaaacagttgatccccaggaatcaattctccctttattcttcttctgtttctttagtgagccctgctcattctcctttgctgttcctgcccccctaacttcctagaggctatcttctcttttcatttctatccacattcatttctaatgggatctcatttattcacacataaaatgtcaagttctaaattgatagcctcagcctcaacctctcctttaaatccagactcatatgtccaccagctatctcaatattccccctacagatatctatgaggcttctcaaatttctttaggtgctctgctcaagtgacaccttatcacagagaccttcctggaacaccctgtattaatattgatttcactctctaacctttaactgttttacgtaacaccataagtgctatacattttatttatttgttaatgtctactctcacttgccgacacattctggaatctctgactcaagaaaacaggagatgtgttttctttaatattttatcctcagtgcttattataatgcacaacacataagtattttctaaatgattaaacagaagaataaaataatgtagaataaaaagcatattgcacaaaatggaattatctagacaggtctggggttgtaccttttccataacaaaaccttggtgtgtatattatattagcttccttttttatatgaagaaaatctcacttataaataacttgcctagtttcccagaaatagtgagtaattgagcacagaattaaactcctcttagtatagtgcagaggaagaggaagacatgatgattgatcaataaggtatgttagttatagtagtagtagtaggagacattattttatcttaaaattatctgtgggtaatttaattaaaattaaaaccagccactttcctagaaaaatatacagtttcttaacaatgttttaaatcttaggtgttttttcaacatataaagaaaaatgttatcatggagtaatacggatggaagaagcattaagagattctaaacacatgtgtaaagccagaaacccttccctgttatacatgtcagtggttatgcaacgtgtgcttgacagtcctcaatgtcaggaaactttctccttcattgtgcatcctatcaacagtctctgataatggattattcactcattttgagccacagtgttcacagtaaaagcaatttttgctttaagtataattttgttatttgtgctaatatattcttaaaaagaaaacataaaactttaacttacaggtacttagcccatgttgtaaagtttaccttagcaatcatatttgcactgaataaccccaaaacctacttaaaaagcattatgtcatgtctcaaactgaacattttctaagaagcatggatttgtgtttattccccagttgcatgcatgagtaatgtgaccttctgcttatgcttgctttttctatactatttcctttgacagtgtcttcttcggataaccttctattaaatctcaaacattagctagctctacgaaaggttaacaaggtaaaacagcaacagtttctaattctttaggagaaaaatgtaatcccttaaatgcccttctcactattcagtagatactcccattcagtcaagggagtataggtaggaaagggagaatgattcatccctagcttttccatcatcagagcaaccaaatggcagtcagatgatgtttttctatctgctctatgttttgacagcaaggagttagaatctctgtaaggaaatttaatgacagccatgccacagactcagggataatatataaaaagaaaagatagtctcatgaattagtttgctagggctgccataacaaaatgctgcagactgagtgacttaaatgaaatttactttctcacagttctagaggctacgagtccaatgtcaaagtgtcagcaggtttgatttcttctgaggcctctttcctgggcaagctgtgtcttcatgtggtcttttctcagtgcatttgcccccagtgtctctctgtgttcaaattatatcttcttataaggtcaccagtaatattggattagagcccacactaataacctaattttcacttaatcaactctttaaaggcctaacctccaaatacaatcacattaagaggtactggggataaggtttcaacatatgaatttttatgttgggggcacaattcagcccctaacatctaggaagaacaaattacaggatgcgactctccttcaaaccaccaatagagtaattatgttctatttttatttaaaaaaattaactactggaaacacaaagtattcaaatggaaaaatacatcaattttatgtttgaaaatggttaatgaaaagtcacattcttgatcactttatgtttcaaaaataaaaacaagtattcttaattaaaaataaaaaacttgaatttgtatttaaagcaaaaataatagtactacttatggtgctagtatatttcttttcttttctttttttttttttttttgaggcaaagtctcgtcctgtcaccaggctggagtgcagtggtgcgatctcggctcactgcaacttctgcttcccaggttcaagcgattctcctgcctcagcttcccgagtagctgggactacaggcgtgcaccaccacacccagataattttttgtatttttagtagagacagcgtttccccatgttggccaggatggtctcgatatcctgaccttgtgatctgcccgcctcggcctcccaaagagctgggattacaggcgtgagccaccgcgcctggccggtgctagaatatttcttagtgtctcttggattatctgacatgggccatttctaatgccacagtaattattagaaattgtgcacagtttattaaaaaacgggagcagaaatgtaatacaactaaagtgatgaaaaatgaattgcccaagttgaaataattttattactaaaattagggttatgttcactttactatcttgagaaaattttcttgaaagacagaagacctcatagctattaaaacactgtacaatttccacatttcaaataggagatcaaagagtaaaaatttctaacacctttaatcaaaagaacaatcaaaatagcagttttaaatatacaccaaataaaatttgaatgctaattgtaattgggctatagtagattttaaaagcaaagcacaaataataataataataatgtcattatttttagtattcctgagatactaaacatgatttattatcagggtttctaaaattcaaaaaataatgtataactcttttaaaatatatatacatgtgtaaaataaattatgtaaattaaatatgcatattttcccgagatgcttagtagagttgaactttaagaatgatgactgtaacagaaaataataaatctatcagtagttaaattatatagtgactgtatggaaatggataaaaaaagaaagaaaaaagctcaaacattttgagtttataatatgttttattaggttacttaatctaataaatataatcattatactagctagatttcccagtcagaagatacaaacaactgatgtaattacttccagcttcctggtaaacacatatgaagatgtgtttaactactagtaacactgaaaactaagactagctgaaaacctattccaagaacctagaaacactttatataatgaggttggcactcaaataagaaaaataaatggtatgtttttgttcttgggtaggtatggatgaacaaaaatttcaaatatccctaaactgatgtataaatgtagggtgatggcatttaaaataccgtttgttcccccacgccagtctgctccctggagctaaccgatcattgcaagttttaaatattatttttaaaaatgagctggaaaagaaagcagttagtcttactagaaaatagagcatctgtaattgacacaaggtaatacttacacatgaagtgacagaaagaccaaagcaaacttctaggaaatcctgaaataaacccaaatatatatggaaatgctatgaagctagcatttcaaattcatactcttttaaataagtgtgtttttttgataattagttccatattaaaacatcaataacattagataaattcttcacttcatacatgtgtaaattacagatggatcaaatatttaactataaaaatgaaaacatacaagtattagaagaaaacatgggtagatttttttgttgttgatatgtaattcatggtgtttctttttttaaatttaagttctgggatacatgtgctgaacgtgcaggtttgttacataggtatacatgtggcgtgatgtggtggtttgctgcacctatcaactgtcatctaggttttaagccccacatgcattagatatttgtcctaatgatctccctctccttttcccccaccccctgacaggccctggtgtgtgatgttctcctccctgtgtccatatgttctcattgttcaactcccacttatgagggagaagatgcagtgtttggctttctgttcctgtgttagtttgcttagaataatggtttccagcttcatccacgtccctgcaaaagacatgaactcattcttttttatggctgcatagtattccatggtcagtattctatccaacaaaggtctaatatccagaatctacaaggaacttaaataagtttacaagaaaaaagaaactccatcaaaaagtgggtgaaggatatgaacagacacttctcaaaagaagacatttatgcagccaacaatcatgtgaaaaaaaagttcatcatcactggtcattagaaaaatgcaaatcaataccacatgagataccatcttatgccagttagaatggcgatcattaaaaagtcaggaaacaacagatgctggcgaggatgtggagaaataggaacacttttacactgttggtgggagtgtaaattagttcaaccattgtggaagaatgtggtgattcctcaaggatctagaaccagaaataccatttgacctagcaatcccattacttggtatatacccaaatgattataaatcattctactctaaagacacatgcacacatatgtttattgcagcactatttacagtagcaaaaacttggaaccaacccaaatgcccatcaatgatagatttttaattagaaggaagaacagctttcctgtccatagtcaaagtattgtgaagggcaatgggaaaaccatagaaaataaaactaatttgtccccagagtgtgatattccccttcatgtgtccatgtgatctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataagtggggtggggggagtggggagggatagcattgggagatacacctaaggctagatgacaagttagtgggtgcagcgcaccagcatggcacatgtatacatatgtaactaacctgcacaatgtgcacatgtaccctaaaacttaaagtataataaaaaaaagaaaaaaaaagagagaaagaaaaaaaaaaaggaactaagagttgcagaatagcaaaactgaagttcagttcaaaaaaaaaaaaactaatttgtgagatgaaaaatgaacttgatacactctcaaagttcttttcaatgttaattttcagtgatttcttggaagttaacagcattacagagtggttcttatccatccaaaggtataataatagctaaagaaacctgtggtgaattcaataatgaacttcagttctacttgtaggcttggtaaaaaagttacaaccacaaatggggtactagattttcaataaaatgggcatgtttgtcatgacatcatctttctatactttcaatttaaacgttaaaagaaatcatggtataagtagtgagctactctttttttatctgtcttgacttcttacactatcttcactatctaaaagcctaggtttatttttagtggtcatatattttttttagtaataatgtaatcttgtaaggctaagttataattgctaaactttatctccttgaggatgcatgcatggtttatttgagttagcctttgctgtttttatctgaacatattttaaaatgaattaatctatagtttccctgaaattaaacataatgaaatctccataaactatactcttaataacatttgcacttatgacctgtgaaatatatagtcatctagcgtactctttcattaccttgaagggaggtttatagatttaaagtcacaatagaaaatctatgttattgtactaagaataattgagaaccacaataaaaatattagtcaaaagcaaaggagtaggttgggttcaaatatattttacaagttcttgcaaatatctctgtgtatacaaaatgtaatgaccttcataatgtataacttttttttaggaagtgtgtttatattaattaactttatctatttcgtacaacaatgattcatgaaaatatagaattcataaaaacaaagttgaagataattgagtttgtttagatcagcagtccccagtctctgtggcaccagggatcggtttcatgaaaggcaatttttccagagatgcggtacagggtcgggggagatttttggcatgagactgttctgcctcagatcatcaggcattagttagattctcataagcagcctgcaacctagatccctcacatgtgcagttcacaacaggtctcgcttatgagaatctaatgcagccactgatctaacaggaggcagagctcaggtggtaatgctcacccacctgctgctcacctcctgctgtgcaacccagttcctaacaggccacagactcttactggtccaccgcctgggggttggggacccctggtttagttatcttagtaaacaacataatctttcaaggggactttgggcaagttatttaactaaattgtgtcaatgttttcatttctaaaatgagaaacgtaaaagcatttaatttatgctggttttctgagaattaaataaattgttgtataaaaatacttagcacggagcctgaatatagtcaatactcaacaaatattaactgttaattatattaattattgattattattaacaatgttactagaccttagaatgttttaatttcctcaaggaataacatttaaaatttgaaaatttacaagaattttgagttggaaagttttgcaaaggggccatttttaatttccatttgtgatgttttaaatagtttaataaaataattttatttgagaaaaaatgactttgattatcatcagtcttacaacagaataaaaaatgagtgtagtcaataatcctctattatcttgtaaagcagtgttactttaaatgtagacattcataggcttggaaaccctcactgatacaaatgccctgaagcttaacattcttcaaacctctggaaatttgtccaagaggtaatttgttttttgtttgtttgtttgtttgtttctgtgtgtgtgtgtgtgtttttttttaaatacattctcatgaccacctgcctttggatcctataaggtgctacttaatcatgcagcttcctgggccttagctcagcctaaataaatcagaatctcttggaatgaggctctgcaggttccatgtctatcaggtctctcaggtgactcatgcatagtaaatgttgaaaaattctaatccattggaccacaagaaaatgttgtcagtgtttctgtcttatggttttcacaactaggagcagatgcccctttctttcacagataagctttggctttcctcatggatcagctaaataaattaacagcttttagtggcagcaatttgggggctctaagcagagacttgcacctgttatagtctagagaaacatatacgagaaaataaagaatcaaaaattgctgtactttatcctctgcaaaatgtgttaagatatgaaaagactcatgggttttgtggctcttttatcactctgggaaacctcagccatcactttcaacatttcctcagttctagtggcatcttcaggagaaacttcttacttcaggaaaatgtgtcttttaaaaagacttagacgtaagacctaggaccataaaaatcctagaagaaaacctgggcaataccattcaggacacaggcatgggcaaagacttcatgcctaaaacaccaaaagcaatggcaacaaaagccaaaattgacaaatgggatgtaattaaactaaagagcttctgtacagcaaaagaaactatcatcagagtgaacaggcaacctgcagaatgggagaaaatgtttgcaatctatccatctgacaaagggctaatatccagaatctacaaagaactcaaatttataagaaaaaaacaaaccacctcatcaaaaactgggcaaaggatatgaacagacacttctcaaaagaagacatttatgcagccaacagacatacaaaaaatgctcatcatcactggtcatcagagaaatgcaaatcaaaaccacaatgagataccatctcacaccagttagaatggcaatcattaaaaagtcaggaaacaacagatgctggagaggttgtggaaaaatggcaacacttttacactgttgggagtataaattagctcaacctttgtggacgacagtgtgaagattcctcaaggatctagaactagaaataccatttgacccagcaatcccattactgggtatatacgcaaaggattataaatccttctatgataaagacacatgcacacgtatgtttattgtggcactattcacaaagcaaagtcttggaaccaacccaaatgtccatcaatgatagactagattaacaaaatgtgacacatatacaccacggaatgctatgcagctataaaaaaggatgagttcatgtcctttgcagggacatggatgaagctggaagccatcattctcagcaaactatcacagggtcagaaaaccaaacactgcatgttctcactcataagtgggagttggacaatgagaacacatggacacagggcagggaacatcacacaccatggcctgttgtggggtggggggctaggggagggataacattaggagaaatacctaatgtaagtgatgggttgatgggtgcagcaaaccaccatggcacgtgtatacctatgtaacaaaactgcacgttctgcacatgtaacccagaacttaaagtataataataattaaaaaataaggttgatggcatctaaggtaaaatagtgaagcgaacttataattttgcataatgcgttttttgttcagaagcagtttttaaaaattgataatcagtaatcaaattaggtgtttaccttctcctgttaaaattatagtctgttaatatttaccatattaaaaattatttttgtgtgttttacaggaattgcactgcctcctaaaggaaatatagatatctcattgttatttatacctcaaattatgaaattacacaaaacaatggttattattgagatgacgaaagcaaatggaaaatattggcctattgacaattttgatgagttggatataaaatttaaaaggtaacatttaaataaagacattgaaggaaaataattttattttgacagccactgacatgctaggtttcttttacatgttatacatatataatgtcaagctcatgattttatattctctgaactgttgaaattcatatgttcagaggaggaaaatatatttgtcatgtggatatatataatgtatagaaaataatatatacatatatatatatctctaatggttgatttgaagctcagagtgatgaacaactttaatcttaagtatcattatcagtgaatcaaagtcagagacatgcaaagggactcctttctgacatggaaaatagtgactgctaacataataaataatcagtatacagaggacaacctaaaacagcttgtctgagtgaagtgaattcatgatactggaattcacactgtgccaggtggatatgacatccatcatatgaaactgccatggctagaggtattctgccactgccagaatgcaagttacttgtatctttcttgcttagctggaagttaagcaaaattcaataatcgtgcaaaatctaaatgtgttctctgttcttatagtttaattaaatgataatctggaaatcttagttaaaaataaatttttactttgtcctacatgtgcatatttctttccttcattttttgccagttctttactgtgggcccattactatccattctaccatgcattttcaccactcttatagtcaagattggctacataaattgtaagtctcagtgaaaaatgagaatgagcaaacttaatattttgctcaataactatgaagaatttcaaaacagttacaggaatgcattaaagaagcttgaaggccttctaaggatgggatcttattcttttgcataagccccatgctcaacctgtcttgcctgcaatgtcttgtctttcattttaatgaaaaaaatcccaacttcaaaaatgatcataaatttttttaattaattgattaatattttgagatggagtcacactctgttgcccagggtggagtgcagtggcatgatcttaacttactgcaacgttcgcctcccaggttcaagcaattctcctgcctagcctcctaagtagccaagattacaggtgtgtgccaccacgcctggctaatttttgtatttttagtagaggtgggttttcaccatgtttgccaggctggtcttgaactcctgacctcaagtgatccgcctgcctcagccttccaaagtgctaggattacaggcatgagccaccatatctggcctataaacattttctaatattgctgtgctcctaatgttgtatgatgcacctaaaatatttggacaaatgccccctttcttttaagtagtatcctccaaaagtaaatgcctcacaaaattctgaagtactgtacttcatggcagtttttgttttgtgctttgcccatccaatatagaatagatcccaagagggctatagtacctctcattaaagtagggaaaaaagctcttcaattttaacttatatttcatgatggtttcattacagtttgctttgtgatgattttccagggtttgctttgaaatgtttataaaatcagtatttgcagaaaatgttctttctttcatcagttgctctctaccaaagtctgaatttacaagctttactaaaataccataaagttaataaataataagctttttgttaatatggagtttctccttttgttccctcttaatattttaatttctaattagtattgtgggaatcgacagcgaagaaatccaagcaatacactggatataccctattgttggactcccacaagcaccacctcctaaatctcccccaggtaggtatacattagggtcagagaatgccagaattcttagagaccttagatattctctattcccatcttttttgtttgaagtccagagaaagtaggtagtaatgtgaacagtcctactggtgggcattctatgacataaacatgctctcccaatgtgtccaatgagttttccacaaaaccacactattttttgttgccttcctgttggtgaaatgcagatatcggctaaaattaaaatcaaattaacttcagactcctttattccacagagctctgcactagatttgtaagattctcaggtatacttgctctcaggtcacttttagtcatcctttttcggcttctgtgtaactctcgatctcatctaagaactatgctgtggagatgtggatccctttattattgtctcaagcataaaactttatggtgttcccccaaaccagtcagaatgtactgaagttttcaggaaggttaactttgccagaataaacacaatataaaatctctgcccttaaatgcctttcttgttctctttgacctttattattattatttatttatttttttttttgcctcggcataccctagacttctctaacgtttctgtgtgttctctttcctcaatactcttctcacttcttttgcattccttgattttcccattgccttcccaggatcagcctaagaaacaaaatttctcttatataaccagtgatatttagtatccagacctcttaccaggctctagatggcattctgcatcactaagatgcactgaattgctctgcaaagcaaaggaatatttattttgaatctccccctttagcaacacagatgagttaaaataagtcttgaaattttgctttttctttctccctctgataacaatctttgtaaataaaaaagagttagacttccactgatgtaattatatcaccacacttagaaagaagagacagtagtaagttttgcttgtaagtaaagcatttccccagatacactggttgtaaagaaagatcaagactacatgtttccttatgtagtttaatttgaactggagtaaaaatccacaaatgtagtaatacctttgaccacaaatgtcatttattttccttgaagcatttttattcttgactttaaaaaatcaacacatagataaatattttaaatattataaattatcttcagaatatttcacaaacttgtcataaaatttattttatttccttccagaagatagttgattgtatacttctgatatagctgaactgcttaaaatttataatacacagtcatctgatcaaagtgatataataagccctagacagtactctgttggaatgctaataatactgttgctcatgtctactgcagacagattcattttatccagattaaaggtctaaagccaaatttttagtcaaaaaccatgcttatgagaacacaaaaacatagatttcttgcacatgtttcttcaaagacagttaaacatcgtctagagcatttttgtttgagtcatttttcttggtaattacttgatttttaaattaaacgtgagttctgtaaatagcttgtgttagattagcacaacctatcgcaacattaatgttctgaaatagagtgtgtattagttattaaatcattttccccaaaatctaaaatctatgctggtgattatttttatctacacatgccctcgaaaggcaagtggatataattttataaatacatatcatttactttctgtgtagtccattttttgttcttagtaacatcggatataacctactgctttccctgctcacctatatcattagcaaagtttattaattcttttcttttttatgtatctgtcactcgagttattctcaaacccaggatacttttttgttctttaagccacattttctctttgtgcattcttatctactactgtctattgggccagataattggaaaaacactctactatctgtcacactgtaaagacaatgaaatgataattcattgtgattgagtgatccatacattgccagagcactaatttcctaaggacctctaggacacaaccagtgacatgatactaattgtaactttgataacattaatttctgatttaatgccttgataccgaagatagttataaccagaaaagcttgtacagtttttcctagccattttaaaccgtttaatttatatatatcattgtattcttattgtacatttcacatactcattctaaatccagaatgttcaatataaatttttaaattttagaataaaatttacatttgttatagtattttaaactacaaatatatgtattgtgaaaacacatacatctgaggacatcatctaattttgtagtttgtgtgaatatattattattgatgccacagaatcatagcataatacatttcacaagcttttttatattatgattctcctttttcccctatattcaatgtgtatttgacttgatagtagtagagcattttatatgtttgggagaaataatattcttatttatgtggactccagtacacatggttacagagctaatgtcaaaataatacattgatattcctccttgatataattggtagttgtacataaacagactattttgatttctcacaacattgctgacaaagtttttcaccactggagatgataaaatattggaatttaatacatatgaaatatatttatatatatatatttaattctgtacattaaattaatatgtaatcacatttaacttgaattttaaatcattacaattttacttttatgtgtttaaaaggtaatttttataaacttaaaagtaaatcaaaaataattttaaatattttatttaatttgaatatgaatttcatggtacatgtaaaaacgtaatgaatctaataggaaatatttttaaaatattgcaaaataagtgttacagaacttatttttttaaattatttgaaggcattttctatagtattgttataaaagtaaagtttagtattatcacaatgaacatatatttcaaaaggggaaaaattcatgcatttacaattgccccttgagttatggatctaactacatcagttcccgaatcaaatttctatatcctaatataatgttttataatctagtatatatcttacagatttattttcctgtgctatttttacatagtctttaatattcatattttcttcccaaatgttaactgatgtagatattgcatgaatgtgtgtgtgtatgtgtgtatgtggccagatacaatgacaagtcaaagtatatcaaaggaagttttatttttatgacatagttcattttcttctatctcaagaatgatcatatcacctacaagtcaagttaactggaaatatttctctcctgcagttgtcatacaatgtcagtccaggaagcgggcagaagagaaggtagaaatcatactgaatgctggttttttcggatttagtcttactccagatctgacagaagttttagtgattccaaaaagaaattcacataatttttgtgaggatcccaatggtaagagaactacggttatagaaaaaataaaatgaaaaaagaaacttagtttccatgaattgcaggttgctgattgtgcagttacattaagatccatgtccatttacttttcatttcactacttattcacatagtgcttaaggagtgttccgttgttatgtgtgttattttcacgtagctcaaacataacaagttacagttatcactagatttataagatgtagattgtgattccatcaatagtgagaagagagaaaactgtagtaactataatttccacttccctcaactttgtttttttcttttactctttctttctgatttaaggattatgataatgccataaaatgcagctttaaatttagaaacaaaaccttgagtaaattattttctaatgtaaagaaatagaaaatgaacataaattagatataatatccaaataaagtttgtataataataataatgcttcacgtatttaatgtatattccagatttgtatataagaatttactatctcgggccaggtgcggtggctcacgcctgtaatcccagcactttgggaggtcaaggcgggaggatcacgaggtcaggagtttgagaccagccttaccaacatagagaaaccccgtctctactaacaatataaaaaattagccaggtgtggtggcacacacctgtaatctcagcttcttgggaggctgaggcaggagaatcacttgaacctgggaggcggaggttgcagtgagccgagatcgtgccactgcactccagcctgggcaacagtgagagactctgtctcaaaaaaaaaaaaaaaaaaaagatttactatctcaattaaaaaacatcaaaataatttaaaataggttatctaattcttcaaatatgtggtgttttacttgaggtaaatatgtgaaactgagtgatgtaagcaacaagggaaagtagagagttctggaccctccaaacacccacaaacacaccaattcagcaataattcccttcgtaagacaacagaaactaattgaaagtttcttgcacttcaggaggaaccagacttaccaaagcctttagggagatttaggacaccctcttgccaaagaccctgtgcttggcaaagggtcttctcatgacacattggtcttggcaatgatttcatggatataacaccaaaagcacagacaaaaataaaataaaataagtaggactacattaaactgaaaagcttcctcacaacaaaggaaacaatcaacagggtgaaaagataacacgtggaatggtagaaaacatttgcaacccatatatctgataagtggttaatcttaaggagctcctacaactcaattaaaaaaaaactaataatctgattttttaaataagcaaaatacttgaatagacatttctctagaaaagacatatgaatggtgaaaactatatgaaaaaaagttcaatatcactaattagggaaatacaaatcaaaaccacaatgagatatcacctcacacctatcaccatggctaacgtcaaaaaaaaacgtgttgataaagatgtggagaaatttgaacccttgaacattgttggtaggaatgcaaaatggttcatctgctatggaaaacagtctaacagtatgaaagctcctcaaaaaattaaaaagagaattatcatctattatctagcaatccctcttctgggcatttattcaaaaaaattgaaatcgggagttccaagagaggtctgtattccaatgttcattgtaacattattaacaatagccaagatatagaaacaacctaaatttatgtcctcagatgaatggataaagaaaatgtagcatatactatcttgaaataatattcagccttaaaaaggaggaaattctataatgtgcaatatcatggatggacctaagtgaaataagccagtcacagaaagacaaaactacatgataccacttaatatgataaatttgaaatactcaatctcatagaagcagaataatatggaataatagttgctaggatctggaagggagaagaaatggggagttgaacattgggtataaagtttccattgtactaaatgcataagttctagggatctgttgtaaaacatagtgcttagagttaacaatattgtgtggtgcacttaaaatgcactttaaaaatattaagagggcagaactcatgttacagtaactgtaaaggaaggtaaataaatgcttatacatataaaccattttaacatgttcttgctactttaaattgcttaagttgtactcttgtcaggttgtaaactaaagaaattgcaattctgatcatatacattgattatacttataacctaaaaaatccacttaactcctagataatcagggtcttgaaagaagctaccaacatcattttgggaactttgaaagtcatatttaggagagcaatctctctcaaaatagctcttgaaaatataccttttgatatggctcttattttactgcttccttatttttcatgatgaaaaacagtatttactattgaaaataactgtcgggaaggtttgcagtctcatctccacccgtcattctctctaaaacagcttttgttttctctgctctctgctcaataccaccacactcaacaagctcattcatattttggctaacttgtgaatcttttttgttctcctgatgtatgtcctgctatatagaagaatagaccagtctcttctcaaatttaacatagttctttctatatagtgcctaaatatttaaaaaaaggaatcgacctcattgtctccttaaagacatatggcaataacttggttcctttcccctgcccttattccaaaggtgtagccaactctctacaaaatctgtaattctctctgcttgaccctcctttgacacctttttctttatgaaaggacaaatcttaccagaaagtctgaatactactttagtctttagtatatgcaaaagcagactagctcctttctcactcctgtgcaatttaattacagtttactcagcacattaagaataggagtcatgttgaccatgcagtcttgtacttcctgttgtctcctaagtcccttctagtggaaattaaagcactacactgagtggcatggactctgataggattttaagagtgataattaatcacatacttgtcttctctcatctgagtttgaaactaactgagaggcagatataaaaataaagcagatggaaatcaaagtgttagctttattaattatacaaatgaattggaaaatgacttggaactgtggagaaatttgggcttttaaataccttccaccaaaattgagtgcattcatgccaaactggccagttgtgaactccttgcaggaacaaacaacttacacatgagcgagtagaagaaagtgtgaatcctggaatcaagacattggggaagaaagagaagggtatgctcacctgctcatgttccattccttcactcaaattcactgatcagatatgttgcttttccacccgtggcaagtcatcatgaaggaggcagattgaggctgagatatttttctcctatactttttcccttcttgagagtgaataggcctctttatgtaaacctgataagtaggagataagaattcccagcattcccttcccattatattcatcatagaatttctgagtcacataaaactatcaagcttcattaaatgaaaatacaaggaccactgtgctctcttcatccttactcatcacacatacctttaagtaaactgggattgattaccttcatgtctttatcattcagcaacaatccagcaagcatcttttctgccagatactacattcagctccagaggtgccaaaattagcaaaacacatactctgttgttaaggttttcaaaaatatttattcaacatgataaatctatgcacctgtactatttacatcaattggtattgtcctattgaaatattattattcttggatttttagactgttttgcagtgtcacttctgtaagattacaaattactctgtgggcaagatttctcctataagtgtatttcttcttcctaagtacctcctggtccatgcattctttgtaattctctatggattagttcagtgactttctcggggctttctatctgaaagtagttttagtcatgccccttaattttatttcccaattgttctatagctcaatactgtttttctttgattaatctgttgtcttttttctgtgtgatgttctgatttatgtgacatatgtgtctcatttcatcccaggccagtcatcttcctgtgtcgtatttgcctgttttttgtaaactcccatgtcaggtttggcctgtaatcacaaacagctcctgagaaacctgtcattgttcctcctgtgacctcatattgacctcctgtccttgattctttgctctgtttctcttcactttgtttttttctgatcaacttacttcattcagcctttgtcctgcttactctaataggattaaccttgaaaagactgccaaccttatccagtgtgcctaatacagcagtcatatctgtgttccacatgtcattagcatttaccagttgatcaagttgaagtactttctgcccttggctttcatgactaaccttattaatttattatcacactggttgacccttcttgatttctgttattttcttttctgacctaactttttgagtgccctagggctctgctctgagagccaccacattcctatgcacaaattatgtcctgcacccttccagacaatgatgctaatggtgctaatggtgcttctgcagcaattgtgccatatgacaaacctgctatactgagttgtaaagtcttaagtcagactgcttgggttcttttatttagtattaatcttgaatagagtctgaaattggatgctaatcactagtagtctagttgtctcctgttattcttagaagtcccacatcttcaccacaccctgcattgtctcgctcttttctactttgcctgcttcacggtttgataaactcctctcaccctctctgctctgccctcataagttctttctcaagtgggcccagctggttttcaccatgaacaattcctgcagtctgagtaattcctgcaggctgctttgatgagtagaaggagttttctccctctctacatccagctaacctttactcatccttcagtttggtgtgttggtctcttcctctggaatccttagcagtgatgttcccaggacctgtgctctcatgggatcctctacttctccatggtagtagttatcacagtagtaatttaaaaactagttgtggcattagtagttattgtcagtttcttcctcttgatcatcaactccatgaggacaagaattagacgtctcatgtcaaggaaaacctttaattaatatttgctgaatgaataaagaaatgaaaatataaataacgataagaaaaacattatgtttttaatgtatgtttaggtgttggctgtggaaacaaaattatttgccccttattcatgaatttagccatagctataaagtttccccgaggtaaaaatttataggtcttcatcagcagttcatgaaaatgtatacagaaggggaggcaactgacaatagaggtgctttgagaaggcaagcatgataactattttatatcataatatagaaaagtctattttcagctgataagaacttcaatcacatacaaaaatacttttactccccctaaatacactttatattatggatattaaaagccattttttattgtatattcattaactaattttttgtggctatagtttttctaaatactttcttttaacatttctactagggttaaaagttatttgtgcaccactattacagtattacattattctgcatttgtatatatatttactttgccagtgagatttatacttttatatatttttatgttgcttttgaacaccctttcatttcagcttgaaaaactccctattagtacattttataagtcaggtctagtagtgacaaactcgttcagcttttgttcatctgagggtttttatctctttatttttatttgtattttttgagacggaatctcgctctgtcacccaggctggagtgtgatggcacaatctcggctcactgcaaactctgcctcccgggttcacaccattcttgtgcctcagcctccggagtagctgggactacaggtgcccgccaccatgcccagctaatttttttttgtattttgagtagagacggggtttcactgtgttagccaggatggtctcgatctcctgaccttgtgatccacccacctcagcctcccaatatctctttattttaaaggacagatttgtcaagtgtagtattcttggttggccttttgttttcttttagcactttgaatgtgtcatctcactgtttcctgtccttcaatgtttctgttgagaaatccactgatagtgtaataatagttcccttgtatgtgatgagacagttttctcctgctgttttcaaagttctatttttgtcttcaactgtttttgactgctccatagacagagaagggacatcccataagcagagtggcccagagtagcttgcctttgactttcaacaatttaattataatgcatcttggtgtaggcctggtgcctgggtttgtaggcagatctggggccatgactggggacacatctggcgcctgtgtctacaaggacaggcctggaaccagggtccatgaggccaggcctagtgcaaggatatatgacagagttggcttctccctttgctattcccttcccctgtttaagaactcctgggctaaggggatgtcgcatcactgggctgagagggttggattctggattagcacagctgtagatccagtcaattcatggttctctgacctctcttccaagttccatatgcaacaaacttcttgatttgtgagttgggctccttacatataactggagagtaagtttaatacatgtttgtacctctcatctacatgctagctctggatttaagatatttttcatgtgcaggggacaaaaaactactacttttctttggtaacctactcattaagaaaatatttgttcatcatattgtctgtatactccaacactaaaacatgaggagcagtttttgttaatcaaaatataccagaaattgaaaatcctgatctaatagtttgaaatgctgtttcaatattgtttaaacttaattcaaagcaagttttaaatgacttcttcataagttttaagtctataggtttttaatacatttattatatagagcaaatgtcattattttcattaggcagttaatgattattaatttccatgtggcctttcttgttttatagacctgaattataaagatttaagagtggtgagaattgtcttctatgtttatttttatatgcattcatttatttattaacttgttaacaaaaatatactgagtatcattatatgcctgataatgcactagactttatagacattaagctaaataatatataccccctccctttctctaaatacctgtgcattgttagtcttgacaggtaattgatattaaatctatgcatatttaattaaattgaaatatattttcatcttgactttcctagaaattcctaaaatacatgaattcgagtatgaaattcaatttgaatctgaagctatgaagtctaagttggaatcctgtgtagctttatatatgattgaaaaatcttatgatattatggctaaaaggataacatttatcttcaatctggtattcacaccaaagaaaccattaaggtaaatctactttcctcttttttatttaaacaatagtattacccttttaaatgtattaatgttgatttctctttttatttctcaatatttgaattgcaatacttatttaatattattgagaaatattttgggctagattacatctagctacaaaaaatattctcatgagaagaatgtagtctaaatggttgaaaatctaagatatccctcaagaattatgacttccctaaggtcattagtgtatcacattaatgaaagagaatattctcttctgtaaaatctttttttaaaaaagctgatttagcgttgtgcaatagcaacatgatatttcttgatgttgcttatcagaaccagttcaaatgatgcaaatgcctaagctatattttacattgcaactgctttcattacattttactactcaatacataacattacacattccttagtaagatataagtgaatctgtgcgaagggtggcctttagatgtctgtcctctaggaaacttcattcagtgtcattatatttgctttctggacacctgttactcagcatctgcaaacactatatgatatttcactatgaaatagtgctttattgtgtctaaatgcagagacactgataagcaccatgatatacacaaagtacagcctggcaatgaaaaaacaattgaaaatattatttgtgtttttaatgatttcttttttcttctctcaacttttgttttagatacaggaagtatatttgtaggttttttacatgggtatgttgcactcaggcagtgggcatagtacctagtaggtagctttttaacctatcccctttccaactagtagtttgcagcgtctgtttttcccatgtttatgtccacaggtgctcaatgtttagctcttacttgtaagtgagaacatgcagtatttggtttcccattcctgcattaatttgcttagggttatggcttccagccccatccatggaaggaggacatggatgcatgcaaaggacatggtttcattctttttcatggctgcatattattccatagtgtgtacatgtcatattttctttattcaatccaccattgatggccacctaggttgattccatgtctttgctattgtgaataatgtgacaatgaacataacgagtccacgtggctttttgatataatgatctatttttctttgggtatatacccaataatgggattgctgagtcaatttctaaagttcaaccttgtattcgatgtagtcatacatctaaagtggctatgaatatgtagtttgataacgaaaagacaccagggtcatcttcaggaagcagcaataaaatcaagctacaagaagaaagtataccatacatattgacattttctatgtttgtattttctttcatttttcacagttttctatgtttgttaatttttttcacattttgcttcatatgtattaatataatgacatggaaattacagcaacactagaaagggaacaatgttattatttgtgaaaatgggcagagccaatgtgaatttatactcatgaaaattttttggatttagaacatcttggtgaatatttgagagactaatttagggcaaaattttttgatgattgataaatttctgtgagtgttgtgtgatgttctgatatagcaattctattttgtgtatatatgcatatattcatttactatgatttcttcttttgtatatacagtcatgcatcacttaacaacaaagatatgttctgagaaatgcatccttaggtgattccatcattgtagagtgcatttacacaaacctagatggtatagcctactgctcacctaggctatatggtatagcctattgcttctgggctacaaacctgcacaggatgttactatactgaataatgaaggcaactgtaacacattggtaaacatttgtgtacctaaacacagaaaaggtacagtaaacatacagtattataatcatatggaacaaccgttgtatgtacagttcatcattgaccaaaatgtcaatgcaagagaaacaattaaacaagaaaaatcaaaattacaccaatagcattgagctatgaaaaacaacaggaaaataattataccatgctttacctagattaatgaattagtactaaattcaattctgttcttttttgtaggcaaggttaaaaagaacatttatgtgttttgataaaaagaaaatatatcatgtttcacaacagtgaatactaggtcattctgacattcatcttttcacagaatacagtgttgtgcatgctaaaaataataataaatatgctaaatggtggtattacaaaagaaatgcaggaaaattatttctattggtctttttccaataaaaatcaagggtccaatacaaaagcgtatgagaacaatggttaagagtgtaatgaatcagtctgaagatcctaatttaacaggtcgtaacttttttaaaataatgaaataacagatatcatttgtcttatggtatcttcagaaatgctaattaccttagcttgacattttcctagaactttttacctgctcaagagctgaacagaatgagaaacaaagttctatttcagagtttgtgggtggcaacttaaaataagaaatatcacacatatgcattgttatgaatctacagtattgatcataaaatggctcaccatgtcatccatgaaattctgtggtcttctcctgaagggtcccacattttgactcagcaacttctcattaactcaaagaagtcgctcacagaatagaattattcagcattgttcatttgaacctgtacattaatttatcaaaaatcatttaacatctacaaaagagacaaaatccctgcactttaggagtgtatcatctagtgaaagtgatagataacagaaataaatgaataagcaagaaagtaaatttcagattgtcctaataaataaataaataaataaataaataaataaataaataaagggagatagagaactttaaaggatgcacatcagataaagtggatagttaggcttccatgaaatgatgtctaagccaagaccttacagacataaaaaagttggaaagagcatttgagccagagaaaataataaatgcagaagtcgtaagacaggaagtgtttagcacaaacaatgaatagtaagaaagccaatctttctctaatggagcgagtaaaggaggaaataagtttggagaattttactgggatttgttcacataggatcatgacaatatgcattggccttttatattagaaacaatagaaaactattgaagaataaatatttggagaactagtttaggaaaacgtgtgtacatgattcatcaaattttgtaagtgttaagtgatacctggtgtaacttaacagttatattttgtgcatatatatatatatatatatatatatatatatatatatatatacacacacacacatattcatttacttctgccattccttgttccaaattaatttggaatggtttactggaagacacagagttaaataagaaaaaccaaaagaaaacagtggctctaaattgtggaaatcttcttgtaagatggtaacagcagaagtggagaaaccggttcttgaaacaatggtcttgaaatagtgggaatagaggaatatagtttcatttacaaagacaggagaatgtgaaagaggtataggtttaaaatgtatatttgaatgtgttaagtttaagattatgtattaatcatcattgactaaattatgctgcatagtattccattgtttctatgcaacatacttcattttagcagcaccctattgaaagaacattttaaaattttactcccttttttttgacagtataaacaatgcagtaatgaatacccttatatacatcacttcttgaaatcttagaggcatttctccagaggaaagtaccaatagtggaactcctaatttactgagtgaagctttcttttctgttttaaaaccttttattttaggttcaggggtacatgggcaggtttgttatataggtaaactcgtgtcatgggggtttgttgtacagattatttcttcacccatgtatgaagactagtacccaatagttattttttcttctcctctttctccttccaacctccatcctcaggtaggccccagtgtctattggtcccgtctctgtgtccgtgtgttctcatcattcatttcccgcttataagtgagaacatgtggtatttggttttctggttttctgttcctatgttgtttgctaaggataatggcctccagctgcatccatgtgtctgaaaaagacatgatttctttttttaaatgaatgcatagtatttcacagtgtatatgcaccacattttctttatccagtcttcctttgataggcatttaagctgattccatgtctttgctactgtgaatagtgctgcaatgaacacatgagtacatgtgtctttatgatagaatgatttatattccttttggtttataccaagtaatgggattgctgggtccagtggtagctctgtttttagctctttgagaaattgccacactgctttacacaaatttgttaagatactatccagttgctcacaaaatggttgagtaattttatagtcccacctaagaagagtaagagttcccagaaatgttctttctgtcacttttaagtaagcggtatgagattccttttctaatcctgacttatgatattgaaaccacactgttacatgtttgaatcatttctaccctaaacaagcaaacagataaccattcatcaactctggctactgccctatctctccactctttgtcatagtcaaatgctttgaaagtcttaagtctatctctactaactttcttccttaattcagctgccactcaattttatcttattctgcaaggtgtatgtggtctttaccaattgcaatttcattttttaaaaactgccatttaagtcaattgtatgggctttgcatgttttcacagaaaatgtattttttctttgtgaaacgagttgaaaatactttcgcataatgtttcatttttgaaaaaaatccccgaatggaatacctattagtataaaacatgggtctattttgccaaatccacccttaccttcttatgcactatgataatctatgctggttacagaaaatttgcagagttcattctgcatatgttgttggttcttagaaaataactagagggtagataagacaccctaaaaataattacttcaaagggagaatgaaaatataatctatgactcaaaaattatttatgaaatgtaattaaaagtcatttacattatttttaagaattaaatgtcctagtgttttcactgaaaccacagagtttacttacatttttaccttagtttagtttgctatatttattctctttacttgttttcacgtagtgtcatttaaaatctccttttatattcaaggtctcacataacactgaaaatagagtgcgtaacagaagggatctggaagtttcccataatgttgatcgctactgaacctgatacggatgctgtcattgacattgaaggagttggtttatttaaggaatctgtttttgaacttaggctgaaaagtcagacaaggtaatatattaaacaaaagtatgtagctgttttagtgaatatgctgaactttggaatgaaatttaagatggaaaattctatagttcatcttttgctggttaagccagcgcaacattggttctctgactcaaagcttcatatactacataaatttttacttaacaattggaaaatagggtatacaaagtgaagaccagaatgaaaaacaaaagtaaataattaaaaattgaaatataggatactattaatatttccatttgttttcaaaggatgtttcagtgtttttctgcaaatgtcaattgtgttggtacgtcagatggtttaactaagcagaaataattgggtaaacccacgttgattccatgttatgtttaattttgtttctatcatagctgtctgttacatttgtgctaacataggcagtctgacaatacttttacctaaaatctcacatgtaaaatatacttttacagctttttgaggtacagcatacataacgtaaaattcatttattgtaaatgtacattttaatagtttttaattataggatttgtagtcataaccacattccagatatagaacttttccatttccctccatatttccctcaaacccttttgcagtcaactcccatactcattaccagtctcagtcaaccactgatttgctttgtctctatagttttgccctttctgatatttcaaataaatgaaattacataatacgtagtcttttgcatgtgactttttacactatacttatctgaagttcagtagttttcatgaataagcacctgttagctttgcatatatttgatccatttctcgagggctgaaatggttgtttgtaacagttgtccagctttatggtcaaaatgagtggtgaacagttaaatgtataatcacttgtgccaggtgatgcaaggctttatagataggataaccacaaaattcactgtccaaacttgaaccttttgagaatgaaagaggataattaataattaggcttggcaacaaggtaaactgggacagatctgagcaaaccagcacctaacagttactgttcttataggctgtggcaagatgtttgctgtttatccaaaaaagactaaaaagtcactaaatgagcagagtgatatatttgaaaaagaatatttagctgaaatgtgtagaaaacaaatgcaaaaatggtaagagtgaatggaggtagattagttagttggctaatgctgttgtctgaaggttgcttgaggtttttgcagggcgagtggagagggaaagtagacagattggagaggctttaaggaggtaaagtcagttaaatttagtggtagttttggggatcagaatgttccactttgctagagagttttaaatgttaagtcagagaagtacctgtaatgtagaagaaactaacatcaggtggatattggactatatgacctggaatttctcttacagtttgaaaatatgatactcttgtgaaaaaaattggtttcatagtcaaacagaatgagaaacaattttttgctcaaccactaaatacctgtgggacttttagctatatatttttgttcctccaagcttccatttcctcatttataaagtggagataaaatataacccataatgttgccatgagaacaaataatgcaatgtatataaattactcaccacaatgccaagaacttttaaatattcaataaatggtattgttattatgtattttttcatatctttgatcaacctgatcagttatccaaaacctaatattgggagagtaactgtttttgatattaagtctcctatgttttaaaacccagagattgagagccaggcaactctagtcagccatcttgctgatgtggtactacaatcagattagtccaggtttatttttaattagtattactaagattctgttagatgtttggtttaaaattagaagtagtctgtttcttctattctgatatatttctgcaagcattaagttcaagggcagtttctacagaaatatacagtagacttagttcattagattgcaataaacatttttctagtggataaatgcagttgtcagaaattctatgatatacaattatgtatgaaaaacacattcaaaatataaaaaaaaacaaactctgactcttctgtattgaacccttatggccctgttatattgaatgaactacttagaattagggataaatctgaaaatctcaatagggtattttctaaagtatagattttgattttcttctatttttgttctaagggcataattatatataccctttataatattgatgctggagagtgattttttttaaagattcaatagcaaatggaattatcccccataagtgcttctaatgtgcagatttgagatatattttaataacatagggtcactcctgtggttaaaatcacatgttggccatgtctacagtcatctgaaggttttacacagctggatgatcaaaataacttacttttataactggagatgtttactctggatgttgactgatactgcctccacatagtcactctttaatggatgccctggatagctgaatttgtacattgtgattggttttccatagagagcatattccgagagaagcacgtagaagatgcatggcattttctgacctacacacacaagttcaacaacaatcactctagtcacattttattggttacaaaggggtcactatattggcctggatttaagaaagggaacatagatcccacctttctatgggaaaattgttaaagaatgtgcaggcttgccacagtggagtatgctaacttgaatgtttttagcttcttctaagtcaaaaaattttgtccagattcctcctgggtattgtcaccagctgcaagtctttgggtggcaaggatcagatcatgatgggtaacataaccaagttacagaagaaggtgaatttactttctcttcatggtttattttcttttttaaaattatactttaagttctagggtacatgtgcacaacgtgcaggtttgttacatagatatacatgtgccatgttggtttgctgcacccatcaactcatcatttacattaggtatttctcctaacactatccctcccccagccccccaccccccagcaggccccagtgtgtgatgttcccctccctgtgtccatgtgttctcattgttcacctcccacttatgagtgagaacatgagatgtttggttttctgtccttgtattttgctaagaatgatggtttctagcttcatccatgtccctgcaaaggacatgaactcatccttttttatggctgtgcagtattccatggtttatatgtgccacattttctttatccagtctattattgatggacacttgggttggttccaagtcttcgcatgggtttattttctacagcaaatggaaactacctgcttccttacattaagtgtgttttaaactttttttagaggattcagtgatgtaaataagctactgaatatttctagcttatttaccagcccttgggaggctacacctaggaaggtattagaaatttcaagttatcttgaagatctagggaactggaggggcgtatatgaaaaaaaataggataggaaaacaggcagacctaattatattcaggatttgactggttcctcatgaacccagtaatatttcctttttctttaaggaatcaagagtaaaataagttctgaaaaggaacgaccccctgtcctagtgactatacatttttcttgtgtgctgggcatacaaggagaggaaagaaggacgaagatgcatgacaaaccccatggtggtagctactctgtttcctaaattaaatatgtaaagcgttagtgtatccaggggtaattttaaacataataatacaaagtattctgaagaatcagtataaaaacataacagagttcaaggtatcaaaataggttacctattcctaaaatattttatgtgcatataagtgattagcaataagtaaaacttttgagaaatataaaatccttatttttctgaatatcctactttttactaacgtctgccctttgtgataacatttaaaaattgtttttatataaatgagcattatgaattacacaaaaaactataatgtaaatcttaggaaatgagaaatccaccatctcttggccactatcactaagtccaactcaattctggtagagtataggaattagaaacaaatggtttcctagtaatataagctaatcatattttgaaatagtcatttgggatcatgctacatagaaattatcttgttataaaatgaaaatcttctgtagatgagcattttcattaagaaaactaattgtagggctgggtgtgtgtatatatatgtgtatatatatgtgtgtatatatatgtgtatacatatgtgtatatatatgtgtatatatatgtgtgtatatatatgtgtatacatgtgtgtatatatgtgtatatatgtgtaatatatgtgtatatacacacatatgtgtatatatgtgtgtatatacacacatgtgtatatatgtgtgtatatacacacatgtgtatatatgtgtgtatatacacacatgtgtgtatatatgtgtgtatatacacacatgtgtgtatatacacacatgtgtatatatgtgtgtatatacacacatgtatatatgtgtgcatatacacacatgtgtgtatatgtgtgtatatatgtgtgcatatacacacatgtgtatatatgtgtgcatatacacacatgtgtatatatgtgtgtatatatgtgtatatacacacatgtgtatatgtgtgtgtatatatacacacatgtgtatatgtgtgtgtatatatgtatgtgtatatatgtgtgtatctatgtgtatatgtatatatgtgtgtgtgtatatatatatataaacacacagctaaatacatataatttaagaagtctttagtgaatcatgctgcccacattgtttaaaccctctctaattcattaacacttttataccacagctgagtctccatttatttctaacaataacaataaagctactttctttaaaaaaaatgatggcatataaagaaaacttgatatgaatttatactcattaaaaattttgtggatttagaacatcttggtgaatatttgggaaactaacttagggcaacattttttgatgattgataaatttctgcgagtgttgtgtgatattctgacgtagtatagtaattctattttgtgcatatatgcatatattcatttactatgattccttcttttgtatgtacagtcatgcatcacttaaagacaaagatatgttctgagaaatgcatccttgggtgattccatcattttgcacacatcatagagtgcatttacacaaacctagatggtatagcatactgcacacctaggctgtgtggcattgcctattgcttctaggctacaaaccagcacaggatgttactatactgaataatgaaggcacctgcaacacaatggtaaatatttgtatacctaaacacagaaaaggcacagtaaacctacagtattaaaatcatatggaacaaccattgtatgtacagttcatcattgaccaaaatatagatgataaaggtcaaattttatttatttcagtatagatattgaggtttcccaacatcatttattgaagacactaaccttttaaaattgtgtgttcttgatgcccttgtcaaaaattacttgacagcatatgcttaggtttatttcttggctttctattctgttctattgacctatgtgtctgcttttatgacagtaatatgctattttaattattgtaggtttgtaatgtattttgatatcaggtagtgggatgctaccagcttttctctttttgctcagaattgctctggctagttggagtgtttacagattactatttatttaaaatataacactagaatttttatagatagcattaaattggtatatcacattgggtagtatggacattttaacaatgttaattattcaatctcatgaaaacaaggtattttcccatttgtgtttttgtcaatattttaaatcaaattttacagttttcagtgtataaatattttatttccttggctaaattcatttctaagaattttattctttttaatgctatataaattggattactttcttgatttcttcttgggagagtttgttgttagaatatataaatgctactgtgttttgtatgttgatttttcatccatcaatgtcagtgttactgagattatgtattagttctaacaggtttttgcatgtgtgcgtgtgtgtttgtgtgtgtgtgtgtgtgtaatctttacagttttctacatataggaacacaccctctgcagatagggatagatgatagtatttcttcctttctgatttgggtgccttttatttcttttacttgcttgattgctcttgctgatatttctagtatgttacatagacatgcaaagagggggcattttctccttgtaccagaccttagaggaaaagctttcagtttttctccattgattatgatgttagcagtaggcttttcataaatgacctttatcatggagaggaaatttccttctaaacttaatttgttgagagtttatcatgaaatgatgttaaactttaccaaatgcttattcagcatccgttgggatgatcatgtagcttttttcttttaatttggcatatcacgttgattgatttgcatatgctaaacaaaacatgcatctcaaggataagtcccacttgattatggtgaagagccttttaatatattggcagaaatggtttactaatactgtattgatgatttttgctttcatgttcatcagatatattggtctgtagtttttttttctcttgttgtctttgtatggctttggtatcagggtgatcctggcctcataaaatgagattttatcttttggaagagtttaataaggactggtattaaatcttctttgaatatttagtagaatttagccatgaagctatctggtactgaacttttctatgttgggaagcttttaattaatgctacgatcttttttaaaattggccccttcaagcattctattccttattagttcaatcttggtaggttatatatttctagaaatatatacatttccttcttggttttccaatttgcttacagataattgttcataatagtcattatgttcctttatatttctgagaaatcaattgaaatgtctccccctttatttcttatttgatttattggagtattctctcttgttatcttaatctcactcatggtttgtcaatttaaaatttatttttaaaatactctttgttttgtcaaatttctatgacttttctattctctattttatttatttctgctcttattttttattattttctcccttctgctaactttgggtttagtttgtccttcttctagttcatataatttaagtggcttattttgagatctgccttttttaatgtagatatttatcattataagatttcctcttaatactacttttgctgcatcccattaagttttgttttgttgtgttttcatttccatttgtctcaatatatttttttttccatgaggcattttatttgtaaatatgtattacatctctagaaaaagaatcccaggattttcactcctgtgtgttttcgtcttgcttcttcatggtccatgatgccagctgaggttgtcagtataatgaaaccaaactggcacaatggaatcagattattctgccgtttttctagacctttgagttgcacatcaaatctgggctgatcactccacacttgtttagcctgcctgtgaggttcacaacaatttttccagctctgtgatcatcagtgatttcaaatttgccagtgtaaccacacttcatcatcacactgagaagctggatgatgactttggagcatgacctaataagaacctggcgtttgcctctcttttctgcatgttgatacttttgagagcatcagccaggacattcatgagcaccattgtggcaatgcggaaagatggcggaaagagaatgggaggggagagcgcacgcagttatgggaacaagatattttctaatacgccttttgatttcctatttgacctattggttgttcaggtgcgtgttaatttccacgtatttgtgaattttcctaaatttctcctgttatagattctcagtttcataccgctgtggtcagtaagaatacttgatataatttcaatgttctaaaatttgctgacttgttttgttgcttaacatatgatccaccctgaaaaatattatgtggcccttgagaagagtatattctactgctgttggatagaatgttctgcatatagctgttatgtacatttatctaaagtgtagttcaaatccaatgtttgtttactgatatctaatctggatgatctatccattgttgaaagtgcagtattttgtttctttggtggtgtaatatttccctgattcttcgtgatctttctagccttgctaagaagtttgctcatttaaagcagttatcttcgccagactttatgaattggcttcagtaaataaaaactttcacctttagggtaacagggcacattggggtgtgttgtggcactgggtctagttctgtagtgttctaagtgtggtgacatgcagtagcttcaggctgtgagagattaatattgctttggctcaggcagctagagtctgtaacatcagcaactgtatgatccatggttgcaagagatatgggatgcccatggtggctgtgaagacccttgagatccttagtcttgactctgggtcaagaagcaagaggccagagcaggcagcaatgaggctagagccagcagtgtacacacactcagctgcaggagccaactatggacacttctgtggaggcagaggccagctgtgggcttgttcgtggtgtctctcttagtcttcacagactggctttctactgggaagattttcaccaatcatcctggctagagattctggaggccttgcaaaccttttatgtggatgtgtcttttctggacttgttcatgtatatttctatttagagagatgtattggtttatttcttttttcagaaagttatagtctcttgttcttctggtgtctgtctgctgtaccattagtcctctgaagcagcagcacaccactcagcctttttttgttcttagtagtcctcagaaatctagagcatgctaagtcccatcagcattctgagacaggcaaatcagaagccacccccttgagcagcctcactctcctgtaaagtcagaacattggatgtctggtccagccttctttttctttccctacagagaagccagaagctgagcatttcttcccaattatgtggcactgtgccagcaggagggataatggcaagagggtgccaataattttcctactggcttcaatatagttcgttttattattattattgttatactttaagttctagggtacatgtgcacaacgtgcaggtttgttacatatgtatacatgtgccatgctggtgtgctgcacccattaactcatcatttaacattaggtatatctcctaatgctatccctcccccctccccccaccccatgacaggctgcggtgtgtgatgttccccttcctgtgtccatgtgttctcattgttcaattcccacctatgagtgagaacatgcggtgtctggttttctgtccttccaatagtttgctgagaatgatggtttctagcttcatccgtgtccctacaaaggacatgaactcatcctttttatggctgcatagtattccatggtgtatatgtgccacattttcttaatccagtctatcattgatggacatttgggttggctccaagtctttgctattgtgaataatgccgcaataaacataagtgtgcatgtgtccttatagcagcatgatttataatcctttgggtatatatccagtaatgggatggctgggtcaaatggcatttctagttctagatccttgaggaatcaccacactgtcttccacaatggttgaactagtttacactcccaccaacagtgtaaaagtgttcctatttctccacatcctctccagcacctgttttttcctgactttttgataatcgccattctaactggtgtgagatggtatctcattatggttttgatttgcatttgtctgatggccagtgatgatgagcattttttcatgtgtctgttggctgcataaatgtcttcttttgagaagtgtctgtttgtatccttcacccaccttttgatggggttatttgattttttcttgtaaatttgtttaagttctttgtagattctggatattagccctttgtcagatgggtagattgcaaaatgtatgctctactgtgctacaaaagcctcttaactggtttctggatttctcacaaaagggactgttattgaatttgtgtcttcatttgtggaaggaaggtctgggagttcctgttctgccattttattgatgtaattcccttaggtgccctgtcttattcattctcatttattgtatcattcatcatagcctagcactggtaataaaatattttaaaataagaacaacagcgatactgatgactaaagtattattggctagtccttataatgcactttttgtgtgtcaggcattaatctaatcgctttgcagtgactattaacaatttaacagatgtcaacactaaagtagggaaaagttaagtaaattgcccgaagtcatccatctaaataaagctatggttccaatccgcagtccatgttctcaaaccttctgttatgatactcaatacatatttgctgaatagatcagtgagttccagcctgaatcctttctgcatcctctcctatgtctcactgttgaatctgtttttggatgctgaacttggccttttatgagtatcactcctgtcaatttgaattttaaatttctcaaaacttccatgcagtgttccgctcttcttctgtattctaccaagaaattcttcaaattattttgcaatccttatctcaagtatagtcaaccttgacataaagatagtcacttgaatcttaaatgtcactcaatttacttcagatcataacaacccattttcaggcccaagaatgtttaatgaaattataaagtgctttcatttcactcagcaagtgaaaagctaaagggaagatgagtaaatatcgccatggaatagaaacggaaacaaaaggtattatgatagctttgctggtcagtcattttatgtatggattaatttacaaatgcctaaatttccattaaggacattgaatagttccaatttgtatagattcaacatttttttctttgtgcattattattattattttgagatggagtttcgctcttgttgccccagctggagtgcaatggtgctatctcggcttactgcaacctctgcctcccgggttcaagcgattctcctgtctcagcctccctagtaactgggattacaggcgtgagccaccatgcccggctaattttttgtatttttagtagagatggggtttcaccctgttggccaggctggtctggaactcatgacctcaggtgaaccacccgccttggcctcccaaattgctggaattacagacgtgagccactgcgctgtgtcttactctgtcgcccaggctggagtgcaatggcatgatctcagctcactgcaacctctacctcccaggttcaagcgattctcctgcctcagcctcctgagtagctgggattacaggcgcacatcaccgtgcctggttaatttttatatttttagtagagatggggtttcaccatgttggccaggctggtctccaactcctgacctcaggtgatccacctgcctcggcctcccaaagtgctgggattataggcgtgagccaccacgcccagcctctttgtgcattataagatgtgattttaagaatctttagaatttcattttgtcaccctgagaagaatgacttcagtaattttttttaaaatgcctcctcactattatttggtaagcattcagcattaatgttaaccaggcctattgcagcaggattcaaattctactcatcaagttctcacaaagagaatgaagtaatgacgaaatttactaagttgaattttgtacttttgttccagaaatcctgagccgttcaccgcacacttcctacctggcagcgatctggagttttttgtaaaacctcaggctggagaacttcttccttttaacacaaacggaactctcatcactgtaggatttaaacctaaaatgtactgtaggaaatataaagcaacattagtaatacaggtgagttctataagggcaatagccaaggatgtttgatgcaactaaagacactaaataaactagcaagaaaaggttttactacatggtgacagataaagaataacaattttgctgtgcaaaaatcaacttatctcaactgctacatcttggtttacctttcttttgtcaaagagcagaattttaagtatggtatataacaaacagttgtcaacactagaggaaagttaaaaaaaatactttccttccatattaaggaactttagaacagacaaataatgactgtaaagtgatttgtatagttatgtatcactttctgtaacatacctattcaaggacttcattaactttaagttatttgagatagggattttggagcccttaattaaggcagagtattggcaagatgttgaagtctaacataaaaaaaaggaataatatataacatttattttgaattgaaaaaaaaaatgatgtgagccagtaattatctgttaaagtcatcattttattaacagttaaggtaaatacaattttgaacatttattcagtaaccaaagttgctctataaagtttcacacatattttatagtaagagctttcaggctaaatacaactttcaaactacttctaaaaaggtatctattaccactgtctactttcagtagcattggcacacaagcatgttgtcatatacacacaactcctggtacaaaagcgatttctagatttctcagtcaagcaataattagccagtgccataggcagaaaaaatttattgttttatttaacagagacaaaatattgaatattgtttgaggaagttatttctattcttttcatctttctaagagtccttacaatctaggtagtaagaagaaaaagcatttgttgacattttgcacctaccttgttgcctacattgatacataattttttttttcctgagacggagtctcgctgtgttgcccaggctggagtgcagtggcacgatctcggctcactgcaggctctgcctaacgggttcacgccattctcctgcctcagcctcccgagtagcagggactacaggcacctgcaaccacgcccagctacttttttgtatttttggtagagatgtggtttcaccatgttagccaggatggtctcgatctcctgacctcatgatccacccgcctcggcctcccaaagtcctgggattacaggcgtgagccaccacgcccagccttgatatataatttaaagtgatcatattgtacttgcttcagtttgctttaaggggattaaatggcatctttaaaaatattttcaacttaaaattatattcattttatctagcatacagtagacagttctgcaattaacagaaggctttaccaacaaaacctgtgcctgatttctctgtgttgatttgacaaattactggcagtgcaattaaagattttatgtgagggaacaagttgttacatgggaacaacagagaatatgccatttttagcctgaagtggtacaatttgatacagtttatgtagggaaaattgagtttgaaacgtttaagaaatcatgattttcttaattctacttttattattgaaaattccaaatgtgtgtagaaatagagagcataattaatcaccatgcactaataatccagtatgaacattcatcaacttatggccaattctgcttcacctatatgcctactctcttccccaccttctgtataaagggttaccttgtgctaagcatatccaacactgtaattcttgccctacccctgacaaccactaatcttgtaatttctagaacattatataaatggaaccattaaatcattaaagcattatccaaataaaaaatattatttgcattatcatcttttttaaatgaatgattttaagcattaagtcaatgtttgcaactatattatcttcattttgcctcacttggaaataaaaatgatgattttaaagaacgtgttaattaaatattagcccaaacaaacctcaataatcttgttcacaagtttcataatttcccattccattaaatcaaatttaaaattgttaaaagctgtcttttcccactagtaaacaagatatatagtgctagttttgagactttgagactaaagtttacttatttagtctgttttacaaaaagcggtgccactcaaagagagtactaaatctgctcaactttcccttggtggatatgataaatcttagtttatgaaaatgtgaggattatcagaattatctaacataaaatatatgatgctttatctttatacttatataaattattcatatatattacacagtaatatataatacataagattatatatgatagtgatttcattgataatatataagtaatatagtattcatataagtaatatttatatacagatgtacctgttataactagagacataaccagacattgataatttgtgtttgcctttaaaggaatagatcattagcatgaaattgtgggaaatggcattgtaaatatcttggtttgtatttcctcagatgcagatcttgaaatcaggattgaaatccaagtaccatatttgctatgtgatctcaattaacagatgtagggaagacaggatgtgagatagggaaggggaagaaatcgataaagggtactttatccaggcatctgccacagtgagcaactggaaaggaatcccgtggaagatctctgggaaatggcgtggaacacatacctcagagttttcacacctgagaggttaagaaagtttggttacatatacagtaaccgccactattccaatcattgattgaagagtgctctcagggattgttcaaactctagcaccagtagagaagccttctggggtttctgaacaatcttgagccaaagaggtacaaaattgatctatgaagtttcacacatattttatagtaaggacttttaggctaaagacaactttcaatcttacaattgaaagttgaagcaggcagtgatatgaaaacacctgagggttgtgggtggacacagaccacatttgctaatggataagtatcaattgtttccattcatagaactatgccttaaatatatagctttcttaatggaaactcgggaaataaaaatatatatacagctttggttattcagtccatgagatcacggactttgggtgatctcttttcagaacacagagagacacaacctgaatgtggaagtttcatctgtttatttttttaaatttctttaaataaatagttgagaagtataattgtcaatttggcattttttgtgaaaaatcaatgtggtaattctatgagatgttagtaatatggaagtattaatgtattcttatattattttaacttctgttctgtatttatattttcaaagggagattggggatagaagatataaagttatatctttaaattttttaaaatatacatggatagttgcttttatttatggttaaactgaagaaatttagctatatgtaaaacaactataatgttcaatctttatttcataaaataaggctattaatgttgtatagctgtttggaatgaagagtatgaacaacttccatacacacacacgaagcacacacacacaagcacacacacactcagcatcacttattgtaaaatttaaatcttaattgaatttcaataaatgtaattgggactttaaaacaatgtttttaaaagtaattattttcaaagtgtcttggcgaaggtgaaggtacaagtccatacttttagctctcatttgtacccactaagtgctgaataaggatatagatcccttcatatagcttactcatgtatacccactaaatgctggccgtgggcacagggcccttcagtaactcaggcattagtatcaaatgccaggcatggtgtaggtctctgcatttagctcactcatttttacccatcaagtgggtcaatgtactggaaaatatatgtatatgcacaatcactaaaatatagctttgtttttcaaattaaacatccttatacgaagtaaaatttttttttacccagtcgtattatgctccttggtttggtccacttttgacacactgattctgaatacataattattacaaacactagataaatggtccagatatgattaggatgaggctattaagaatgtattgttgtgcaatacattcttgtattgttgtgcaagacattcttgcacttaatattaattgacaggtatcacactacatataaagctcagagcgttgcaatattcactttgtctggacctattctgaatgagttttctgagtatacgtggtgtaaatcttaatgttaggaggacaccagtataaacacaggtggtttcaggaagttctgcacaaggaatgagacttcagtataaacataaacatatatgcagaagaaatgaagaatgtttaaataaatcactgtgtaaattctactcacttggatttagatggtgattgtcagcaatgatcctacatcatttgtggtatattaaaatggttatacgtactatgggctgggtgcggtggctcaagcctgtaatctgagcactttgggaggccaaggagggtggatgatctgaggtcaggattttgagaccagcctggccaatgtggagataccccgtctctactaaaaatacaaaaattagccgggtgtcgtggcacatgcatgtaaatccagctactggggaggctgagacacaagaattgcttgaacccgggaggtggagattgcagtgagccaagatcgtgccactgcactccagcctgggtgacagagtgagaccctgtctaaaaaataaaaaataaaaataaataaataaatagttatacatgctatgtactttcataatcttcaaagcagctaaatatattttaccagtcatttctatggttacacttaaattctcatgaatgtgtttatcttggaaggtactatttccattagttggcgttcatactgtacaacagtcttatgcaagccaaatagattgctttcccttattatcagatggatgcgtagtttacagggagaatctctgagagattttttagtaaataattcttaattcataaagtgaaatactttctttattttccacattaattgtcactctaagtggtttcagttttgtaccttttccatactctacatggagaacagaagatgttaattatagtgaacttttccctacatgttttgaagtccctggatatttcaaatgaaaatttctccctctttctatccagacagaagaaatgtactggaagtatgagatcaatggattaactccaactaccgtgccaccaaaaaatgcaaaagccaaaattgatgctactcacaagacacatgacaacatgccagtccgtccacataattttgtccgtgaaaatactaaactcataagaacaggggtgtcttccaccatcaagggtgctcctttggtgaagaatcaataaaatttttttccaaaatatttcttggtctcaggtagaactttgatgactattatttcatcttttggaatatttctgaggaataatggtttaattataataggccttctatatttccttgtcttttaaaattcaatctgttctctgaatatattatacttcatttgtgagttatgaatgttttttggttgcgaacattggaattggttcacttttaaagtgcaggtgtatatttgtggtaaaacgaaatataatttaaatgacaacagtatttccaataacagcgttgctaataaagctaaatgtctcatgtagatattccttgttagtctttatgttttaattgacaactaaacattgtatatatttatggtatacaacatattttgaaatatgcatacattgcagcatggttagcctgagctaattaatacatgcattgccttacatacttattttttgtagtaagaacacttaaaatatactttcttagccattttcaactatataatacattgttattaactatcaccaccatgttgtacagcagatctcttgaacttcttattcctcctatctaactgaaattttgtatactttgaccagcatctccctatcatcctgattccccctacccagctcctggtaattagcattgtactcttgtatgagttcactatttttagatttcacatataagtgagatcatgcagtatttgtttttctgtgcctggcttgttttacttaatgtcatatcttccaggttcatccatgttgtcacaaatggcaggatttccttctttttaaaggctgaacggtatctcattgtgtatatatttcaaatactagtattgctattaaagctcaatttcccatgtagatgttgcttgtgagtctttaaaacattaatgattaaattagcactgaagacagaaggattgaccatttcttatatctgctttataaaatatatgcttatatcgtatatcttctatttggaatattatgtgctatttaaaaagtaattaattaaaaattccatgtagatatgtgtatgtagttcatctacttctatattgcagcatttaaataatataggtatatctcaaaaggatccaggagaaagttcatttcgatgtgtgtctgatccttttcagtaatgtattaatcaaagtaaaggggagtatgttgcttggtacttatcattaaagggaagccagtatggaccagctttaagatattttgacacaaactggctctgccacaaaacattcatgtattcttaagcaagttgcttacccttttttaccctattttcttgtttccaaaatgaagggactatactaggacagaggttggcatactatggtccatgggatgaatgtagactgccatctatttttatatagcacattagctaggaacaatttttacattgttaaatggttgaaaaaataaatagaagaatattgtgtgacacaagaacattatataacattcaaatttcactgcctataaataaagttttactggagtacagcacaatcacttccttatatattgtctgtaattgctttgcactacaacagcaaagttgagtagacagaaaccacatggctgcaaagcttaaactgtttattctctatctctttacagaaaatgtttggaaacgtatctttgggattaatttgtattgtctgtagcaattgagaaagaggggagtggaagtccatattccatggatttaacatccatggatttgggaaaaactcactctttttttttactgtatccggtctttcttcttctaacttggtgataccctgtgaacttgtgtcttgagtcatcttcccagctcactcttgccaagataggaatacattctgcttgctcttatgatccctggtggtagttccatttttatctaacactaatgaacccttctataaatacacaaaataaatgattattatatagataatagatgatgaattttcagtcatgttgcattgaagagagcacaggaaatttaggtaagttaattggtgtttatgtatatgttctaaaagtgactttatcacatgtataactaagagtcttgagaggatgaataaacaatccctacactgttgctacatgttcaaaacactttcttttacttctttgctcttttataaagctaatatgaacaagttattcttgaattccgaagcagcccattggaacgaatgatgtgggacaatttggccaagttcaagttgataattctggcagtaaaggaaagaataattgaatgaataccacaattccaaaaatatggaatcttccattggacttagaagatgatcctggattgctttcttcacaagaagagattagaagtacatgctattcaaggtgatatttattctttttatttaagctatcaagaagacataaggggcaaggtcatagtgtcaaactctcccctctcctgccccatcaatttgtggactattttacattcaaaaggtttgaaattagatcagaagattaaacttttcctttggcagtctttttcattttcaatttcttgtaaaagctttttttcagaatgtccatctttacacagttatgattatagctcttatggtaacttttagggcaaaatcaataagacctcttaaaattctgcaagaaagaccagttttgttttattttattttattctaatagtacaaaggcattgggaaaggattcagtgagagtaaacttgcattgtgtacttccagatatttcttagtccagcactagtgaatatcaatggctcttaaatggcatcaaaccaattcagagatgaaagcagttacgtgggaaacatagagtgattataaagagatctaacaatgtcctaatagcctcaaaattcttccctaattcttagagaacaaagaacatgctatgttatgtcgatattcatagtttcatattaaaaatgcagtctggaaataaaaaactctaagatgttttacttggagtttcttatttgaggatcacgaattgccccttagtatgtgaattctctgaagaatgcaagataggccaggcgcagtggcccacacctgtaatcccagcactttgggagacagaggtgggtggatcacctaaggtcaagagttcaagaccagcctggccaacatggcgaaaccctgtctctattaaaaatacaaaaaacattagctgggcatggtggcaggagcctataatcccagctactcaggaggctgaggcaggagaatccctcgaacccgggaggcagaggttgtagtgagccgagatcatgccactgtactccactccagagtgggcaacagagaaagactccatctcaaaaaaaaaagaagggaagatgagattttttgggggggaatctgaaagttccacataaatctgacattgtacttacacaaaatacatatgcaaatttgaaagatgattgtataatctctgaacccggattaaatacttatcaatttactcatgggtttatgccttttattaggaaacagatgttgagtaccgctcagaactagtttctgtactccatcctaagataaaaagagaaaagaatcctgatcaaaactttcttgacagtgcttcttgaatggtaaagaaagcaggtatgagctggtagttcccatacttgtggaaagtgctgtcattgagagcttggtgtggaagcctagaggtagaaatctggcagaggagagagaaaaggcttcaaattggagtcttccaagtatagaagaggagtaacaagaagaaacaacttgaatttggaggaggaacatgtgaaaacatggccagtctcaagagtaggaagaagtggctgaagctcagaaaaatagtatagggggtgacgaaaaaggtgggaacgaatgtaagtgagaacagttgaccttaaggtgactcacattcttagttcagggacgacatgaaataaaaatgtaagaagatgagctcaaatttgaatatgctatttttaggtaaagatatggcatttgtattgaaatgaccagttaacagacagatacacttacatggaacttagaacaggaatttgattttgacgtaaattttatgactcattggttaattatttgtcaaaaaccaatctgtacaaggcaaggcttagacaaagtttattaaaaaaacagtagttctcaaactttagtatgcattataattatctgagttgattacaaaatgcagatttataatattcacattctctcattctgattcagtatttttgaagtgagatccaagaatgtatgttttaacacatgctccagatgattccaaggttcacacattaagaaaaaatattgagtaagagaagcaaggcataaaaacaacccagaaaaatgaaaactttcgaattagcaacaagcatagaaatgaaaaagaggtggtatacactgagaagaaactagttagaaagagatatgtgtggatcttcctcctgaggtgggagtactccagtcaagggtgctgtcctcactgagccaaccacagcaaggcataggtcttggagaaaagactggacgatgtggaataattacccactgggaataaaaggttaaggggaagccatggattgaatgtgcgtggcaacttctgcctagatttcagaggatgtatcagatagtttgagtgcccaggcagaagcctgacacaggaacaaacttcacagaaagcctctcctaagacagtacctagtagaccctcggaagcaggtcttctccccttcagacccaagaattatagagccaccagtagcacgcaaccccagcctggaaaagcgataggcattcaactcctactaatgttagcagccacatggactgcacccagcaaagggaggggctgcctctggccttgggagcccactccttataccagtgtgcccaagatgtaggatatggtgttaatggtggttattttagagctttaagatttaatgcctatctttctgggtttcaacttatgtgggacctgtttccagtttcctttggcctatttctcccttttagaatcatatcttggaagtaaacaatatgattttgattttacaggctcatagctgtaaggaactttccttgagtcttaggactttggacttcggaattttgaattgatgctggagcatgttaagacttttggggaccattggagaccactgagatgaaatgattgtattttgtatgtgagaaacagatgagatttagggtttcaggggcagaatgctatgctttggatatttgactctccaaatgttgaaatctgatctcaatattggggatgggtgcctaatgggaggtgtttaggtcatggggcagatgcctcatgaatggcttcatgcagtccttgtggtaacgagtgaattcactctctattagttctcatgagaacttcttgttaaaaagaagctggcacctgccttccctctctctctcacttcctctcttcccatgtgatctgcatgtgttggctctcctttacctttcaccatgagtcgaagtgcttaaaagcctcaccagaagcagatgctggtgtcatgacttttgtacagtcagcagaaccatgagccaaaacactaataaataaatacccagcctcaggtatttctttattacaacaccaatgtagtaagacaaggctggaagaatttggaggaccaggatagaaaaagcctagattgctgtgaatagagcaaatttattataaaatatttgtcaaatttgtcaaattatttcatacaattaacatcatcaagaagcaattcctgtcctgtatttagttggttgtatttttacttttaaaagctaacttattttttaattgacaaaatttttatatatttatcctgcacaacatgttgttttgaaatatgtatacattgtaaaacagctacattgagctaattaacatacattttctcaaacacttatttttcatggcaagaacacttagaacgttggttgtatttcttagctttagatttcttcatgcattttagaattgtggatcacaggcttatttgaggggaacgtattttttgctttgcattgctttatttttctttaattcccttggctccctcctccctgacaagaagttatgaggctattttatgatcaagggttgtgcctcctccctggtagggatatgaagcatttacaagactggttagtgagcctcaggacagggctgtcctgaggctctgccagtatcctcaggcttatattgcctggaaaccccacaaaaattgtagcctcaggcaccagttgtcagtatattttcactctaattttattaatcataagctcctggatttaagcagtgaggccaactttatttctccattttacacagatctgtagtccttcccaccccctaggagatgaagttgtagcttctattgcctgctttggaatatggtacttcagctccgttaaccacttcagccttctatttttgtctctggtctatgaaaatgtttatcttgtcaagtctctttgattatttatttttatactgtatccatctttgccaaatttgtagagcagaaggggttacatcaaagaagaaaaagagcatgccatttttgctggtgtccctgggttcatttttaactcacattccattagtgattttcagtgtaattcataaaggaaatccaaccactttgaagtaaaaatgactatggagtatccagtaatttaaaaatatagatgataatcaattactaaagttctttctgctctgtttcaagaggtgcttagcatttaaagagttatctaaaactgcaattcaatcaactagttaaggatattggaatggttcctcctcatcagctatcactgagaagagcctcagtgtctacattttagtgttggttaagtaatttttatacccttttctgcaagagtgaaaaaatttacactgaatatcaggttgttgaatctttatatctttgcttgtacattaacatgtacctgagtgaaggtctgaagtactctgtttttaagccctaaaatgttgtgttttattgagctttaagctgaaggtcttatctttaaaaattatacctacaaggaaacaatcatttcctcttataagaagcactacattaatctaaattgagacatagactgtatattttaccatattataccatattatatggttttaccatgtttgccatattataaagtctgcatagacagattaacatttttattcaagtgaactaagaatgtatgtatcgattaattcactctactggacctcagctgagaaatatccttagtatgcttcaagtcattgaccataggtggggaatcctctgtatccagacatccagcagggtccctctccctttacgtttcaatctgctaagattccaaagtgatgaatttcacttggcttgcctcttaattattttactccatgatttggttgaagactttgagccctatgctggaacaattcttctttcttgttctgcacagatcaggtcttcctccagtgttcaagccatatttactttctgtgcactgactcagcggtgtccactgtggacaccgctttcttatggcttttgcttacgtctcttatctttatcaattattggcctcttctgtttccctccatcatgccagcactgaatgaaggccataaaaccttagatgggaatttgaggtattatagtttacttggaagttgaccaaaggaagcaccattaggggatttagaaattgaaatgcaaatgaggataaagccagaaaagggtatgctattacaaggttagtactatgggcaactggggctcacttctactggagacatctgaaatccggaacaatatatacctgagagttatccccttccttttccaggggaatgtcggatctagtatttatcctctaattcccatttgtcatttcaaaaggcactaaccttcttaggacattaacttacacatgggtaaaagaaagccttcaggcagaaatttgccttagacaaggttgtcaggtactagacagtgaatattaagaaagtatggaggaggtactagtagtagctgatgaaacgctcagttcactggactcatcctcaatatccatgtttattctcccacatgatcccatagttaattgaatgaggggcatggaattgacctagaaaaaaaaatcattacattctctttctaggcatttctctttggaactgaagaagctatttggtctcacctactcaggtaagtttgggggctgagaggtagcactgtatgcagcaagaaaagcatcaataattcctgacttcagatagagaaataaggcaaatatacatagagagacaaattggagatgtttgtttactaatgacattctaatggcttgttcatattctggggatgtctgtccgtattgcctatccttgggtttcacggattatacctgagttttataagtttatccttcacacttaaatatactctgaatgaacttagcaaatgaatttccttctagacccgtttaaagaggatgcacaagaatactggtatatggataaaaaaacataggaggttgacagcctccacattttaccaaagtcagaccaagttggagtgaggaagatgaagtatattaccagatatatagagaaaaaaatactatgaggcaccttattatatctgagtcaagtacattttcattttaacatttttttttattatggtgaaatatacaaagcataaaatttaccctttaaccatttttaagtgcacagttcagtagcattaagtgcattcgcattgctgtgcaaccatcactattatctatctccactattatctatccactatataatatctccactattatctatctttttttatctttccaagctgaaactctgtacccagtgaacaataattccctctttctccattccacagccccaggcaaacaccatattattttctgtctctatgattttgactagtctaggtactcacactattaatgcacacatgtgtgaaagaaagcccctgggcagtaagtggaagcatacagtgtttgtccttttgtgactggcttatttcacttagcataatatcttcaaggttctttcatgttgtagtatgtgttgggattaaatttctttttatgctgagtaatattccactgtatgtatatgccacattttgtttatgcattcatccatcgatgaacacttaagttgcttcctccttttggctgttataaataatgctgctatgaacatggatataccaatatctttttgagtctttgatttcaatttcttggatatatatcctgaagtgaattactgggtcatatggtaactctatttttaattttttgaaattgccatactcttttctgtagcacctgcaccattttacattagcaccagtgatgtgtaagggctccaatttctgcatattctttccaactgggtcaaataacttttaataaagattcatagtatcttcatccaagagaggtttagaattacacattcttgtttttctggtcacagttgttgctaagaactgctccctagtagaattaactttcttagggcattaactgacacatgtgtgaaagaaagcccctaggcagaaatttgaagtagttatacttaaaaacttgtttttaatattctttcttaaattaaaattttaaatttacatgcagttgtaaagataaaaaagtgacatctcatatatcctttacccagttaccccaatagtaatatattgcaaaactatagtataatagcccaaaaagatattgacatggatatatatactcaaaatacacaacagtgccattaccaggctcctttaatattgtccttttgtacccaagctccttcccatgccatcccaatcccctattttacccctggcagccacttgtatgttctccatttctataattttgtcatttcaaaaatattacataagtgggatcatccagtatgttccatttagggattggattttttcattcagcataattctctggagatttaaccaggttgttgtacctaaataatatgttcctttatatcacagagtagtattccgtagcatgaatctttgtaatattcacatggctaacataatatgtttagccatttaactattaaaagatatctacattgttcacattttttggctactaaaaagtaaatttgccatgaactttcatgtacagatttttgtgtgaacacgtactttatttattagggatgaatgcccaagagtgcagttgctgagtcatatggcagttgcatgtttagttttattaaaaactgacatattgttttcagagtggttttgctgctccccattcccaccaataatgtatgtaaaatccagtttctccacatcttcaaaagcatttggtctgttcatgtcctttgcccacatttaatgggtttgtttgtcgtttacttgtaaatttgtttaagttccgtgtagattctggatattagacctttgtcaggtggatagattgcaaaaatattctccagttatgtaggttgtctcatcactctgatgatagttacttttgctgtgcagatgctccacagtttaattagatgccgtttgtcaattttggcttttgttgcaattgcttttgatttttttgtgatgaaatctttgcccatgcctatgtcctgaatggtactccaagattttcttctagggtttttatagttttaggttttacatttaagtctttagtccttcttgagttaatttttatataaggtataaggaaagggtccagtttctattttctgcacatggctagccagttttcccagcaccatttattaaatagagaatcctttcctcattgcttgtttttgtcaggtttgtcgatgatcagatggttgtagatgtttggtcttatttctgaggtctttattctgttccattggtctgtgtgtctgttttcattttgttttttttgttggttactgtacccctgtcatatagtttgaagtctggtagtgtgatgcctccagcttcattcttttttgcttaggatcgtctttctataccggcccttttttggttccatatgaactttaaggtagttttcttctaattctgggaaggatgtcaatggtagtttaatgggaataacattgaatctataaattactttgggcagtatggccattttcatgatattgattcttcctattcatgagcacgggatgtttttccatttgtttgtgtcctctcttatttcctttagcagtggtttgaaattctccttgaagaggtccttcacttcctttgttagctatattcctaggtattttattatctttgtagcaattgcgaatgggagctcattcatgatttggctctctgcttttctgttgtttgtgtataggaatgcttgtgatttttgcacattgattttgaatcctgagactttgctgaagttgcttatcagcttaaggagatttggggctgagatgatgggtttttctagatgatagactggataaagaaaatgtggtacatatacaccatggaatactatgcagccataaaaaggaacaagatcatgtcctttgcagggacatggatggagcttacctcagcaaactaacacaggaacagaaaaccagacaccacatgttctcacttttaagtgggagctgaatgatgagaacaactggacacagggaggggaacaacacacactgcagcctgtcagggggcaaggggacagagagcatcaggataaatacttaatgcacacggggcttaatacctacgtgatggattgataggtgcagcaaatcaccatggcacatgtttacctatataacaaacctgtacctcctgcacatgtaccctggaacttaaaattaaattgaatttttaaaaaatttggtcttttcaatatttttaatcttagccatcctgatacgtgtataataatacctcattgtgatttaaattgcatttccaaaatggctgataatgttgaatatgttttaataggttaattgctctatacaattcctattccatgaaatgtatatttatgtttatgtctcattttatagtcagattgctttgtcattattgggtactgctgagtcttaaaaaattctaatacattgtagatagtatttatttgtcagatatacatagagtttagtttgcagatattttcttttttatttaacttttattttaagttcaggagtacatgtgcaggtttcctatataggtgaagttgcgtcatggagggttgttgtacagattatttcatcacccagatattaagcctagtacccattagttattattccacatcctctccctcctcccacactccaccctttgataggccccagtgtgtcttgtttccctctgtgtgtccatgtgttctcatcatttagctcccacttataagtgagaacattcagtatttgtttttctgtttctgcattagtttgctaaggataatgacctccaactccatccatgtccctgcaaagaccatggtctcattcatttttatggttacatagtattccatggtgtgtatggaccacattttctttatccagtctaccattgatgggcatttaggtcgattttatggctttgctattgtgaatagtgctgcagtgaacacacgtgtgcatgtgtcttcacaacagaatgatttatagtcctttgggtatatacccagtaatgagattgctgagtcgaatggtatctctgtctttagatctgtgaagaatcacctcactgtcttccaaaatggttgaactaatttacactcacgtcaacagtgtataaacatttctttttctctgtaacctcagcagcatctgttattttttgactttttaataatagccattctgactggtgtgcaatggtatctcattgtggttttgatttgcatttctctaatgataagtgatgtgagcttttcatatgattgttcaccccatgtatgttttcttttcagaagtatctgttcatgtcttttgcccactttttaatggggttgggtttgtttgtttgttttgtaaatttgctaagattccttgtagattctggatattagacctttgtcagataaatccattgcaaaaattttctcccactctgtaggttatctgtttactctgttgagagtttcttttgctgtgcagatcttaatttaattagatctcattagtcaatttttgcttttgttgcaactgcttttgctgtctttgtcatgaaatctttacctgtgcctatgtcctgaatggtatcgcctaggttgtcttctaaggtttttatagttttgagttttacatttaagtctttaattcatccagatctgatttttgtatatgttgaaatgaagacgtccagttttaatcttctgcatatggctagccagttttcccagcaccatttatcgaatagggaatcctgtcctcattgcttgtttttgtcagatttgtcaaagatcagatagttgtaggtttgtggtcttatatatttactctttatgtaagatgtcacacattactgtagctactttgaaaattttttgttttcaattttcattagtttgaccttgctgtgtgttaagtgtggattttttgtgtttctttttttgtttgggttttttcagcttgtcaaatctatagatgtatatcttttgccaaattttggaatttttcattaattatttttataattacattttcagccctaccttttttttttctctgctatttccagaactctgatggcattaatactagatattttgatatggattaaaaggttcctaagtctgtttgtaattctactttctcactgttactcagttttgatagtttctattgttccatcttccagttcattgattttttttttttttcttatattgcctgtttctttgctgggacattcaatctttgctgatagtttttatttttgtttggttcaaacatattcataatgtttgttgaagcttttattttatcatttgttgaaggcaactgctttaaaatacttgtcagatcactctaacacctctgcaatcctggtgtggggatctattggtcaacttttttcattcagattaaggctttttggtttgggatatgaagaatacttttgtttttatttgaaacctggacattttagatatcatgttatgagtctctgtgtcttatttaaactttctgttttaggtggtttcatacaataacagtccaacagggaaagggagacaccacagttttacagccaggtggaagtagaagtccaggttcttcacttggcctctttgatattcaacgtggatgcgcctcttgttgttgctgggtagggtagaagtttgagctctccacttgaccttaagtgacacttttctgttgggaggcagaagtacttggttattgctactcacatgaccttcagtgacaccacaaagagggtgtcatcacagttaagaggtgatgaaaatcctgtttcttcactattcttcctttgaatacaccctaattaggagggcaggagtgtcttattactgcagggtataagtggatatcctgccctccatgttgtcttctctgtcactgtgagtgggacagagccttattaccaccgagcaggaatgaatgtgaaatccctgctccctacttgtgcttctctgacaccacctcagtgaggggtcgtggcacttcattacagtctgacaagtgtgagtgggaatgtcaaattctcagcctccatttgttctttattggtgaaggtgaaggggagggctccctcaatgacattttacagtgtttggttggaatatagcagattgtctaaatgttcgttctgctatgctgaccttttcttagtcttttttctaaagagggaaggctttttttttttttgaaaactcaccgctgtgttgtttcctgagttcagagcttcttatctactttattcccttttctccatatttcagttatacacttaaataacttagaagttattttagttatactaagtgggaggaatagaaaaaagtttatctactccatctttacagaaaaggaaatccatctttacatttatttaattcagagaaaaaaaaatagcatgcctgctttcatttccaccagtatctttgtcatccatttatttcaaaagtcaaaaggagtgcagagctattcacctatcaatcccattctatggtaaatcaattttcaatgtgattcacagacaactttttcttttcttttcttttcttttttttttttttttttttgagatggagttttgctctgtcgcccaggcttgagtgcagtggcatgatctcagctcactgcaacctctgcctgccgggttcaagcaattctcctgcctcagcctcccaagtagctgggattacaggcatgtgccatcacacccagctaatttttgtatttttcttagtagagacggggtttcaccacgttggccaggctggtctcaaactcctgacctcaggtgatctgcccacctcggcctcccaaagtgctgggattacaggtgtgagccacagtgcccagcctgacagacaccttttgaatttttctgctatttgcctctgtcctctgaatgcataagagaaattctaaaatttaggggcataaagttaagcccaatgcagtcaaggtgaatggaactgtgaagtgatgagcttctgaatgctctgatctcacaaagactccccagcatttgagaccaggcctctctttttgtctggtagtgctcttgccccaaatacaggcttgagaaatcccaacaatcatttcctatctttttcattcaatagcttcaggcaattgatacttaaattattgctataaattttgtaaatataagttaaatttcaaattctttaaaaaaatcatttcatctctccttattgtaaacttactgaccaaaataaaacagccaaatgctttgattaaatgaagattcaaacattatgtctataattctgtaagaaaatgtcccagttttatctcagtatttatttgtgtcttagatactcaataattgcatttttctgcaataacatattacaataaaataaatgactgaagaatagcttatattgctgacacagatcacagtgtgtcactaatggagtattaactgctttttaagcaactggataaatctgctgattcataagagactcatgtaaaggaaatccaattcatggtggggctcttaccacttctacgggcataaaacaccttcttccatattatccttgtttcagtcatgggaatattgagagtagcacctgacttgtaacaagatcttttaactgggagagttgacacatttaataatatgtcaagtctactatttaagggacagacactgctcaaaataaaaatggtatttaagaatatctttcatgtaaaaataatccccagggaacaagggtttgctccatttcaaagatcagaaaagcagtgctgaaagagcattatgagcttttcagagacaaaaaaaaaactatgactttagcttcatccctgggaatccctacgtgattttatatctaggacaaccactcacagaggcccatgcaaaactttaacagaagcaaaacatagcacttaagcagatattttttttcttcttttaaaaaattgagacacggtctcattctatctcgcaggctggagtgcagtggcatgattatagctcactgcagcctcaaactcttgggctcaagcaattctcctgcctcagtctcccagctaagactacagtctctcaagtagctaagaccatacgcacatgccactacacttatttatttatttatttatttatttatttatttatttattttgagatgagttcttgctatttggcccaggctcatttcaaactcctggccttaagtgatcctcccaccttggcctcccaaagcattggaactgcagacatgagccaccatgcctggccctctaggcagatgtcttcatgtctcagttttcctcagcatctagagcaccttcctgttttgtatgcctttgtaagacagttcaaactaagaagaaaatagttccatctgaagcatggtttggaaatggggctgtgcttttcttacaggtatgcatatgatttatcattttttgaaagaataatacggtaaatttgaaaataagatatgtataagaaaaacgtgacatttataatgtatttttatgaatttcaaaaaagataaatatttaaaataacactcttcacttagactcatatcacagtcctccaagaatggatacctgtagtagttatttaaacaatagcttacaagaagttgtgtaaattgtggtggctacataggtatatgcaggctgtaaattgtttttaagttgttaacatctacatttaggaatagaaaattatgataccaaatctacatttcagcatcacttgctcctgaatgcagcatataagttctattgcctatgcagatagatgatccagaaatatgacttggtgactcagaaagaatatgtggaaatcatcagtcccgaagtatcaaataggatcttttacactattggataaataatttcacatctattaaaaatattttagtaagtaaacaagtctcaaatataaagctcaaagaatttttacatatgtaccagatcaagatgtagaatttatccccctatctagatagcttgtttgtgcctgtttaatattccccagaaagtagcaacaatttcaaatgctatcactatgaaattgttttggttgttttggacttcttagaaatgaaatcataatttgttctcttttctgtttggctttctttcacccaatattttgtctgtgagattcattcacatttttgaatatatcagttttcaattcctttttatttctgagttatttcccattatatgtacatattaggtatatttatcctttcatgtgtggatggacctctgtgttgttccaggatttttgtcattatatataaagctcccaagaaaaaattcttgttcatgttttttggtgcatatgtgtacgcatttctattatatatatagctgagggtacattttctggatgctagagtatttgtttttggctttatcatttgctagtacaaatttttccaaaatcgtcttaccaatctaaccaccaatcaacaatgtgtaaaagttccagttactttataacagcaagaactcatctcagcacgtggtattctcagtccttttaattttagctattctggaagtggcctactgatacctcactgaagtttaaacttgcatttcctgatgacttaagatgttgaacaccttttcctacactagttagcaatctgaattggaagtgaactagtttaattttaaaaggtagaaattaaatgtttttatttttttcatacatattaggtaaaaacagttgtcatttcacaaaattccccaaaaccattcactattattccaaacttgaagagaagaaatcagaatcacataagaaagccaaacatcagtggtaagaaagtactgtaactgccaagctttagctcaacagagcttctctgatcttttgctttttgttctctgctaatcatcaaaaatacagagcaggctgtctgtcacaaaccatcagggaggcatattttattagtctattttcacactgttataaaaaatatcacctgagactgggtaatttataaaggaaagaggtttaattgactaacagttccatatgattggggaggcctcaggaaacttacaatcatggtggaaggcaaagtggaagcaaggcacgtcttagatggtggcaggagagatttatagagtgaagggggaactgccaaaccctttaaaaaccatgatctctcatgagaactcattcactattacgagaacagcatgggggaagctgcacccatgatcaaatcacttcccaccaggtcccaccctgaacacatggggattacaattccagatgagatttaggcagggacacagagccaaaccatatcacatgtgataacattaatgaaattagttacatctcaaaagtggtaactgttagaatagtacaaggattaagaagttatattaagattttataagatatgatcagtggcattttatttgccacacatgggtgttttataatttggtctgcacactgaatcataattatgcacaaattacttatgatgtatatgaatatgaatgtgcataacataaaactatgtagagacacatgctactataaataaatactcatccaaaaagctcttgatagttcattaagcctcataatttgttggaggctcataaatgacaaagattatacatttttctgaaggcaaaaggcagaattccagtgagtctcaggtcttagaagaaagaataacctcacactctggcgtaaatattggagtcagatggtggtgtcttaaattcttataacaactaatcatattgggagtttggctgcaaatgcagccatctccagtccactgatctgaatattcctgggctaccaatcatttaacatttgtctacaagtgctatagctgtgtcaccattactgactacatacacagaaataaatggagctaagttgcttttgtcttaaaatcggacatatttgaagtttattgaagcatttgcctgataagacaaactttggagtcagacttcagtttgagtcttgagtaagtaacttaacaatgatctgaatctccatttccctcattgtaatatggaagccagtttccactgtctccaccttttcattgagttttaaagatagtatatgttaaataactgcaaattgaaacagactaaggtaataatacaaaatgttgtttatactaaacttttgcaacttatgagagttcttgtcttcccaaagaaagtgcaaaaaataaaaataaggtggtaaatttagaagtttttagattgaccattgttggatggttgttggtgcttgatatgtttctgtgaggattccttgtatacttctgtccacttttgtttattttcaaaattttccaaaatgtaaaattcaaaaagaagcactttaaattaaaatactataagtcataggaggaaaacattgcaatgcagtatttctcaaagaggtgtccctgagaccagcagcatcaacagctatatgggatctggtataaaatgcaaattattgggtaccatcccaaatcaactagatcagaaactttgagggtgggtttcagcaatttatttttttaacatgccctccaggtgatttggatgcaagactaaataatgggaaccactgatgaaacaaaaatattattctggaagttaagggatctgaattttagttcaggatcaattggtttggcaaccttggacaagccacatactttctctgaatatcagttctctcatctccaaatgaggtctggatcatataacttcctgggctttttctaccttagccttctaggatgaccctgaaacacacaaattaggtaaggaagtatgatctctgagaaactactatctagaatttggtaaattatatgaattgggagctttgttgactacacaaagggctaacaattaaaccagttgtggctttaattaataggttctttgtatgtagctgggagagtatgaattttcatctccacatacaatttgaaatgtaaattttcctttacaaatagaaagtgtttcaggtttcttattacaatagtcactgattttactattaagcctagatgacttggggtgatttgcttgtgttgttgtaattgtgtgtttttgtttgatgcagaatggggacttatattttctataactgtaactcatttgagaactaacacttaggttcttaactataactatttataaatagcaacttatgaacctaaaaagtatttgcaaagtacttttaagcactaatacttgtcaggagtttgtgtaagtaagtctgccacactcctctggttcaacacaagatgttaaaaagtttacagtgtcatgaaattttggccactctgaattatgtttagagagaacagagagaatacgaagtgaggggaagagattaagaatcctttctacagatttctaccatcaattggcaggacctttctgcggctgaacacttacaaatattagcaacataatgaggacagtcaagcacgttggacctggaggagtgtgagcaaaggcctcattcagaaacataagaaactgggagctcattttcttatcagatgtgattaaactatgagaaggcaagcaagaacttcctttattgtcatcccatgtaaccctgtagattctgataatgcttctggcactgcttactcctttcagtcactattaaagagcaattaaatgggagatcaggaagttgtaatgcttctgggccctctacgttcagggaatgtaatgcgtagggctaagaaaaaggggtccatcctcaataaaaagccacaggaagtcccttccatcccaaatggtctattggtgcagatttaaagtgtcttgtggataacaaagatacctgattttttaaaacccaaaacattgttgttatttactaatccttgaagaaatgacagcaataagctggaataattctgcacatggagcaagcaagaggcttgcaatgctctatttatggagatttatagcaaaggtaaagacaggtgtttatttgtttcttaaagcaagttgaatctccctggatgcatacactagccaagatgaaacaattcaggtgtttcagctggtcaaggtctctaggtggacattattatttagagaataaattaaaagagataagagcaatgaagtgtggacagaatttgatgcttactttactcacattcagctgaggttatagatatagattgaaaagcagggagggtgtcacagtaaaggtagacatctaatgctgacacgtatctatgttcagcctgctttatttgacccatataatttagaaaggttttacataataaagttactccctactcttcctggtgacccttaattgtttgcactcaaacaaggtggtaagagactttcagttccaaccaagactgagaagacccccctgtccttccaggttctccctcttacaacttaaactctggatataatacaacacaaaatcatgagaagactctgaaacatggaaagaaggtgggttgcctagggaccttgtgacttgaagaacaatatggcaatgaattccctggtatattagttagcttagggtgtcacaacaaaataccacctactaggtagcttaaacaacataaatttattttctcaaagaactgaagattggaagtacatgatcaaggtgccagtagggttgatttctcctgaggcgtctctccttggcttgcacatggctacctttgtactgtgtctgttacagtaggcagctagtcaggcatgagcagggcaggagagggatccctgccacccccatcaggaatgtcaggggaccatcatgtgatggtcaggtggttgctacactgtttctctaaaataataattggtcccagctggcactaaggaaaggccgtctcccaatagatagaaaaaacctgaaactggtgatcagcaacttccagataagatctcaggagttgggccagtgggctcaagcatgcacactaagaggcaaaatggtgaggtttaattggtatacaaccttctagaaacattaggactggtacgggaagaatgtctcaagtgagcatatgcacaattttggcaaacacactgcacatgcggcccctctcaagtgctggcaggccaccgtgcatgcggacagcccaccctaggggagaaatctgagaagtaacacaagaccctggaagcatgccaatgtataaaactccaaatcaaaaggtcaactcgcgcacttgatctttcaagttgcccacttggctctcttccaagtgtactttacttcctttcattcctgctctaaagctttttaataaacgttcactcctgctctaaaacttgccacagtctcttattctgccttatgcccctcagtcgaattctttcttcagaggaggcaagaaataatgagagtgctgcacagctgtacagacttactactggaaacgccttctcatgaactttctctgtatacatgtaaaaagagagagagagagcaaactctcatatctattcctcttattataaaaacgttagtcatgtaagattagggcttcatttatgaagccttatgacctcatttaacctcagtcacctccttaagggccctacctccaaatatggtcacattggaggttagggcttcaatgcataaaattggggaggccacaattcagtcaataaaacccatttttttaatcaacttcacatatcccagaaatgccgacaagcacagacaaaagaagaatgtcttttttcctagccaaagttgaagaaaatgggagacctaagaacagaaatcttttggcaattttctttagtatttttccatcaatatccatcagagatattgacctgtagttttcttttttgatgtgactttgtctggtctcttttttgatgtgactttggccttttagaatcagtttggacgcattccattctctatttttctgaaaagtttgagtagaattggtatgacttctttgttaaatgttgcatagaattcagcagtgaagccgtcagttcctgggcttttctttactggaagattgttttattaaggctctgatcttattacttgttattgttctgctcacattttggatttctttctggttaaatcttggtaagttttatgtgtctcagcatttgtccatttcttctaggtttttcaattaattggcaaagagttgcccatatcaccattaatgatcctttgaatttctgtagtataagttgtaatgtctccttcttcacatctgattttatttattttgattttttttcctagtctggctaatggtatgtcaattttgtttaacctttcaaaaaacaaccttttgttttaataaccctttgtaccgttttcttcatttcaattttattaatttatgcttctgatctttagtatgtttttcttctactaattttgggcttgatttgctcttgcttgtctagttctttaagatgcatagtttatttgaattttttctctttttgatgtactcacttacagttataaactccctattagtactgtttttgctatatctcataggtttggtatgttgtgtttccattatcatttgtttcaagaaatttttcaatttacttcttaatttcttcattaacccactggtcattcaggagcatatcgtttaatttccatgtatttttatagttccaaaattcctcttgttattaatttctaattttatttcattgtgcttagagaagatgctagatattactttacttttttgaatgttttatgatttgttttgtgacctaacatatggtctatccttgggaataattcatatgctgagggaaataatgtgtattctatagttgttgcataaaatgatctgtaaatatctattagatccattttggtctatactgcagattaagtctcatgtttctttgttgattttctgtacaaaagatgtatccaatgccggaagtggtgtggtgaagtctccaactatgattgttttggggtctatatctctctttagctctaataatatttgctttatgtatatatctgggtgctccagtgttgggtgtatacacacacacacacacacacacacacacacacacctatatatagagagagacagaggacataacaaatatatacatataattgttatagcctcttgctgaactgacccctctgtcaatatataacgaccttgttttatctcttcttatagtttttgtcttgaaatctattttgtctgacataagtataggaaatcttgctctttttggtttccgttggcatgtaagatcttttttttatcactttattttcagtctatgtgtgtatttacaagtgaggtgtgtttcctgtaagaaacagatcaatgggacttgtttctttttaatccattcagtcgatgtatatcttttgattggagtgttaagtctatttaaattcaatattatttttgataagtaagtacttactgctgccattttcttatttgttttctggttgttttgtggtcttctcttacttctttctttccttcttgccatcctttaatgaagatgattttctctggtgatatgatttatttccttactttttattttttgtgtatccattgcacgatttttcatttgaggttaccatgaggattgcaaatactaccttataacccattatttttatctgataacaacttaacactttgcccaaacaaagaaacaaacaagcaaaagaaaattaataaagattctataccgtaactttatccctctggtttttatcattttattttttctgtttgagttaatttttgtatatggtgtaacgtaagggtgtaacttcattttttttgcctgtggatatccagattttccttcaccacttgttgaagagactgtcttttctccactgtgtagtcttggcattcttgtcaacaattatttggacaaatatgcaagatatttttctgggctctgtattatgttccagtggtttatatacatttgtctttaggccagtaccacaccatcttgattactgttgttttgtagtatgttttgatatcagaaaatgttaggccttcaacttttttatttttcaagactgttttggctattctggatcccttgagagtccttatgaattttagaatgttcttcacatttttttccaggaaacaacaccagatatcacctggtacaatgattcatgttttttagtggaaatctttctagagaggtggacttatccaatgcaaaacattttaggggcataaaccctggtatattcaccttatgttggctctactatggagccaatattcttaaacaactcagatttcagcaacagtcgcctataattatggcttcctgatgccatgttgtttctcctcaagcttttgcatggagattgacctgtaggagtctgaatagggatttaattcatgacatattctgttacataagttaagattggcacatgatagttgctcagtatatgttgttcttctctttcgtatacattcaggtttttttcattactcagcctaatgcaatagataatttttgtttataaatatgatgattaataaagataaatgcctttattttgtactcaagatatattgtaatttggcccaaattatattgctttaactaacccattggtcttgcaatatctttttctctacaagtaccacaatacttttagtgtgtttaaatatctttatacactgcaatgatttcaaaagtgccatttcatatgccagaaatgtcctttattcttgtctttctaatgacctaggacttctaaaatcagctcaaacttcagattctctatgaaaagttttattgtctttccacaaaagggttagcctccctcctttgtgctcctatttgtctcatatatttccatctccttcagttcattttcgtctctgactctataaaagtatgttaaaataatatgctaattcctaaagaaaatgtttccaaaaatgttaaagcagcataacatgaaatgaacacagaagacaagttcagtaaagaaaaaaaaacaaaaacaaagctttaataagttgaaagttattctgatggatcaactcatttagctaaacatcttattcttcttaatgataaaagtctaaaaataacattataaacattcaaaatttcctcccatgtattcagaattttgccgaaataaatataagcaatggcctgtccataaaaactgtagttttatgtgctgtttttttcaggatgagtttctgtgttaagacctgaactggactatgaactctactggtcttccctgtttctgggaagtgtacctcttatgcctacaaaccttgtgtcacagtgaaatgaggccatgagcaatgagggtgtctcattcttgtcagtagtgataatgtaacacccattgcccgagcttgcacaccagaaaatataatagagttctggcccgagaaccctattgaaatctcaattcatagttaacagtgttgccaggaacttgctaaagtagttttctgtttgttttgtcaggctctgtacagctttaagctgctcacctaatgtgtttaatgttatagttaatgtcagaaaacttagtaaccaacatatgagcccagcgttactctcatctgtttgaagttacgctctccaagatgtcagctttgatgaaatgttctccatagggctcttgtaaaactcatcagtagtgcactgatgaaaaattcctgcaagctactaatgtcctttaatcatatagctttgtgtattactctttgatattttgtgcttttagccagagaacctacacaagatggaaaatactactcttttccattctataaatgcatggcatacaaatataaactccgctttccacttatggctaggtattagtggaggaaattaagacacagtgtgccaatggcctgaacctaggctttctagccgtctttgccatttgacggtaatagtaaatcacttttgtttgtacatattaagaaggttttatgaaatctctgctctaaaacaacattaaagaaaaggaagggtagtcttaccccttggtttccccattataacattttcactagaaaaatgctgtcctcacaaggtactgttatttacaagagatacaaaataataaatagtattaagagatttggggaacattttctttcttatatacactttaacatatcaaagtttctgctggtgggtacttacttacacaaagcaattgagatctatgatacattttacatatgtaactaagcacagaatatttataatgcattttactgtaaaaagtttcatgcatgcatatcttctcttactctacattaccccttcatctcctactttaatttaaaaggtgatgaaattgtaacctgtctctaggtttgggggtacacagtgaaaaattacccactggtaacttttgcaccttgagtttttgtttcagaaaagttccaggaagaagttcaaccctgatgtagttgtccattcttgcattgctataaagaaatacctgagactggataatttgcaaacaaaaggggtttaactggcttatggctttgcaggctgtacaagaagcatgatgctggtatcttctcagtatctgagaggcctcaggaaacttccaattatgtcagaaggggaaaggggagcaggtacattacatgagcacagcaggagcaagacagagagaggaggtaggtaccacacttttaaatgatcagatcttatgatatctcactcactatcgtcaggacagcacaaacaggatggtgctaaaccattcatgggaaatgtgccctgatgatccaatcacctcccaactaggcccctccactaatgttgaggattacaattcaacaggagatttgggcagtgacacacatctaaactatatcattaggccctggaccctcccaaatctcatgctcttctcacatttcaaagtactatcctgccttaccaatagtgccccaaagtctttactcattccagtgttaattcaatagtacaaaatccaaagtctcacctgagatgaggcaagtcctttccacctatgagcctctaaaattaaaaaaaaaaacaagttagttacttccaagatagagtggagctataggcattggataaacattcccatttcaaaaaggaagaaatcagccaaaaaaggaactacaggccctgtgcaagtttaagaccctcagagcagtcattaaatcttaaagcaccaaaacaatcttctttgacttcatgtcccacatccagggtacactggtgtgaagggtgggctcccaaggccttgggtagctgcattcctgtggctttgcagtgttcttcttccatggctgctcttacaggatggcattgcatgcctgtggcttttccaggttaagagtgcaagttgtccgtcgatctactattcttgggtctggaggatgacaatcctcttcacatagttccactatgcagtgccccagactctgcatagtggaactgtgggggcttcaaacctacatttcctttctatattgtaactgtccaaggggttcaccttgcctgctgcctagacagagctgatttatcaagacaggggaatcgccatagagaaagagtaattcatgcagagctggctgtgagggagactagtgtttaattattactgaaatcagtctcccctagcattcacacatcagagtttttcaggataatgcggtgggtgaggagggccaatgagtaaggggtactaactggtcgggtcggagatgaaaaggaaaagtatccctacatattttttccagagcaagtgtggatataattttaagtgaaataaaattattaacaattatgaagtttttgttattcatggtatatttaatagtggtgtctgtgtagaggatgacagtgtatgttcactatttggtgaacatagtgtccatgatatctgtcttctaccaatccaaaaagtacaaaaatgaatattaaaatttcaggaatcattatctctcttaatcttttctcttctcagttttgttgtggtaatggaggtagcttacaagcccattgtctactaaaagtacacttacaggtctttaaatgttaaaagaaaagagggtgttttttgtattacgtatacgtgtatctcagaattttccttgtcttagttccgtaccatgcctcaaagtgtaaatgtgaaatatctaaaataaatttaggatcaaataattgctattgttatgctcagaaagtggtttttaaaaaattataccttaagttctagggtacatgtgcacaaggtacaggtttgctacataggtatatatgtgccatgttggtttgctgcacacatcaactcgtcatttacattaggttcttctcctaatgctgtccctcccccagctccccaccccccagtgtgtgatgttccccgccctgtgtccaagtgatctcattgttcagttcccacctatgagtgagaacatgcagtgtttggttttctgaccttgtggtagtttgctgagaatgatggtttccagcttcatctatgtccctggaaatgacacgaactcatcctttattccattgtgtatatgtgccacattttcttaatccagtctatcattgatggacatttgggttggttccaagtctctgctcttgtgaatagtgccgcaataaacatacatgtgcatgtgtctttatagtagcgtgatttacaatcgtttgggtgtatacccagtaatgggatggctgggtcaaatggtatttctagttctagatacttgaggaattgccacaccgtcttccacaatggttgaactaatttgccctcccatcaacagtgtaaaagtgttcctatttctccacatcctctccagcatctgttgtttcctgacttttaatgattcccattctaactggcgtgagatggtatctcattgtggttttgatttgcatttctctgacgaccagtgatgatgagcattttttcatgtgcttgttggctgcatagatgtcttcttctgagaagtgtctgttcatatccattgcccactttttgatggggttgttctttttttcttataaatttgtttgagttctttgtagattctggatattagccctttgtcagatgggtagattgcaaaaattttctcccattctgtaggttgcctcttcactctgatcgtagtttcttttgctgtgcagaagctctttagtttaattagatcccatttgcctattttggcttttgttgccattgcttttggtgttttagtcatgaagtccttacacatgcctatggcctgaatggtattgcctaggttttcttctagggtttttatggttttaggtctaacatttaagtctttaatccatcttgaattaatttctatataagtgtaaggaagggatccagtttcagctttctacatatggctagccagttttcccagcaccatttattaaataggaaatcctttccccatttcttgtttttgtcaggtttgtcaaagatcagatggttgtagatgtgcggtgttatttctgagctctctgttctgttccattggtctatatctctattttggtaccagtacatgctgttttggttactatagccttgtagtatagtttgaagtcaggtagcatgatgcctccagctttgttcttttggcttaggattgtcttggcaatgcaggctcttttttggttccatatgaacttaaagtggttttttccaattccgtgaagaaagtcattggtagcttgatggggatggcattgaatctatacattaccttggacagtatggccattttcacgatattgattcttcctatccatgagcatggaaagttcttccatttgttgtgtcctcttttattttattgagcagtggtttgtagttctccttgaagaggttcttcacatcccttgtaagttggattcctaggtattttattctctttgtagcaattgtgaatgggagttcactcatgatttggctctctgtttgtctattattgttgtataagaatgcctgtgatttttgcacattgattttgtaccctgagactttgctgaagttgcttatcagcttaaggagattttgggctgagacaatggggttttctagatatacaatcatgtcatctgcaaacagggacaatttgacttcctcttttactgattgaataccctttatttctttctcttgcctgattgccctggccagaacttccaacactatgttgaataggagtggtgagagagggcatccttgtcttgtgccagttttcaaaggggatgcttccagtttttgcccattcagtatgatattggctgtgggtttttaataagtagctcttattattttgagatacgttccatcaattcctagttaattgagagtttttagcatgaagggctgttgaattttgtcgaaggccttttcgtcatctattcagataatcatgtggtttttgtcattggttctgtttatgtgatggattatgtttattgatttgcgttggggaagttctcctggataatatcctgaagagtgttttccaacttggttccattctccttgtcactttcaggtacaccaatcaaacatagatttggtcttttcacataatcccatatttcttggaggctttgttcgtttctttttactcttttttctctaagcttgttttctcactttatttcattaatttgatcttcagtaactgataccctttcttccacttgatcgaatcagctattgaagcttgtgcatgcgttacgaagttctcgtgccatggttttcatttccatcaggtcatttaaggtcttctctacactgtttattctagttagccattcgtctaaccttttttcaaggtttttagcttccttgtgatgggttcaaacattcttctttagcttggagaagtttgttgttaccgaccttctgaagcctacttctgtcaacttgtcaaagtcattctccatccagctttgttccattgctggcaaggagctacgatcctttggaggagaagaggcactctgatttttagaattttcagcttttctgctctggcttctccccatctttgtggttttatctacctttggtctttgatgtcagtgacctacagatggggttttggtgtagatgtcctttttattgatgttgatgctgtttctttctgtttgttagttttccttctaacagtcaggtccctcagctacaggtctgttggagtttgctggaggtcccctccagactctgtttgcctggatatcaccagtggaggctgcagaacagcaaatactgctgcctgatccttcctctggaagcttcgtcccagaggggcacccacctatatgaagtgtatgttggcccctactgggaggtgtctcccagttaggctacacgggggtcaggaacccacttgaggaggtaggctgtctgttcttagagctcaaatgccatgctgggagaaccactgctctcttcagagctgtcagacagggacgtttaagtctgcaggagttgtctgctgccttttgttcagctatgccctgcccacaaaggtggagtctagaggcagtaggccttgctgagctgtggtgagctctgcccagttcgagctttccggccactttgtttacctactgaggcctcagcaatggcgggtgcccctcccccagccaggctgctgcctcacagtttgatctcagactgctgcactagcagtgagcaaggctctgtgggcataggacccaccgagccaggcacgggagagaatctccttgtctaccagttgctaagaccttgagaaaagcgcagtatttgggcaggagtgtgccgtttttccaggtacagtctatcacagcttcccttgtttaggaaggaaatcccctgaccccttgcacttcccaagtgaggcatgccccaccctgcttcagctcaccctccgtgggctgcacccactgtccagctagtcccagtgagatgaaccaggtacctcagttggaaatgcagacatcacccatcttctgtgtcgatcacactgggagctgcatactggggctgttcctattcggccatcttggaacagagctctattttttttttttaaagttttctgtctttgttactactttcctgtcaaacttggctacattttggtctgtgtggaaaataatattatgaataaaagacagctaggctaaattgatttttaagagaatttaatgactcatttatagaatctgaatttttagactcagtgaaaaaatcatgcaaattctcatcagttgatgttctctgtttgaaatcaaatgtttctattatactcctaactcctagagacatttagagaaacttccttctaataataatacaataggcctattaatcagactatttctacatgatagaagagttacagactatttctacataatagaacatcttccaactgtcatctaaagtaatttgctattgttacttcatgtgaagttgaatgaatgatgaaaatacatacatatacttcacttcacattcaaagaatttataattataccactaccagataagaaatattaatattgtggtgcctattttatgtacaaaattgcgcttacaaaaattctgtaaatacatcatacaatacacatatatatttatgtatctatatttacatataatatctatatatgtacacattaatctgattatacttaatataacatagtagtttacaacatccttaactacaattggaaatatgatttctaaagctgattaccattctgatttataaaaacaccataattttaaatataagatgaattgtatcacccccaccaaaaaattatatgttgaaatcctaatcccagtacctcaaattgtgactttatttcgaaatagggctttggggatgtaactagttaagatgaagtcatactagggtagagtgggcccctaacccaatatgactggattcttcgtgaaaagaatgtcatgtgaagagacagacatgcattcacactgagagaacataagaagattagagttatgctgtcacaagccaagggactaccagaagcttggagagaggcctgagagaaatacttctgtagcaccttcagagggaatgtggccctgctgacactgatcttagatttctggtctctagaaatttgtgacaataaatttctgttgtttaggtcactctgtggtactttgttacagcagccatggcaaactaatatgtctctaattttttcacttttttgcttttgaaaatgacaataagatgaatgttactgtaccagaaaggttattcacctgtccaattattttattttacaaaataagctttattaaagtataattcacattgaaaaaagaaaaatgacttagagaagtctgagctatatgaggtatgcaaaatttatcaggcccaaaaagacatgattatgggacttcagtcatgcctgctgcactcgtgactgggatgggggaaattgtttaaaggtattttgttcctgactcacccattatctacctgttcctggaattggtgatagaaagaacatcgtagaaccaatcaatagctcatgctattttaatgtaaattcttggtaaacaacttaggaactgccttttcccttaaaagcccacttgtaagtactgccaatcagggcacatattcagggcaacttgaatctgtgcttccagtttgcagttctcaaacttggtcgaaataaactctctattcatattaatttttgcctcagttttttccctttgggttgatgtatctggtacagtcgacatgtttcaaagtgactctcccagatcatccagtgtttctgtctgaaaggggtgcttgatggcagcatgaagccattgccttctctctcttctagagtcccattagttgttgtgggtaagttttactgaaatatggactttatcccactctttgatggaaggtctacactttatttgggctgtttttacaaaccattcctttctagaatagagattttttaatgttttccctgtgggcagatttggattacagtaaaaaacaaaacaaaaactgcgttttctctgcctctgtctcacagcagttggttcatgtcaaagtttctctgcttttgcctcaggactggaggttggggtcaaggtcaggcaaagagctctccatagaaattttgcttttccacctgtctcacaacataaggtttggatgaagagattggcagtttggcaacaggggtcttgttttaaatagcatgctttaaaaattgcagctgcttgctttctactgcttaaaatttaggcttggctttttatttgtcatcaactaattaaataccagttggttttatgtacaacaattattgggtattctcttttaaatatctaggaaagaggactcacctaacctggtatggtcatatgcggaaatggccaaaatgggggcccttggcttgcttaaataatgtattaatgcacataactggaaaaagctacctttagaacaagaaaattgaatgggagaactacttcatgtttgttctggatgaaataagagatttgaaaataattgcttaagaactctattgtcataaattagcttaattaaaagcttatattcaaggccaggcacaccggctcacacctgtaatcccaacactgtggaggtcaaggtgggaggttcacctgagcccaggagtttgacctcagcctagacaacatagtgagaccctgtctccataaaaagattaaaaaaaacaacaacaacagaaactaatcaggcatgctggcaagcacatgtggtcccagttacttgggaggtcaaagcaggaggatcactttaacctgggagatcggggctgcaatgatttttaattacatcgctgcactccagcctgagcaacagagtgagacactgtctctaaaaaaagaaaaaaaattcggatattcaggctacaaattttttgggaaaataaaaagctgttctgcttttttctcttggatcatatttctgtgaaattttttcagtcaagtaagcttttaaaaaaatgtttcatacctctgtttgcttactgtcttgttggtataactgctgagaaaaatgtaaaacttccttggcctttcagaaagcataaaatctcctcaaattggcttctctatgtattcttttttttccacttatgcttttccattcctttgccatgtttgataacacatgaagaaatgcaaaggagacttcaagtgactcagactttatgtggagtacagaaaaaaatgccacttactcccttttgggggtcttctgttttccttgcagagttcagtcataggcaggttttttctccagtcaaaagctttgctctcttttgcatagagttacctgatgtcttttgctttcagggtgccagggactacattatactgtgagagagaatttgacttttgtgtgtgcagtggctaaaaagtcactggcaaaagttgcagtttcagaaattgctgacagcagttacagtgaatgggtatcactgcagaggaatacttgtttctttgtagatttccataagaaaggcacagtttgaagacttggaggctatggaaacactcaccaccaagaactaatactctggcaggagatgggttgatcacagagtgggttgattggtgttgggtcacctattagccttgcggaatgtctttgtagtaaggtgcactatggaagcattatatggcctattctcatggtgcttccctttttggggggacctggaattcagtgtaaaagtgagatccttgattttgtacagatctagatgccctgccttagaactgtgcctgcttttcatatgtttaaatcttaggccctgaaaactacaaatgctttctttgccctattctttaaagggctcaatgctgaggtcagtaatcaaatttagaaacaagctaagcagaaaagaccacttattaaactgaatccatctccaacctacaactttttgatatttagatggctgctttgaacttttttaaaagaaatttacatctataaaaaattctcattagtaagggcatctccctctttgcatcaaaactactagaaattttataatggggaaggcattgccttaaattgtacataaaataccttacctttgttcaagataattatcctaggaaacttgtcttgattgggtttttacctatgcccttctttgcttcagcaaataatagtgtttatatgtaagttctgtgctttggggatataaatttttacctgagtcatgcctttgaaagtgcaaatgtgggattgtctcactaacaattgtttactgcacttgaaccgctaatcaagggatcaatagtctaaaagtgggagaaaaggtatttgaaaattggaaaatgaagaatcttataaagctattaggcctctgcttctacctgtgtgtctgtctgtatgtatatctgtatgtttcatgtatatgtaatatttcactactaaaatatatgaaagtgctttgattgacttaaaaaagtaaccactgaaatcaaatattttatcagaaaatcagaaactaaaatatcttttagttcacatgacttaggtatgtctctaaccaataagactaatttaatattatcagtttgataaaaacaactgccttctgagtaatcaacaaaaaaaggcatgtatttaagttttatgtttttatgatacttgcctgacatagagtaatataaaaatggatagtggaaaacgtaacttgaaatgatagctacaattgtccagtgtctcctgaaattttccaaacataattgttaagaataaactaagtaaatgtaaatggaataaatattttaattataattttgcatcataacgtgtttgttagaggggtttgaaccagagtgactctgtcttgaatagggctgggtaaaataaacttgagacctactgggctgcattcccaggaggttaggcattcttagttacaggatgagataggaggttggaacaagatacaggtcacaaagaccttgctgataaaagagtgtgcagtaaagaagctggccaaaacccaccaaaaccaagatggtcacaaaagtgaactctggtcatcctcactgctcattatatgctaattttaatgtattagcatgctagaatgcactcccaccagcatcatgacagtttataaatgccatggcaatgtcaggacattaccttatatggtctaaaaatgggaggaaccctcagttcttggaattgcccacccctttcccggaaaacttatgaataatccaccccttgtttagtatataatcgagaagtaactataatatcaatcagatgagcaggtcatgctgctgctctgcctatggagtagccattcttttgttcctttactttcttaataaatttgctttcactttactgtatggactcgccccaaattctttcttccatgaggtctaagaaccctctcttggggtctggattgggatccctttctggtaacacgtttacttaaaaacgtttttcaaatccttttggtaatttttcctttagggattttgctaagctaaattaaattataaatgttcattgaatacctaaatcatttacagataagatgtaatactaagacattaatgactaattatgagttgaagcttatatatttttggctttttatttcagagaaacaaatatatttagacctttaaataaatatgttctattccacgttttaaaaattgttccattaggaagactatgtttctaaatattataaaatgtgtattcataaattgttagtatgcaactaatagttaaaaaattacttactagggttactacgggttaaaattctgagtaatatatgataatttaaactagacataagaaggaaaatgaggttgggcgtggtggctcacacctgtaaccccagcactttgagaggccaaggcgggcagatcatgaggtcaggagttcaagaccagcctggccaagatggtgaaacccccatctctactaaaaatgcaaaatttagaggggtatggtggcacgtgcctgtagtcccagctactggggaggccgaggcagaagcatagcttgaacccaggaggtagaggttgcagtgagctgagatcttgccactgtactccagcctgggtgacagagcgagactctgtcaaaaaaaaaaaaaaaaaaggagaaatgattctatatacagaatgtacaaggaaagggaaataagtttttggttatgaatgttataagaaagatatgagaatgtggtttttgttaaaggaaaagtaatgtataagttatttaaaagtttttttaagttgaatggataaaaaaggatacaatgagaaataaattgaaaggctatagagaagttgaaatgaaggagaatttaaaaaattgtaagaggttataaaagatttatgatgtcctgggaattgtctttgcctgctgcctcgtgaagtgtatcagaagtggctatgaggtgatgtaggggtctggtatcttcagcctcctcatctgggggagtgtagtagtctcctctaggtttttcaattaagtggattattttttcagacagaaaaaaatagatttaatgttaacaatacatgaatgaaaaggtaaactttagttttctcttttgaacaagattttcatatagtattaaaaagagataatacaatattttctttatcctttgagtaaactgcaaaataaaaaagaggagagagtttgccttatgctatctttactaagtttcttcattgtttgagaactgaatttcctctctatcaaaaagtaaaggtcttcgcttaatgaagtctaagaattattactttggctaagtgaattaccattattttacagtaatttgtgatcctattttgatatcaagtgttctaaagttaatatttgatgtttccaaatcaaatttcagattctaaaattaagtattttccaaaaggaacccctggaaattcaggaaaaatgtattaggcttatttggtatgttaaaattatatgagaagcattgtcaaacaagaaatggtatttaactttctttgagttgtatttgtataaatgtgttattaatacatgtttcaaaattctgtgatattccaaaattctgacatgtgtggtatatgttatcagtcataattatgattactatgttaaattgttgtatgccacagaaataagaaaatttccatgtcaattgtgtccttaaccagggctactctaaatcttttgctatccacagaaaatttttattttactatgattcttctcagaacacagtttacagtcagctagagtccaaaatttgctttttcttcaagaaaattaatagaaatgaccctgacaagtacaattcaatacaggtttctgataactttggaattcgtatcattagactaagtaaaatctttcagagcttcagtacaaaaatgatttgtccatgaagattgctaacccaacatcaagaagaccaataattaattacatgttagtgaactgatagaaaactgaaaggatttttatgacctttattgtgaaacaatgttgatttttaaaaatatttagttttctatggtcaagaaaacttttttcctttgagctatctgtagctaacggcaattgggtaaagtatacttttgtgagaaaaattcaaacattttcctttctctatacctgatttatccagaattcagaactactttttgttttatttttattttgctattttctggcaatgtagttatttgagtatgttcaataaaaatttgttttcttttgtaataggacatattggatacactgattattttatcaggcctttgactgaaatgtcatagtttaaaatgtaaccaaactgctttgaggaattgaggttgatttgataaagccaatagatgtggaaaaacaaaaaaacaaaacaaaacaaaaaactggcctcataccttgtctatttggttctcttacaaggttcctaaatttgtgtaagtaaagaatgtcactttctgacaggcccatgaaacccaaggtattttggggaccttgagaagagagggattcacccaatttgtacagatattatcagaacggtctaatggcaaaaacttggtttggcttcctacccataacatgtatttagaaagtctaattgagattccttatgaaaaagtttcatcaaagccaacttaaaagagcctacatcgccaatcactattcttgtttcacttatgcaaataatcaagccaagtataatactaaaacttattttcaaataaatttgtcttaatgagatttatcttcagtagaaatggagaattagagagcgaaaatatgtttcagaagaaaagtatagaattcttgttatcagattctagtcttgaaattatttttaagctattattttcctacaatttagatggaattctgaattatttcctggctacaagtatagaatgcttgttatcagattctagtcttgaaattatttttgttattattttcctacaatttagactgaattccgaattatttcctggctacaagtatctaaagaagaatatggattcatttttcttcattatgtttttagttgactccccaatggaacaggtatctttttaaaatttgttttggcatacaaattatttttttaatttatctcattgttttatgtcttccaagaaaagtaaacttgtggtatttcgaggaatagagatgatgattcaacaagcaaaagtagctctataaatcattgacttcaccgaagtattatttttgccactccatccccctgtgaagccatcccaattcagatttcagtgctcttaaaattcttgactgagacacatctccctcccacccactgacacagaacacgactattcaggaataagctttctgagcactaagggatgaaggctgtctatcactgtagcctcagcaaagataatcattaatgcttccatgggaagattattgatcaaaagagggtaaatgaaaaaaatgaaaatagctcagaaaagtttgagctatgtgaggtatgcaaaaattatcaggccgaaaaagacaaaactatgggatttcattcgcacttctgcccccatgttaggagcaatggtttaaaggctgtctctttcattatcttcatgtttctggaatttatgacactaagaataatgtatgtccgatcaatagattgctattttaatgtaaattcttggtaaacaacttaggaactgatctttttctttaaaaacccacttgtaactgctattaattagagtgtgtattgtagcacaacgtgaatacatgcacctgcgttgcacttctcaaacttgtttcaaataaactgtttacttacattaattttgcctcagttcttttcttttacgttgacaacatacaaaatatgcaccgattataagcatacagtttacagagctttggagcatttttatatacaatttgtctagcactctaatcaaaatgtaaaactttttcgttattccaaaaaatttacttatgctccatgaagtcaatcttctgacttcctgactgagagaagagctgctgtaattcctataattatagattaattttgctctttataaatacatgtataagtaaaattagatagcctctctatgtgtgcatgtgtgtgtgcgcgtgtgtgtgtgtgtgtgtgtgtggctgacttatttcaattaacatgtttttgaattcactcatattattgtgtgtatcagcagttcatcccttttttattgttgagtagttttccattatatgaatatagtatattctgtttaactggattgtttccagatttcgaatattaagaatagggtactaagaacattcatattcaagattttctctgtgcatatgctttcatttctcttgaataaatacctgtgagtaaaattattggctcatgcaatagtatatttttaacattataaaaacttgccaaaatgctatctaaagccattctgctattctcccttacctccagcaaagcatgatgagaattccagttgctccatatccttatcgacacggtcacctaggagatatgtacaggtattacatagtggttttaactggcatttccctcattgctaatgatattttattcacatgtgcttcctggccattcttatatattcttttttgaaagatatcttcaatttttttgctaatttatgattgttcattttttccctcaatattgaatttttaaatgaatgtatagatttattatgtatattacttttttttaaatttttatttatttatttttttattatactttaagttttatggtacatgtgcacattgtgcaggttagttacatatgtatacatgtgccatgctggtgcgctgcacccactaactcgtcatctagcattaggtatatccccagtgctatccctccccactccccccaccccaccacagtccccagagtgtgatattccccttcctgtgtccatgtgatctcattgttcaattcccacctatgagtgagaatatgccgtgtttggttttttgttcttgtgatagtttactgagaatgatgatttccaatttcatccatgtccctacaaaggacacgaactcatcattttttatggctgcatagtattccactagaactagaaataccatttgtatattactttaaaatataagatctaaatatttacatttatttttgagataccagtcccttttcaaatgtgtgctttgcaaatattttcccccaagctgcaatttgtctattaattttcttaactggtcaataaagaggacaggttttcaaatttgatgtagtttaatatttttaaattgtatggtttatgtttttatcttatataaaatatcttaaggtcgcaaagatgtttaaaaattaattacagtttttattttattataaaaatgctatagttttaacagttatgtttaaattggatccattattaataactatttttttaatgatgtaacgagttaagatgtttctctttccaagtgtccaactcctccaggagcatttgtgaaaaaatactcttttactcactaaagtagttggaaacctgcgaaattcagctgatcacatatgtgtggatacatttctggactatatatactgttgcattaaactatttgtcaatattgtgccaatattaccctgtcttgcttactaaaaatgtataatagttcaatcagatactacagatttttttcataatttttgactattctatatcttttgtaattccacatgattttagaacaaacttgtatattgttacaaaataacctgctgatattttgattgtgtttgtattacgtgtataaatgtatttgagtagcttgaaaatcttaaaagtattgagtctaagccgggcacggtggctcatgactgtaatcccagcactttgggaggctgaggcgggtggatcatctgaggtcaggagtttgagaccagcctggtcaacatggtaaaacctcgtctctactaaaaacacaaaaagtagccagacatgctggcacaggcctgtaatcccatctactcaggtggctgaggcacgagaattgcttgaacctggaaggcagaggttgcagtgagctgagattgcaccaatgcacttcaacctgggtgacagagcaagagtctgtctcaaaaaaaaaaaaaaaattgcgtctatccaatattgtaatatatctgttgcccatacttggctaaatttatccttttaaaaataactttattaaaatataattgacataaaaattgtatatatttagtgtataaaatgttatattttgatacatgtattcattataaaatgattcccacaatcaagctaattaacatagcaatcacttaacattgttaccttttctgtggtgagaacacttgatctctactctagtagcaaattttcagtaataataataataatagtaatacattattaagtagaatcaccatgttgtacattaggtctccagtacttatatatctcatgactgaagttttgtacctcttaacaaataactaagtggaaagtttgttcaacttaatttttcagtcagaattgtgtaagctgaactaagtgtttatggtgctggctattgtttctcctcttaatcataggtcctcttcagttagaacacaaacaagactattttttccttgcaaattgatgtggatggtgggctgctggggcatcattttcaatattttctcgtcccttcttaaaatgagttattcacttgtaaattgatgatgatttctttggagtactgttcccataaactttttataaggcattaataatttcaccattcttccgttcaagcttcaccataaatttgatgtttgttcttgcttcaatttcagcagcattcatgttgctctgatagggggtcttttcacactgatgaaatctttcttctcatctagagcctcagacaactagatcctgttcatacacgttataagaagttagtatgagtttattttggtgcaaaaatattttaaaatccatgcatagttttttcataatgtacattttccatgaactttttgaagacccagcatgtgggggtgtgtgggtagagggagggagggagagagagagagagagaatataagaaaaaataaagttttatactggagagaataaaataacaaaaattaaaaccacagtttgtattttatcagaagtggaaattaaataacaacagaaaggtatcataccaacagccaaaggaacaatctaaaatgacatctcaaaacttaccctttttaataattgagaaaactacattatcaccaactgttacagtcttagtgactcaactataacaaatgtgggaggggaggacatttcttagtctttagcatggctcgactaagagactaggctcctccaaacacctgcacatatggaggaagagacttcgcatatcatgtgtcatgtattcttggaatgaatttagatagttaccatgacaactgctagccaaggagaatatttagtagtatgggtatggacatcaccaaataccacaagaatgaggtcatgttggttatacagcctagtggaactaaagcaactggacttcatttatttccattgtgaagcccttatatcttggttttataataaatgtcgaaagcaaaaagacaagtggcagttactacacaaatgtctttgcagacaatcttacctcattctcccagttacagacaaacgtgtcaagtgtggctttgcataagtcagaatagttatgaaaaatacataacttaccagggcaaagtcatgttttatttttctcttcagaagtgtttgattccaccaatttgtaattttcttttttttaggcaggctttgagagatgtttcagtgttgttgccttgcttgataaaaattaaatggtaaaagtttattcagatacggatctggctgaagaacaaagaggggagaggaaatgtgtatgggcaatatgggtgatgttaaaagcccttgagtctcatttcagaggtaagaatccatacaaaaattataactaataataataaagcctaaacgctgtatatagaattacaagtcatggtgaatcattgtcattttactccaagaatgctattgttattgagattttaaatatctaaatgcctttctgtagggtccagccctacagggcctgtgggtttttctcttcgtgtgcggagacgagagatcgtagaaataaagacacaagacagagatagaagaaaagacagctgggaccaagggaccactaccaccaaggcatggagaccggtagtggccccgaatgcctgaccatgctgttatttattgtatacaaggcaagggggtaggctaaggagtgtgagtcatctccattgataggtaaggtcacgcaagtcatgtgtccaccagacagggggcccttccctatttggtagccgaggcagagagagagaggggacagcttacatcattatttcttctatgtattcctcagagagatcaaagactttaatactttcattaattttgctactgctatctagaaggtggagccaggtgtacagggcggaacatgaaagtggaccaggagtgtgaccattgaagcacagcatcacagggacatgtttaggcctctggatggctgcgtgcgggcctgactgatgtcaggccttccacaagaggtggtggagcagagtcttctctaactccctgggcgaaagggaggctccctttcccagtctgctaagtaacgggtgccttcccaggcactggcgctaccactagaccaaggaaccctctagcggccctgtccgggcgtgacaaagggctcacactcttgtcttctggtcacttctcaccgtgtcccttcagctcctgtctctgtatggcctggtttttcctaggttataattgtagaacaaagattattataatattggaataaagagtaatgctacaaactaatgattaataatattcatatatcatcatatctataatctatttctagtataactattcttattgtatatattttctttattatactggaacaccttgtgccttcagtctcttacctcggcacctgggtggcttgctgcccacacctttccattataaggtccatgttagattttaggaccctgaaaccattttatgataatgggagcctctctctctctttatgtgtgtgtgtatatatatgcgtgtgtgtgtgtgtgtgtgtgtgagagagagagagagagagagagacagagagagagaggggtaatttttcagtaaaaatttttataacctcttctgagttgctcttggttagtacctagtatcagctggatgggataataactagggatgccctttgatggatggattccacataagctacagcaatccccatctcccctacttcatgtaccagccacccccactttactatggaatgctagggtattacatagtcgtctgagatataagtgaggatccgttgctacagatctgaagaaacctaaattcttgcctcctcagaagaaagaattcgactgaggagcacaaggcagaagaagaaaccaaggtaagtttcagagcaggagtggaagtttatgaaaaagctttagaataggaaagaaagggaagggaagggaaaggaagggaaaggaagggaagggaagggaagggaagagaagggaagggaagagaggggaagggaggggaagggaggggaagggaggggaagggaggggaagggaggggaagggaggggaagggaggggaaggggcagattggaagagggccgcgcgggcgacttgagaaatcaagtgcgcagcttggcctcttcacttggggttttgtacattggcatacgtttgggatctagaatttctccttcaatacatctagaactgagcttcttctctgacataaacaaaacacattaatgtcttatgtatcattaaattagttatgtgaataagacagctgcagttacatacccagtctgtgagttacaaattctattgttttttcctgctatgaattatacattttaagtagctctgtgcgatgaaattcagtggaaattacaggaagtgatatctggttacaattggttgattatgaaagcaccaggacctcctgttgcttgagagctatctaaattatctaatagccctggtgaagtgacaacatccatggcactctggccaagtcatgattacatcattctgattcctcattgtttgcttctgctggatttgaaaggctagagtgactttaaatatctctatctctaatatctgactgcacattacatctacataaaatattttagtctgacctaccaggcacttaatgatttgccatcagcttccccatcacagtaatcaacatcatcatcatcatcatcatcgtcactcccatgatcctcctcttcatcatcattgctaatttttatttagcatgtctaccagacacctttacaaaatataattaatcatcataacaaccctacaagataagctatattattgtcctaattttaccaataggggcttagtgacattaacttaaaaatcttccccctctaaccctacagacagtgtgtagaggagttgagatgcaaacccaggtcagtcagctttgaaacctagaggtcttactaaaaatgcattaaaacacacaaataagttttataagacatttatacatctagccaaccttcaagcaataggaactaataggggtcatagaaaattaatcttaaaaaatgtaaacttttcttttttccaagatggcagatgggagactgtgttagcacacctctcccacttggaaaggcaaaattgtgtatagatattcacactgtgaattttttccaagaagcaatgcaggcacttaataggaaaactgaagtacacacattctttgaaagaactggcaggctgcagtctatgccatgagccagacgaaagtgtaagatgaggggagactgcctcaaggatatacttcccaaccagggaaactggaaatacaaaccacaggggaaggccttaaccctacccagtgctggaactgatttagggagcagtgatgaatataaatgtaggaacagcagcaggaagagccttgggcgcattcccagtctccagtgcagatcgagggaggccctccgttattctgcctcacaggggatattgcagaagtctgcaaactaactcaggcaatggttgcaggttgagaaaagctcccaactgaatttcatgatataacctcaagtgagaaagaactcccttggccagatttgggggtgagtggaaagtgtgctgcagccacaagcactgggagctgggcatcccggttgtatgggcggcctgggaggggcaggtgttgaaagccaaggttcatgtcttcgtgggtaagacttatgacctggggcagttttgagttctgagcatagatagcctgaaacttagcttgctgctgctagtgaaaaactgtggatgtgagatctgtcttgccaagggtgtgggagcagagcggggcttactgcaggctgttactccccactccctgcacaaacacttctgtgcagcaaaggcagatatactcctttctggaacattatcccagtggtcagaaaaccacccccaactcccacaagggctactgcttgccctgcatgcagagtcagagcacagacctgccagaaacagcacccacctggctctgccccacaacccaccctggtacttaaaaacaaagaacagaaacttttgggagctctatggccctgctcattgcctaagaaaccagagtactgtccctgggtaacataagagaagcacaaatccgcacactactactgcagctggtgcgcttttgcaaatgccatctcctggctggaagccaacaaatacagtccatcacagcatctccatgtataataacactgcacccagaaagaagaaaacttgcatgtgacctcagcttataaacattgtgtgcatcaccctggctaaggaggaggtgctgagtctgtccacatgacctgtttattactactataactgacatttgagaaagccgacacactaacattatctataaccaaggaatttcacagagtcttaatcatgcccttaccacccccatcagagctggtgctggtactcactgctgggagacatgaggacaggtcacatttctgaatctgctacagacattccacagtgccaagctggagcatggcagccacactgggtagctagacccaaattagcaacagcattcacagtagtctggttatcagggacttctactcctggaggaatagggagtgcaccatctcaagggaacaccccgtgggacaaaagaacctggatgacaaaccttaagtctcagatatttctgctgttgggaagtgtctttcagcagcagcacagttgcagtgctgggctcagcagggaaagtctgtagctctctcccaacagtcaggcaactctagtgcttgtgaagggtcttggagaagaggacttcttttccctctcatccaccagcacagacaaagttggggcttttcccatgggagcttggcatgggtgcacctataaacagcctctctggaacacttcagggtgactgcatccccacagaaggagcaccctgcaggtgcaggcttgcacgagggctagagtcacgattcctctatacttggaatataaccattcctggagatgaaaagaggagccagtctgatctgaatagatgcaacactgggtcatgagtatgtctgggaggtggacagctttcctgctggcctggcaagggagctgaggtagctcaaattcttctctctgataagacctcaatgctttcactaagagctccttcagccacctctgtcaaggctgggacttctgcccaccattgggtattacatttacccacctgctttactgtcagcaatttttacctgtggacacctcccctattgtcctgaagcctgaactattcaactcagtaaataaaataccgaggaaaaataaataaataaaaaagtgcacaccacaggggaatgagataagtttcaagagacttctgtcattccaaccctatagaagacagtgaatttgctcacatgaagcacattaacactagaatcagcatctgagaaagccatcatacaaagactctctagaaccaaggaacacatacaagtcttcatcctgaaaacaccaagagctgaattaggctataataaactataatcattaagtcacatcccctaagggggaaaaagaaataaaagaaaacacagtcaaaccaaagataaatgcaaaaacaattcaaaaaaatagtttacccaaataagaagaaaccagaaaaataattctggtaatatgacaaaaaaaattctatagcaaccccaaaagatcacactagctctcaagcaatggatccacaccaagatgaaatctttgaaataccagataaagtattcaaaaggttgattattaagctactcaatgagataccaggggaagggggaaaataacataaaaacattaaaaaaatacgggatatgagtgaaaacatttctgaagagatggacatcttaaagaaaagccaatcagaacttctggaaatgaaagacacatttaaggaattacaatatgcagttgaaactttaaagaatggaatagaacaagtagaatacagaatttcagagcttgaagacaaggcttttgaattaacccaatcagacataaataaagaagaaacaatcaaaggaaatgaactatgtctccaagaactataggattatgtaaaatggccaaatctaagaagaaatggtgttcctgatggagaagagaaagcaaaaagctcagaaaatttatttgtggaaataattgagaaaaatttccctggccttgctagagatttagatatccaaatacaaaagctcaaagaactacaaggagattcactggaaaaaggtcgtcaccaaggcatacagtcatcaggctacctaaagtcaacgcaaagaaaagaatcctaagagcagtacgacaaaagcatcaggcaacctataaaagaaaacctaccagagtaatagcagacttctcagcaaaaaaacctcacatgccagaagggaatggggtcctatctttagcctccttaaacagaataaccctcagccaaaaatgttgtaaccagaaaaactaagtttcttttaattttttttttgacatggagtctcactcaggctggagtgcagtggcgcaatcttgactcactgcacccgccacctcccaggttcaagcgattctcatgcctcagcctcctgagtagctgggaccacaggtgcataccaacacacccagctaatttttgtgtttttagtagagacagggtttcactatgttggtcaggccggtctcaaactcctgacctcaagtgatctacctgccttggcctcccaaagtgctgggattacaggcatgagccactgtgcccagtgaaaaactaagttttataattgaaggagaaaaaaagttattttcagacaaacaaaagctgagggaatttgttaccatcagacaaatgctacaaaaaaatgctaaaaggagttctaaatcttaaaacaaaagctcaatgtgcaccaaaatgaacctcttaaaagcataaaattcacagggactataaaacaataacagaatgaaaaaaataacaaagtatctaggtaacaattaacatgataaatggaacagtactttatatctcaatattaacattcaacataaatgtcccaaatactccacttaaaaattgcagattgtcagaatggattacaaaaaaagaaaagtcacaaaccagacatctgctgccttcaagatactcatctaacatgtaaggattcatataaacttaaggtaaaagggggaattcaacctgcatgccttttacttacctatcctcaggctagttccttgagtggacaaatgcaaggcccttcctgccctttcatcttaagaattcagtgatggaccccattcacttggcttactctcagggctgcttcctgagtataaacatggcaggcctcttcttgtgcttaatcttcgaaatcctgcatttaaatatagcaccaactgataatctcatcctgaaaatgtaaggtgtgaatctcccttgcttggttatgtattcacctagttctttctttgccccagaatacttccaaagtgcaatataggatgtctagaggtcaatatctagatcccaattcctagtactacccaacatacaatgtctgtaaatgtcaacaatcctcagagctcagagacaaggaacaatgcatcataataaaacagtgtcactgtgtcagctcttgagcatctgtggttttgcgagcagcatggttttgtgctatggggatagagatcttcatgctcaaaagtcaaagatttacaacctgatccagcttgcagaatgtgcaacctagaacatgagcatcagagttgaaaaacccactttaagtcaggttattccttaggcacactaagaacagatagaatatcctatgatgctgtggaaaaaaaaacacaagaagaaaaatcagggacaagggaaagcaggataaacaaatgaaaagtcatttgactatattttccccaggagaccattggctcatcactgtgctactgttttgtcctggcagccttgtgaaacaatcaaaagaagaatgactgacctgaaataatacctccaacacacagggtacaaacaatgcaatttgtaaactcaagcattcttgattcagggtatttttttttgcatttttttctcttacacaacagttatttttggagcaaatagatagcttgttttgacaggaaatgggatcattactttgccagctgatggtagtgttcaaggtcaatttctttctgagtgaaggaaagtgagtccctgcagatgtccatgtgctgcttcagaggactcataagttatggtgaaatcccaatcctgccaagcagacatgcaaactgtagaagtgcacatctacatcaccctggcactacaatatgggtatgctttttgataatacattttgttctctccataacaggcagcaacataagtttcctcattctaactgtaacagaaaaaaagcctacttcacatgctaggggtgtaaatatggtaacagtagtttcaataatcaattcagcatttctatgaattcccctatcagtactgcaagactatccagccctcccctcataggcacatcaccaggatcatcccactcctggtatttggatggagaatatttactggaatattgtatgctgtggaaattacttcagtctagagctgaaacaccactagaaggtgagtgattctgcaaccaccactcgctgtgaagccagagaccaatgtctgtgcctagcaatctagggagacaattcccaaatcttcattgccctgccaaggtcattcaggtaagcagaacccaccagttttgactaatgctattgcaaccttatggtgtcactgttaaaaacaaagtggttttggccgggcgcgttggctcatgcctgtaatcccagcactttgggaggccgaggcaggcagatcaggaggttaggagatcaagaccatcctggctaacacggtgaaaacccatctctaataaaaatacaaaaagttagccgggcgaggtggcaggcgcctgtagttccagctactcaggaggttgaggcaggagaatggcgtgaacccaggaggcagagcttgcagtgagccgagatcgcgccactgcactcctgcctgggcaacagagcgagactccgtctcagaacaaacaaacaaacaaacaaaaaacaaaaaacaaaataaaacagaaaaacagtggtttcaatagccacatatcatttctgtaatacagtaatacctctcctggtcgagttgtggctgctcaggttttatgattttgtttttgctttttttggttcctattgttgtggtggtgattttggaggtaagaggtggggagggaatgggagaatgtggagataaaatgatctattttctcccactgttacagtgagctgtgactactgcataccatcatagcctcccaacattataacccgtcattttactattaatatacagatgctcctttacttaccatgtggttacctcccaataaactcatcccaagtggaaaatatggtaagttgaaaattgaatatacctaacctaccatacatcacagttatcgtagcttagcctagcctgacctaaatgtgctcacttacattagcctatagttggacaaaatcatctggcaacacagtacactgtagcgtatcagtttttgattgtgtggctggctgggagccacagcttgctgctgctgctcaaccctatgagcaggtgtcataccacatattgttaatctaagaaaacatcaaaattcaatttcaaagtactgaatgtgtatcacttttcaccatcatgaagtcaaaatataagtggaaccaggctgggcgtggtggctcatgcctgtaatcccagcactttgggaggccaaggtgggtggatcacgaggtcaggagatcgagatcatactggctaacacgatgaaaccccatctctactaaaaatacaaacaattagccaagcgtggtggcgggcgcctgtagtcccagctacttgggaggctgaggcaggagaatggcaggaacctgggaggcggagcttgcagtgagcagagatcgcaccactgcactctagcctgggcgacagaccgagactccatctcaaaataagtaaataaataaatgaataaatggaaccattacaagctggggtttgtctgtatagccattaatccctaaaccatagcctggtacttgagttatttagccacaggaagttttcaggttcaacctactttccttagcactccatgcatcacagacactggttttctatttagcaaacccatttccttttcttttatttctttttgagacagagtctcactcttatatgaggctggcatgaggtggcacagtcacagatcactgtaacgttgaccacctgggctcaagtgattctcccacctcagcttcccaagtagctgctacaacagacacacaccaccatgcttggctaatttgtttattatttgtagagacaagatcttgctctgctgcccaaaatggtcccaaacttctgggctccagcgacacttctatccctgccttccaaattgctgggatcacaggagtgagccactgtacatgcctccttttcttatggacacctttcctgaccctcattgcagcagatgaggacacgtagatagaagtgatacaaaccacttccagatctaacccatcaataaatctcttgaactatcatttgtgacacagaatactgtgcaccagtaccagtcctcgagaggggaacgctatacataagttaccaatgccagggaaggactttaaatgcctcatcaatttctgcaccagttcctagatctggcaggaagctttgcacaaactcagctagcagaggttttgcacaaacctggctgtcagagtatgagtctagcgagacacatcacttgcatgaatcagagaaagcaaatttattatacacaaatgggcagcaagaataaacagaggcctaggatccacagtgagccagttccccaaggctcaggaaagcttcccagggcaaatgaagtttttctgtgggtactccactttatgtcacagctgagggaccccaaaaagcactccactctgggttttataccccaaagataacttggcttgttgagatcaagtgttgcaggtagtcctgttctaggagaaatgaggaaaaagcctgggttgttcccatttctccttatcttaggatgctgcattctaggtacatttgatctgagaactgcaagcgatagtggggagagctgtatcagtcaaggttattcagggccctgtgctcttgaattctccactttctttcttttttttttttttttttggtacttggaagatgaaaacctagcaggagaccttgaggctctacaagttagcagtgctataagaaggaaaagtctgggtcctgtatctctccatgcaagatcatccaccaaacacacacacaacaatttcatgagccagtactagatttgtgtcatattaagcaactaagatttaggggtcggtagttaggcagttaaccttcctggaatgatacatcctattagtttaaggcctgatttaggccttaattgccttaattatcactccaaattccttcctactgctctctgaaccagttcatttataaaagattttcaagaatgtggaaccttgagagggacagaagtcagacactatatatatatcttttctcaggagaatatttggcccctttgccaatttgactgctatgtctttcctaacaaactcactctttcttcaaaacctgtgggagcttgaattcatacaacctctgaagctgaacacatcatcaattacttggcagaagtaaaggaaattctatccgaaagattgtactttaaattccaaaaattactccacttaaagctctgtaatataagatattacagtaacacacacatatacagagaaacaaagtataaataaatgtcaacaaaaatattaaactatgatatcaacttcgcaaagaatattggcattatcagacacgtgtctaatgttttttttcttttttgagacggagtcttgctctgtcgcccaggctggagtgcagtggcgcgatcttggctcactgcaagctccgcctcccgggttcataccattctcctgcctcaccctcccgagtagctgggaccacaggtgccggccaccacgcctggctaattttttgtatttttagtagagacggggtttcaccgtgttagccaggatggtctcgatctcctgaccccgtgatccacccgcttcggcctcccaaagtgctgggattacaggcgtgagccaccgcgcccggcccgtgtctaatatttttaaataaataaaagtaccaaaagtatgccaatgataaattacattagttttcagcaaatatttatctctcaccccatcttcttgagaggagtgtgtctatttatctccatcccattaattctggacttgacgatgtgagttgctttggcaatacaaagtggattgaagtgacagtgtgccagtttcaaacctaggtcaggaggcattgtgtgtttacacccaccctttgcgggcaatttgtatttctgccataatgagaatatgccctaggtagctagggcccctttagtctgtgtcccagaatgaggcacatgggaagagatgaatttgacttgcaacgtgaagcagagcttcctctagccacacaaaggcatcatattggctagcaattgtattgttcacctcaatgctctttaaatgtgttatatgctatacatgctattttatatgtataatgggtgatgatggttatgatgatgaggatgataaaagcaaatatcctcatttttgttaacagctaaattatctatatgccttccttagggcatagaatgggaaacattttaggatgattgtcttaagaaattagtctatcagtgtcaaaagctgtgtaatcaaaaagggtgagagaaatcctttatttctgtgtgttagtgtccaaggaaaggatgaaagttactatgattatatcagcacaagctctgaatttaggagtgaaaatcccctattccttagataggactattttagctagtatgattttggagtgtacagttgaaaatcaatgtaaataaagagatttgtggcactcctgcattagtgttctgagaatgaaaaagtaagtatacttccaatgcttgcttaagataaatagaatttgtgtaaacatgtgtattcctaagtataggttagtgtatatctggacttttgttgtctctgagctaagctactgtaatatagctgaaaatgcttactatttcctcccttaaacagtttcagctgagtctggttagaaactgcagaatcagggctacagtctaaaaaaagaattcttctggaacactttcagtaaaaggaggacatttgatgacccaatttttgcctacactgcatttctgagtagtggcttttccctgaaagtgaaaggcagccaaactctaattgcactgtgccattcacactggaggccattgagtggctggttcttatttcttcctatgccagtcctgtgactctaatcttaaaaagtttgtcttcctctattctaaaaaccgattttcttaactcaataaagagataatcatgattctaagactgatttggaatatctaggaaataaatgacaaaagtggatttattctataagattctgaccacacaatgcatgtcgtatatttaattctgtacttggcatcaatatgtttacagatacttaactttgcagtaacaaaacttaatgaagactgtgtgataataactaatgtataggataattctcaaatcagtaggaaagactattattgactcccattgattaacacatggtgtggccttggagacataattatttgttatatatatgtatgctttagcaccaattcgaatataattataaacatagatcaatatattttttcactgacatttcaaatcgtatctgtagtactagtttacatcagctctcactgattttgaaatagaaactaatttggaaatatttgcctttcttacactaagtaggtttgaagagactaacaaatattaaacagggtaagtagggtaaagaaagggtctgagatcaagtagtagaagttaacacaaaagataagaagtcaatcacatgggcaggtcccgatattgtggaatttgaagtttatacaatttgagtgtgtccctttaaggaaaataatacaagattatgaaaatataggaaattgaatatatatttaaaataagaaaataaataacaacacttttgcatactcttggaaatccagattcctttctcccagaaacttcaggaaatttgccaacgatgcttataagacaggtttcatcttggcaaatttacttcgtctctctacctagaacactctacaactcccagaaaattccaatgtactcaagggtccatgcaattgaagggtgctgatgatgctgaagcataatttacttccttgggaatccacctctggtcagtagaatgtctaaatgcattttgtttcccaaatgttgcctcttagggatatgagaaaaaagttacattgcatcgttttgtaacagttgctctataactaaaactgacagtatctgtattgtgtctatattcaattctaacttaaaagacacataacccgtaaacttattacagtgccaagcaataaaaagcaaaattcatttacacttatttgtctcaaaaattcttgtcaagaaagcttggttattaaaaatttcaaaaggatttgatgaccactctgactctttcatagtaatcatcatagacctcgagactgtctgtcacatattttcactgttattatgagctgtgtgtgtgtgtgtgtgtgtgtgcatttgcataagtgtgtacaactcctgccaaggactctgatttttatacccttaagattatcacaaattatgtgttagtgttttcacaatctcagaaatgtggtatatttggtaataataaggacagcagacagtgacactgtggtaattgaatgccaactcgtattctttagttgtatttacttatttgatgtttacaatgaacccatgaggaaaattttattattatactcatatatattgcattaggccgttcttgcattgctacgaagaaatacctgagactgggtaatttactttaaaaagaaaagtttaattggctcatggttctgcaggctgtacaggaaacatagcaacatagcagcatctacttttggggaggtcccaggaaacttccaatcatggcagaaagctaagaggaagcaggcatgtcacctggtgaaagtagaagcaagagagcaatgggagacctgctacacacttttaaacaaccagatctcatgagaacttactcattatcatgaggatagtaccaagtggatagtgctaaaccattcatgagaaatccgccctcatgatccaatcacctcccaccagaccccacctccaacactgaatattacatttcaatatgagatttgggcggtgacacacatccaaactatatcattacactgctgtaacctccaaaatctcatgtccttctcacattttaaaatactattatgccttcacaagaatctcccaaagctttaaattattccaatgttaactcaaaagtccacagtttgaagtctcatttgagacaaggcaagacatttctacctacgagtctgtaaaatcaaaaataagttagttacttccaaggtacaatgaaggtacaagcattggataaacactctcattccaaaaggaagaaatcgcacaaaagaaaggggcttgtattagtctgttctcacactgctaataaagacataccagagactgggtaatttgtaaaggaaagagcactcacaatttcacatggctggggaggcctcacaatcatggcagaagacaaaggaagagcaaagggacgtcttacatggtggtgggcaaagagagcttgtgcaggggaactcctatttataaaaacatcagatctcgtgagacttattcactaccaggagaatagtatgagggaaaccacccctatgattcaattatctccacctagccccaccttggacctatggggattattacaattcaaggtgagagttgggtgggtacacagccaaaccaaatcaggctacaggcctcaggcaagtactaaacctaacagggtagtcattaaatttttttttttaattttttttagacggagagtcactcttgttgctcaggcaatggcatgatctcagctcaacacaacctccacctttggggttcaagcaattctccttcctcatcctctctgggattataggcatgtgccaccacgccagctacttttgtattttttaagtagagacagggtttcttcatgttggtcaggctggtctcgaactcccaacctcaggtgatctgcctgccttgacctcccaaagtactgggattacaagcatgaaccactgtgcctggctgtcattaaatcttaaagctccaaaataatctcctttgactccatatctcacatccagggcacattgatgcaatgggtggactctgaaggccttggacagctctgcccttgtggctttacagggttcagttccagatgctgtactcaggttgttgagtgcctgtggcttttctaagttgaaaatacaggctgttggtaggtctaccattctggggtctggaggatagtggacctcttttcacatctccactaggcagtgcccctgtggagactttgtgcaggggttttgaccccatgattcctctctgtactgtcctagtataggttctttgtgagggttcttcccctgcaggaggcttctgtctggacacccaggatttttcatacatcctctgaaatctatgaggaagctcccaagcctcattcactcttgcactctgtgcacatgcaggcataacaccacatggaagccaccaaagattatggcttgcaatctctgaagatcctgcccaagcagtgcctggattccttggtgatacagctggaactggagtgggtaggatgcagagaaccatgtcccaaggctgcacagggcagtggggacctgggcctgacaaacaaaacaattctgttcccctaggcctctggacctgtgatgggaggagctgcctcttatgtctctgatacatattcaagggcttttccccattgtgttggctattagcactttcctccattttagttatgcaaatttctctagcaagtggttgctcagtggtccacttgaattctttttctgaaaatgggcttttcttttctaccacacagccagggtgcaaatattccaaacttttatgctctgcttcccctttaaatataatttccagctttaagtcatttatttgcaccgacatctgaacataggctgtcagaggcagccagattacatcttgaacattttgctgtttagaactttcttatgccagattccctaaattatgattctcaagttcaaagtttttagttccccaaagcatgggtacaatgtagctaagttctttgctaatgaataacatgtgtgacctttgctctagttcccaataagttgctcatttccatctgagacctcctcagtctggacttcattgtccatatcagtatcagcattttgatcacaaccatttaactaatctctaagaaactccaaactttctttcatcctactgtcttttactgagctctctaaattatttcagcctatgctgttacccagttccacattttcaggtatctttataatgatgtcacactcctggtactaattttctatattaggtcattcctgcactgctatgaaaaaatacctgagactgggtaacttatattttttaaagttttaattggctcatggttttctgggctctatgggaagagtagcagcatctgcttctggggaggcctcaggaggctttcaaccatggcaaaaggaaagggggagtagacatgtcacatgaaaaaatcaggagcaagaaagtgaggagacacttccaaacttattctacaaggccagtattacactgataccaaaactggacacacaaaaataaaagaaaagaaaggaaaagaaaagaaagaaaaagaaaagaaaactagaagccaataacacatagaaatatttatgcaaaaatactcaacaaaatactggcacaccaaattcaacaatacattggaaagatcattcatcatgaccaagtaggatgtatcccagagcatttgataaaattcaatatcgctgcatgataagaaccttcaaaaaatggggatagaaggaacacacctcaatataataaaagccatatacatcagacccacagatagtatcatagagaatagagaaaaaccgaaagcctttcctctaatatctggaacacaacaaggatgcccactgttaccactgttattcaacatagtacctgaagtcctagctagagcagtcagacaagagaaggatatacagggcatccaaactggaaaggaagaagtcaaattatccttgtttacagatgatacaaagctatatttgaaaaaaaaactaaagactccacaagaatattataagaactgataaacaaacatagtaaagttgcaggatacacaatcaacatacaaacatcattagcatttctaaatgccatcagtgaacaatataagaaataaatttaaaaagtcacatcatttacagtagtcagacataaaattaaataactaggaattttaaaaaaagaactgaatgatctgtataataaaaactataaagcactgctgaaagaaattgaagaggacaccatgaaatggaaaaatattccatgtgcatggattgaaagaatcaatattattaaaatgcccatactatccaaagcaatctacagattcaatgcaatatctatcaaaataccaatgacattctccacagaaatagaaaacagaatcttaaaatttatatggaaccggaaaagacacagactagtcaaaggaaagtatacttagtacacaaagtatacaaactatacaaagcttatgctaagcaaaaataatgaaactggaggaattacattaactaacttcaaattatactatagagatatagtaaccaaaacagcatggtactggcataatacagagacatagatcaatggagcagaatagaaaatccagaaacaaatccacacaccttcagtgaactcatttttgacaaacctactatggacatgcaccggggaacatacagtctcttcaataaatggtgctgggaaaactggatatctatatgcagaagaatgaaactaggcctctatctctcaccatgtacaaaattcaaatcaaaatgtattaaagacttaaatctatgacctcaaactatgaaacaactatgagaaaacatcagggaaatctccagaacattggtctgggaaaaaaaattcttgagcaatatcccagaagcacaggcaaccaaaacaaatatggacaaatggaatcacatcaagctaaaaaacttctgcaaagcaaaggatacaatcaagaaagtgaagagataacccacagaatgagagaaaatatttgcaaactacacatctgacaagggattaataaccagaatatattaggagcttaaacaactctacaggaataaaatgtaataacctaataaaaatgggcaaaaaatttgaatagacatttgtcaaaagaagacatataaatggcaaacagacatacaaaaaagtgctcaaaaattgatcatcaaagaaatgcaaatcaaacctacaatgagatatcatctcactgcagtcaaaatggcttatacccaaaaggtaggcaattacaattgctagcaaagatgtgaagaaaaggatacctttgtacactgttggtgggaatataaattagtacagtctctgcagtgaacagtttggaggttcctcaaaaaagtagaaattgattttacatatgattcagcaatctcactgctgggtatgtaccccaaagaaaggaagtcattatatcaaagagttatctatgttttttgcagccctgtttacaatagctatgatttggaagcaatctaaatgtccaccaagaggtggatggataaaaaaaagtggcaaatatacacaatggagtactacttagcgataactaaagaatgagatccagtcattttcagcaacataaatgggactggcaatcattgcattaagtaaaataagccaggcacagaaagacaaatatcccacgttctcactcatttgtggtatctaataatcaagacagttgaactcattgacatagagagtaaaaggatggttaccagaggatggtaagggtagtgaggagttgtgtagtgaagtgtgaatggttaatgggtccaaaaataattttaaataatgaataatatctactatttgatagcacaacagagtgactatggtgaataaaaacttaactgtacattttaaaataacttagagtataattgaattgtttgaaacgcaaaggataaatgcttgagggaaagaatacctcattctccatgatgtgcttatttcacattgcatgcctatatcaaaacatctcatataccccataaatatatatacctactatgtacccatgaaaattaaacattaaaatttaccagaaatttgtattcaagagtagttatcagagtattttccatgaatctccttgaagaaaaagcaattttggactccagttgaatgcaaatacttttacattataattaatgtaaaacaataactgtctatggaggacaatgtccttaaaatggccacagtaaaaatataatgtgaattcattataatgatgatgtaaaggaaaagaaaatttccttagttttgtggcataaaacattttaacataataaccaaaagtatcattttttaaactgatagatttctaggaattattaaatatcatttaatcactattataatgattatacattatttaattatattgatacattagatttctaggaatcttatgaaatttgggggaaactcatatcaataatatagtcataaatataacttaagttttagcatttcttatttgacaatgcttctcatcgaaaaaccaggatccaatagatacaacagagagaatagggagaatagaaaagccccacagaaagccaggaagaaggaccagtgagtcagggaataatccccactcaggaaaagagccagaaagaagagactaccagtccaaagagtcagggaataatgtcaacacagaacaagggcccaggtagaaaaccttccagcccaggacatgtttttccacggaatcctaggactctaaccaagtttcagagagcgcacacttaccttaagaatcaaaatgtgactttgccagcttcaactggcattgttctggaacagtggttcagaagactgtctcaccaattgatctccaatcaatcagaagtgtgtgtggcaccaaccaccgaagcgggcagcacttatgcccaggagtggatgtggagagggagttatctcctgcattcccatacactgttgcaggtacagcagtggttcttcccactgggggacagacaactagtgtaactaaaaaaaaagtgtttttcatgccacttgcagtgactccacctcaaccgaatgtgaatgtgtgcccactcaggctttcatgaagggtgaggcccagctccccatccctacacaaaatgacagtgccccagcaacaggggacataccacagagttgcctgccctggcctgggaaaaaatggctgcgctccaagccctattttagtggtagccatcagaaaagcttaccagtagcccacagcctcactgaggctgggaagcaaatgatgaagtctttataaactgaaggtcatgagccctgaaacaggggcacagtaaggaagtggataatattcctgctggttcagaatgaggagccagtgcacctcttcccaagacgtcagtgcagctcatcacaatctcttcctgcaacccacatcagggcaggtgcgtccactaatcaccagcctacctgtgggctattatctttaatcaacatatacttgactgcagcctgaaaagcaccaccaaataaaaaaccttcaacctgaagggcttaatgctagtccacaatataaaactcctgagtcttccacaccgtcaacccttccagagatagcgtgttggcccttatgttcaatacactgctacagtaagcagcagaaagccatcacacaaaaggtatccacaactagggaactcatacaaagcattggaccatggaaagcaccctgaaattgcgctaaacaatcataaacaacatacacctagtcatatttttaagggaaaaagaataaaataattttaaaagccccatctgaatgatagcaaatatagaaataacaagcaacagtttcttcaagtgagaaggaatcaatgctgaaattcagcagtacaaaaagtcagtgattcatactgttaaaggttcacgttagctctctagcaaagaatcttaactagattgaaatgtctgatatgacagactacaattcaaaatatggattgcaaggaaactcaataagatgcaaaataaatttttaaattagatataaagaaaagaaaaatgatccaggatatgaacaacaagataactacattaaggaaaaaccaaatagaatttttggaattgtaaaaattttaccacagaaattttaaaatacagttggaagttttaacaacagactagaccaaggatatgaacaatgagatagatacattaaggaaaaaacaaatagaatatttgtttttctttttgagacagagtctcgctctgttgccaggctggagtgcagtggcgcgatctcggctcactgcaacctccacctcccaggttcaagcgattctcttgcctcagcctcccaagtagctgggactacaggtgtgcaccaccacgtccagttaattttttgtatttttagtagagacagggtttcaccatgttggccaggatggtcttgatctcttgaccttgtgatctgcccaccttggcctcccaaagtgctgggattacaggcgtgagccactgtgcctggcctgaatagaatttttaaaaaaataaactgaatcttattgaaacatgtggttgtgtaaagcaactgaatcaatgatttattggcattcctgagaaggaaaaaaaaaaagtaagaaacttggaaaacacatttaaattaataattcaggaaaaattcccaaatcttgcaagagggattgtcatacagacacaagaagttcagagaactcttacaaaatactatacaagacaaccatccccaagacatatagtcatctgattatccaaggtcaaagcaaatgaaaacaatcttaaaggtggccagagaaaagggccaaattaactataaagggaatctcatgagagtagcaacaaacttcccagaagaaaacttataagcaggaagagatgggggtctatttttgccatcttaaaaaaaatccagccaataattttatatagagccaaacttagtttcataaagaaaggaaaaaaaaatctagcccagataagcaaacactaaaggatttcatcacaaacagaccagactacaaaaaaaatagtcaaagaagttctaaatatgggaacaaacaaaaacaacaacaaaaggtacttactaccataaaagcacatgcaagtacaaacctcacagaccttataaagcaattatgcaattgagactacaaataaactagctaacaacactatgacagtaacaaaacctcacatatcaatattaactttgaatgtaaatgacttaaatcctccatttaatagaaatagagtgacaaattagatttttttaaaaaggacccaaccttctgctgccatcaagagacccatgtcacatgacaccattgcttacaagagacaatctcttgtgagatacatggtgtaatgatgcccacaggttcaaagtaaagggatggaaaaagatctgtcatgcaaatataaaacagaaaagagcagaagttgctattcttgtatcagacagaagtgattttaaaccaacaacagtaaaaaaaatgacaaagagggcattatacagtgataaatgggtgaattcaagaataagaattaactgtactaaatatatatgcatgcaacattggagcaccaaaatttataaaacaaatattactagacctaggaaaaaagagacacatggacatgcattaatagtgggggaatttaacactccactgacaacattagagatatcattgtggcagaaagctaacaaaaatctctggacttaagttcgtctcttgacaaaatggatgtaataattattccatccaacaaccacagaatatgtgttctttgcatcctagcatggaacatattgtaagactgacttcatgtttggtcataaaacaagtctcaataaattaaaaaaaaatcatatcaagcattttttcagaccgtagttgaaaaaattagaaaacaatacaaagagtaaatcaatattagatatcaatacaaaggtctcaaactcacacaaatacacacaaactaaccaacttgattctgaataacttttggataaacaacaacatgaaggcaaaaatccaaaaattatttgaaataaatgaaaatagagatacaatacaccaaaacatctgtgatacagcaaaagcactgttttttttttctctttttctttttttatttgagatggagtctcagtctgccacccaggagtgcagtggcacgatctcagctcactgaaacctcaacctcctggtttcaagtgattctcctgcctcagcctcctgagtagctggagttacaggcatgtgccaccatgcccaactaatttttgtatttttagtagaggcgaagtttcgtgatgttggctaggctgtttgtgaactcctgacctcaggtgatctgcccaccttggcctaaaatcactgttaatagaaaagctcatagcactaaatgcctacatcaagtagatagattgcaaattaaaaacctgacatcacgcctcaaggaactagaaaaataagaacaaaccacaaccaaagataataaaagaaaagaagtaagtaataccagagtggaactaaatgaacttgagactaaaaagtcatacacaaaattaacaaaacaaaaagttggttagtggaaaggaaaacaaggttgatagaccactagctagatcaagcaagcacgaaagagagaagatccaaacaagcacaatcagaagtgacaacagctaccatagatgtataaaagattttcagagactactataaacatctttatgccaacaaactagaaaacctagatgagattaataaattcctggaaacacgcaacttcccaagattgaaccaggaggaaactgaagtgctggaaagaccaaaaaatgagttacaaaattgaatcagtaataaataatctaccaaccaaaaaaatcaaggaaaaatggatttacagctgaattctacaagacatacaaagaagatctggtaccaatcctactataactattccaaaaagtcaaagagaagagattccaccctaactcattctacaaaccagtatatcttgataccaaaatctggcaaggacaaaacaaaaaagaaaactataggcaaatatctctaatgagcatagacacaaaaatcctcaatgaaatgctagcaatcctaatccagcagcacatcaaaaagataattcaccacaatcaagtgggctttattactgggatacaatgatggttcaacatacacaagacaataaatgcgattcaccacataaatagaattaaaaacaaaaattatatgatcttgtgaatagatgcagaaaaagtattcaataaaatccaacatctctttatgataaaaacttacaacaaattaggcattgaatgaacatacctcaaaataataagtgatctatgacaaacccacagccaacatactgaatgagcaaaacttgtaatcatgccacctaagaactggaacaagacaaagatttccaactctcacacctttattgaacatggtactggaaggcctacccagaacaagcaggcaagaaaaagaaatagaaggcatgccaataggaaaagaggaagtcacattatcttccctcactggtggcaaaatcctatacctagaaaaccctacagattccttcaaaatacacttagacctgataaatgacttcagtaaagtttgaggatttaaaatcaatatacaaaaaccagtagaatttctacacgtcagtaaggttcaagttgagaacccaatcaagaatgcaatatcatttacaatagccatacataaaataaagtacttacaaatacatttagccagggagttgaacaatgtctacaagaagaaccacaaaacagtactgaaagaaatcatgaatgacacaaacaagtggaaaaacattccatgctcgtgaattggaaaaaccaatacagctaaaataaccattctgctcaaagcaatctacagattcatgcaactcccatcaaattaccaatgccattcttcacataatgctaaaaaataattctaaatatcaaaccaaaaaagagcccaaatagccaaagcaatcctaagcgaaaacaataaagtcagagacatcccattacctgacttcaaactgtactacaaggctataggaaccaaaaccgaataaggtacaaaaaccaatacatagataaatgaaacagaataaagaacccagaaataaagccacacacccacagccaactgatctttgacaaagtcaacaaaaatgtacaatagggaaaggaaacccttttcaaaaaatggtgccgggataactagctagctatatacagaaggatgaaactggacctctacctctcaccatatacagaaagtaactcaagatgaatgaaagacataaatatgagaccataaactcagaatcctagaagaaaacctaggaaaattctcatggacattggtttaagcaaataatttatgactaagaccccaaatgcaaatgcaacaaaaataaaatttgagaaatgagacccacttaaactaaagagctctgcacagcaaaagaaacaatgaacagagtaatagataacctatagaataggaggaaatatttgcaaactatgtgtctgacataggaataatgcctagaatacatgaagaacttaaataaacaaaaaaaaaaaccacattaaaaagtgggcaaaggacatggacactttttaaataagacatataagtagccaacaaacaaaaagtgctcaacattgctaattatcagaaaatgcaaattaaaaccacaatgagatatcatcttcaccagtcagaatggctattacttagaagccaagaaataacagatgttggcgaggaggcagagaaaagggaatgcttataaactgtttgggggaatataaattaattcagccccatggaaaacactctggagaattctcaaaaaactaaaaatagaattgcaatttgacccagcaatctcacaactgggtatctacccaaggaaaaataaatcattctatcaaaaaggcacttgcatttgcatgtatattgtagcactattcacaatagaaaagtcatggaattaccatatgtgtccatcaatggtggattgaataaagaaaatgtgatacataaacaccatgcagtactatgcagccataaaaataacaaaatcatgttttttttgcagcaacatggatgcaactggaggccattatcttgagagaaataacacagaaacacaaaaatcaaataccacatgtactaagttataaatgggatctaaataatggattcacatgaacacaaagatggaaataatagacacgggactccaaagaaggagagagtgggtaaagggttgaaaaactactagagggtactaagttcactacttaggtggtaggttcagtagaagcctaaaccccactattatggaatataccttcacatgtactccctgaatcaaatataataagcagaaaagaaaaacaaaggaaacatcaggggtaaaagatattctggctaaactgatctaacaggatccctgctgaagacaggccagagtggtaaaacatcacttgggggacagtggagaaagatgaacctgatcagatatcaaggatgatcagatatcaacaataggagttcttgacttagcaggaatcacccttaaaactgaattttacagagaagtgctcagatgggctcagcagaagtttcagaagcctgaccaaagcttggccaatcaaataaattttgctattacaagaagttccttgtgggatgatgcctgaaaaagatacaatgcaggagggatcaggattgggcagagaggggcttagttcaaaattcagatctgacaagtctcagcttacccagagaggagctgaagagctaggttgcttgttagagtacccatgcattgggcagaagtgccaggccttagtaaccccatgttgcatagtcattgactgaagactgtccaagaagagcatggcatcagctggaaaactgtagtagatcttgaaggtcatgcagctggacgctgtcagccaattgcactccttgaagctgaagagtgagttttgttttgaaatgagatcttaactgcacatatccctggctcccatcactgattgtgtattcaattttgtattcatagcttttcgtttaattgtacaagtgtgatacttttttgtggtgcttcattatatactcaacaaccacttctatatagacaaacatctggacatccaggatgctcaactcttcagaagggccaatttagtacaaatggagcaagaatcactgtaggacttggccagattctgtgtcacatttcagtttcattttgataaaatgaagtgtggattccctggcaaagagtactatcttttattcttatttatatattttctttatttatttttgtaagacagagtctcactctgtcagccaggctggagtgcagtggcgtgaccttggctcactgcaatctctgcctcatgggttcaactgattcgcgtgcctcagcctcccaaggagctggaattacaagcatgtgccaccatgcttggctaatttttgtattttcagtagagatggggttttgctgtgttggcgaggcttgtcttgaacccctggcctcaagtgatctgtccacctcggcctcgcaaagtgttgggattacaggtgtgagccactttgtccagctatttatatattttcattgtaatctcaccccccacacacaaaattaagagcctagtgtagcacctgctgccatggaggatcacagtaaatgtatttaatagaatgactaattatccagaggtttaccttttccccctcacttaatgtcaatatatagagcttttgtatcacttgcttttgctgatggatctggctctggttttgaaatcaattaatttgtctattttttatgaaagaaggaatacaattcctattggtaaaggataatacaaataaaacaaaattgagaagaagaaatgttaccttaataaaaaaaaatagattgaccattttctgggatttgcctcaccagtgacatccccagaaagataacctgcttttcagcacaacacagcaaatgctgagagcaagatgtgttacaaattgatggaaccaagtattcatgtgtcaagaaaagctagaaggaaggagggaaggaagggagggaggaagggaaggaaggaaggaaggaaggaaggaaggaaggaaggaaggaaggaaggaaggaaggaaggaaggacatgtgctttgcaagctctgaaaaggagaggaaatgctcactgtcagtctgtagcatgccctggtggtaacccaaagggtaagtctggcaagtcagaaggcctaaagtaagcctaaaaaggtgaataacaaccaattcttttataggatgtggcttcatttgcaaagcctttcactgatagatgcctttcagtgctaggagccaagcctcttaactcctgactttctgaagctccctgggagagctgcaaatgtagaagttaaaaacaaagcagcatagaggttcctggaaggctcttttatacaactgattatgatattcttctggataatttacttgtttcaagtgcataattaatggaattattattcataattaagaagtgcccagagagcaaagaacgcaaacaatgttctgactggctgtcagtaattttcaggctcacactaataatactcaggaaattaaaaggctctggcgttttccttcaatagtagctagaaatgtccattcttaacagcaatttggtgctgtgggcagtgtatatcctgtagattatgtcacctcgaagcaccattcctcatgacatcccttgcggagtacacagagaaagtcaggcaggtatcattgcttatttataagtagggccattctagtaggagcctttgtaaatgatacctgcctcttctcttgcttctcctcatgtcttggtgtaatcacctgtgctgcaggtcccttaaggtgacacactatgttagaggaactgagttctattagctaccaacttggcctctaatgaaatgttttataaggcccatcaactaagttttcatggcatagcccctcttcttctagtggtgggggaaatgtcttagcagccttttcgattttttccatcattattttgttttatttgctacaactaagcatgacactgtcatgctcaccagcacagtgttgcaactacaatatgctctagaaagaccccaatcagagtgaagactatttgtacaggcagttgcctctccagcctagttatcttttgtcgttgttgctgttgttgttgttttcagaatagagcaatcaaaaagcctgggcttccctgtacaagtgtccaataaattcaactgaaatgggagaaaagcaggtaacaggcctcaaacacaacttgcagtttgcttctccatttgtgtgtgtatgctagattttccaaaagtgtgtggcctggggtgctgggtaagatgtttgagttgtttgtgaatctgggagcaggaaagggaggaggtggaaagcacattggtgttgaccaattcaaagcaagttacatgcaaaaagctaaatgtggcaatttgggccacaggcagagttagcccaaactctctgcaaagctcacaaaaaattattctatttggttctgcctcagagcacctaaatctatagcagaactgtgtagtttaatctcaaaatgggtcacttttgctcacgtcaagctaaacagagaatggaaggggataaaggttgagctagttcattcctgccagggctttgaccagaataaatttgtccactcagggtatctagccccttgcttgtcaaagtgtggtgcatggtccagcattccctaggaacttattagaaatgcagaatttccatccccataccagacccactgaatcagaatctacaagttaacaaaatatgcagaagatttgtatagatgttacagtttagaatcctttatttacggcacttgctaaagttatctctgtagtttaaatgggacgaagggcatatttggcttcaaataataaatctatttagtatgttagggacttgactttcttttcagaaaggcttgattcccaaacttttgaaaagaaagattgagatgtaccatgggaatgataagagtcatatttttccggcaccggggaataattttagtgagcagtggtctattttcagagaaaacctatattattagccccaaagttacatgaaatattataaataataggattctatttctgtttttttgaggcagcaaacagacaaattcaggggtattacccaccttctgtcccagaattctgaaaattattcttatcaaattaaggagaaataatctgtaacataaagcaggtttcctttttaaaaatgagagtatggtttgtggggttccactgggggaaaacacaaactctccaggggtcaaattttaaggaactgggctattgtgacattagaaagaagaagacttgatgattcgaagtcttggatcctggaattagataattttctctaaatatctgtttgggctagtttttgatctcagagcctcagctggcctctttgcccagagtccactctgcacagtaagggcccattctttcctgccactgaggagaactttgcagctggctacaggaggagtgaattacaaagagaatcgaaaaatagataaatcttccatgcagaattccaaattatttacgtagacactccatcctcaaagacatagaacataacttcctatttcttaagtgtggcttgcccatattgatttccttcaaagagtacagtatgggaagggggacaaaagggtaactttacagtgaagaatcctgacaaatattacttcaatcaagtgatccaaattaactttaacaatatgatctagcaatcacactactgggcatataaccaaaagaaatgaagtcagcatgtaaaaaagatgtctgcactcccatgtttattgcagcattgttcacaatagccaagatatggaatcagactaggtgtccatcaatagatgaactgataaagaaaatgtggtacatatatttacattggaatagtattcagccttaaaaaagaagcaatcctgtcattcttttttttttttagtaattttattttattttattttattttattgtttttttttaattatactttaagttttagggtacatgtgcacattgtgcaggttagttacatatgtatacatatgtgccatgctggtgtgctgcacccactacctcgtcatctagcattaggtatatctcccgatgctatccctcccccctccccccaccccacaacagtccccatagtgtgatattccccttcctgtatccatgtgatctcattgttcaattcccacctatgagtgagaatatgcggtgtttggttttttgttcttgcgatagtttactgagaatgatgatttccaatttcatccatgtccctacaaatgacatgaactcatcattttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttatagtcctttgggtatatacccagtaatgggatggctgggtcaaatggtatttccagttctagatccctgaggaatcgccacactgacttccacaatggttgaactactttacagtcccaccaacagtgtaaaagtgctcctatttctccacatcctctccagcacctgttgtttcctgactttttaatgactgtcattctaactggtgtgagatggtatctcattgtggttttgatttgcatctctctgatggccagtgatgatgagcattttttcatgtgttttttggctgcataaatgtcttcttctgagaagtgtctgttcatgtccttcacccactttttgatggggttgtttgtttttttcttgtaaatttgtttgagttcattgtagattctggatattagccatttgtcagatgagtaggttgtgaaaattttctcccattttgtaggttgcctgttcactctgatggtagtttcttttgctgtgcagaagctcttgagtttaattagatcccatttgtcaattttgtcttttgttgccattgcttttggtgttttagacatgaagtccttgtccatgcctatgtcctgaatggtaatgcctaggttttctcctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagtgttatttctgagggctctgttctgttccattgatctatatctctgttttggtaccagtaccatgctgttttagttactgtagccttgtagtatagtttgaagccaggtagtgtgatgccttcagctttgttcttttggcttaggattgacttggtgatgtgggctctttttcggttccatatgaactttaaagtagttttttccaattctgtgaagaaagtcattggtagcttgatggggatggcattgaatctgtaaattaccttgggcagtatgaccattttcacgatattgattcttcctacccatgagcatgaaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacagtcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagcccttattattttgaaatacgtcccatcaatacctaatttattgagagtttttagcatgaagggttgttgaattttgtcaaaggctttttctgcatctattgagataatcatgtggttattgtctttggctctgtttatatgctggattacatttattgatttgcgtatattgaaccagccttgcatcccagggatgaagcccatttgatcatggtggataagctttttgatgtgctgctggattaattttgccagtattttattgaggatttttgcatcaatgttcatccaggatattagtctaaaattctctttttttgttgtgtctctgcctggctttggtatcagaatgatgctggcctcataaaatgagttagggaggattccctctttttctattgattggaatagtttcagaaggaatggtaccttgtacctctggtagaattcggctgtgaatccatctggtcctggactctttttggtcggtaagctattgattattgccacaatttcagctcctgttattggtctattcagagattcaacttcttcctggtttagtcttgggagagtgtatgtgtccaggaatttatccatttcttctagattttccagtttatttgcgtagaggtgtttgtagtattctctgatggtagtttgtatttctgtgggatcggtggtgacatcccctttatcattttttattgcatctatttgattcttctctcttttgttctttgttagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacattgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgtactgtggtctgagagatagtttgttataatttctgttcttttacatttgctgaggagagctttacttcccagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattattgtgtgggagtgtaagtctctttgtaggtcactcaggacttgctttatgaatctgggtgctcctgtattgggtgcatatatacttaggatagttagctcttcttgttgaattgatccttttaccattatataatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccacttacatttaaagttaatattgttatgtgtgaatttgatcctgtcattatgatgttagctggttattttgctcgttagttgatgcagtttcttcctagtcttgatggtctttacattttggcatgattttgcagcggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacatagatttggtcttttcacatagtcccatatttcttgaaggctttgctcatttctttttattcttttttctctaaacttcccttctcgcttcatttcattcatttcatcttccatcgctgataccctttcttccagttgatcgcattggctcctgaggcttctgcattcttcacgtagttctcgagccttggttttcagctccatcaggtcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggccctctgctttttagagtttccagtttttctgttctgttttttccccatctttgtggttttatctacttttggtctttgatgatggtgatgtacagatgggtttttggtgtggatgtcctttctgtttgttagttttccttctaacagagagggccctcagctgcaggtctgttggagtaccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaagcaggcaggcctccttgagctgtggtgggctccacccagttcgagcttcccggctgctttgtttacctaagcaagcctgggcaatggcgggcgcccctcccccagcctcgttgcctccttgcagtttgatctcagactgctgtgctagcaatcagtgagactccgtgggcgtaggaccctccgagccaggtgccggatataatctcgtggtgcgccgttttttaagcccgtcggaaaagcgcagtattcgggtgggagtgacccaattttccaggtgctgtccgtcacccctttctttgactcagaaagggaactccctgaccccttgcgcttcccaagtgaggcaatgcctcgccctgcttcggctcgtgcacggtgcacgcacccactgacctgcgcccactgtctggcactccctagtgagatgaacccggtacctcagatggaaatgcagaaatcacccgtcttctgcgtcgctcacgctgggagctgtagaccggagctgttcctattcagccatcttggctcctcccccccgcaatcctgtcattcttgacaacatagatgaacgtggaggacattaaaggccaggtacagaaaggtaaacattgtatgatttcacttacgtatggaatcgaaaaaagttgaactcatagaagtaaagggtagatggtggtcactaggggctggggtggagcagattttgaggagatgttagtcaaagtatacaaaatttcacttatacaggaggcataggttcaagagttcttttgtgaaacatggggactgtagttgatgacaatgcattgtattcttgaaaatcactaagagagatcttaagtgttctcaccacaaaatatagtaagtatgtgaggtaatgtatgtgtgacttagttatttcacaatgtatacatattttaaaattcatattttacacaataaatacatacaataaaagaaacaagggaaacatagtaatatcaataatcataacagttgttgatctgatgtgataaaatgaaaatttatctttgtgattttcctctcccaaacccaaaatcccagtctaattgtgagacaaacagaagacattgatatggtttagatttgtgtccccgcccaaatctcatgtcaaattgtaatccccagtgttggaggaggggcctggtgggaggtgattggatcatgggagcagattttccccttgttgttttcatgataatgaaggagttctcatgagatcttgttgtttaaaagtttgtagcacctcccctttcactctcttcctcctgctccagacatgcctttcttccccttcacctgctgccatgattgtatgtttcctgagtcctccccagccatgttcctcatacagcctttggaactgtgagccaattaaacctcccttctttataaattacccagtctcagtagttttttatagcaacaagaaaatggattgaaacatacatattccaattgagaggctcgtgatattggtaattgtgtgaaacactggtatggaaaaagacattagacaaagaacactaaaagtgcaaaagaaaagaaaaacacaattacaaaatggacagaaatattaacaaatacttcaacaggctttacatattctcactgtcatctactgcaccgctctttacaatttcatagaaaggtatacagttcagaatcagaatattcatgtattcattttttgttggttggttggcttaggttggcttactttttaaggagaaagtatccacaagtctttcaggtcttttctgctgtgtaggaatcagacatcttatgccaccagtgaattcagttggcatcaaactattcaaaagattaggaatcacacattggttgagggtagaaggttctaatatagtcctctctgtgcatctgattattgaatataatatacatagactgtcacttagtgcatgaccaagtcagttgaataaccactgtagctactttatgaggcacatcccagttttaatataaccactgactcagggatacctgtgtttttttcacatttcatctttcatgtgggaccagaatagtatacccattctaagcactggaaagtatcttattttggaaattcttacaagaaaactgtctttatattatgggacaagtaataaattttaatttagaaaatagaaataaccttccaaggtttggggtttatgttcccagatctctacatgcattaattcatcttacatattttagattccgcctcaccaagtatgtatttgtgcttctacataaaatggccctaatcagaatgttctacatttatgaaaaaaatggcttttaaatagtaattatgtttatttgacagtaaagaacgtaataaaaatagtttgtttttagcaatttcaatttgtttcctaagataaacaattgaataatacctacaagttaacacctttacaatggaattaatcctgctacaataaatgagacatctagccaatgaatatgttttttgctttctttaatattcaggtatgacatatggtgtttatatttatactctttgcttaacaatagtaaaataacatcttcaattactcacattatgtatctcagaggcatatgtcacatagtttttcaaaagatagaatataatggtttacaaataaaatcaagtttctttgtaacctgaggcatcttatgctgaaaatcagcagcaaagtaatattgttgaaaaaattatgtcttacaccaaaattatgattcccattattcttatatggtaggtgaaacatgtttggggtggagaaaaataagattaaaaattattaatcccaccaaattgaggtggtgacaaaggaatcgaacctcatttatgaacccagtttgaggtggagatatgggtacaatagtaatatctgaataaagaagagtgtagacaggttaccctattcataaatctttacagaagactttaggaagacaatgctgagattttccatttattaatgaattctgattgtcctactaaaaatatatttccttctaaagtgctagcaatgttcaacttatggggtaaattcactctgccttgtttttgtaaataacattttataaaaacagatccagatgattgtttcacataatgttcatgactacttttgcactataatgcagagttagttgaatagttgcaacagagtccccatggcatgctaagcctgagatattacctacccctttcaataagaggctactgtgccctgctataaagtgacaaatgattacttatatctaaagatatacagaacataaaatttacttcatttattatagaatatcacatataataacactatattttaaccaggaatgctgaaaacaaacaggttgttgaacattgtttaaaaagcccttaaatctctaaaatctgaaatattaattatcataaataacatcatgcttacaactgaaatgaaattccccacacaactaactgttgtttaaggggaagtagtcagaaaaaaaaaacaaataatgtgatctgtaaaagatttatttatgttcatatgtgctctggacaattgtagtttaagggatactattaaatttaagacattttaaacacaaaaagtaatatcaacaccttgacctgtgaaactctgtgactatatattggcagtgccaattgtaaaataactccacagagaactttaagagcacaaatgttgttttatgatattaaaactgaacattacccagtgctaatatattgtcaagcaactttttgatgatgatcaggattacttcacctatctctgggcctcagatcactcagttcaaaagtgaagatggctgctgtgaaggcccaaatgaagactggcactaaacaccaacaaccatcaagttgagagctaaatcaattatgcaatctctttcacaatagccaccaaataaataaaatacctagaaaaaaaactaaccaggaggttaattatctctatgatgagaattacaaaacattgctcaaaaaaatcaagagttgacagaaatggaataatattccatgcttatgaataggataatcaatatttttaaaatggccatactgcccaaggaaatttacagattcagtgctgtttctataaaactaccaatgacattcttcacagaattagaaataaaacattttaaaattcatatggaaccagaaaagagcctgaatagacaagaaatcctaagcaaaatgaacaaaattagaggcattacattaccccacttcaagctatactacaaggctacagtaaccaaaaaagcatggtactggtataaaaacagacacctagatgaatggaacagaataaagagcccagaaataacgttgcacacctacaaccatctgatcttcaacaaagttgacaataacaagcaacagggaaaggactccctattcaataaatggtgctgtgataactggctagccatatatagaagattgaaactggaccccttacttacaacatatacagaaatcaaatcaacatgggctaaatacttaattataaaacctaaagctataaaagccctgtaagataatctatgaaataccattctggacataagacctggcaaagatttcatgatgaagatgccaaaagcaatttcaaggaaaacaaagattgacaaatggcaactaattaaagaaactatcagtagagtaaacagataacttacagaaagggagaaaatatttgccaactaccatccaacaaatatctaatatcaagaatctataaggaacataaacaaatttgcaagcaaaaaacaaactgccccattaaaatgtgggcaaaggacattaacagacatttttcaaaggaagacatacatgcggccaacacgcatatgataaaatgctcaacatcactaatcttagaggaatgtgaatcaaaaccgcaatgatatactatctcacattagtcagaatggctattattaaaaagttaaaaaataagagatgttgctgatgttgtggagaaaaggcaatacttacacattcctggtggaaatcaaattagctcggccattgtggaaagcattttggtaatttctcaaagaacttaatacagaattacaatttgtctctgaaatcccatcattgagtatatacacaaagaaatataatttgcttttaccataaagatgtttgtacacatatgtttattgcagcactattcacaacagcaaagacaaggaatcaacctatatgtccatcagtggtagattgggtaaagaaaatgtggtaaatatacaccatggaatgctatgcagccatttaaaaaaaatgagattatatcctccacaacaacatggatagagctggaggccattatcctaaataaactaactcaggaacagaaaaccaaatactacttcttcttgcttataagtgggagctaaacattgagcacatatggacacaaataagggataaacagaaaacagaacctacttgagggtagacaataggaagaaggtgagggtcaaaaaactatcaggtactatgctgattacctgtgtgatgaaataatctatacaccaaacccccataacttgcagtttacctacataacaaacctgcacatacaccccaaacctaaaatacaagtgaaaaaaaacaaggaatcaataaaaaaataagtgaagacattggatagcattttatctatggtttgtcttttagtcatgactttttgtaattttattatttgtcattcaccaccagtgtttcttatgtttagcaattctgtcatatagtcacactgctgtgttcaaaggcaacattatggactacttttttaagagagaatttcagtctttttttttctgttcaaagggaataatgggaatcttgaactaactactgacaccatgtcttatttttaaatgcaaagcagctgggtacattatttaatataataggactatgactagcgttatttaaaaagtataatgtatcccttaaacaaattgggactattttttttcttgctgatttctttgagttccttgtagattatagacactagtcttttgttggatgtgtagttcgcaaatattttctcccattctgtaggttgtctgtttattctgattattatttcttttgttgtgcagaagctttttcacttattcaggtcccatttactttgtttttgttgcatttgcttttgaggttttattcatgaattctttgcctaggccaatgtccagaagagttgaacagtttttccaaagttatcttctagaatttttatggtttcaggtctgagatttaggtctttgatccatcttgagttgatttttgtgtaaggtgagagatagggatccagttttattcttctacatgtggcttgccagttttcccagcaccgtttattgaataagctgccctttccccagtttgtgttttcttatggtttgccaaaggccagttgactctaagtatttggctttatttctgggttctcaattctgttccattggtctaaatgtctatttttataccattgccatgttgttacgtaactatatccttgtactgtaatttgaagtctggtaatctgatgcttccagatttgttctttttgtgatttgttctttttgcctaggattgctttggctatttgggctgtattttggttccatgttttaggattggatttggttcctagttttaggtttgtttttctagttctgtgacaaacaattttggtattttgatgaaaattgcattgaatctctagattgctttaggaagtatggccattttcaaattattaatacttcccatacatgagcatgggatgtgtttcctttgtttgtgtcatttatggttacttaataaaaagtatattttaattatcattttaattaaaatttaagaaataaaacataaaataggttagcaaaacaatcaattaaaaagtataatgttttcttataatgcataagaaaacatatcaaaaaacaatcatacatgctacagaatggcaatgaagagatcaaatcttttctattgctacattctacctcagccttcaaaatttttcccttaagttgtgttcaaaataagttagcatctggcctcataggatagacatggggccaatgtagatccctagattttcaatatagtagtgtgcggtggatatcctttgctaggtttacctaatttccctgcagacctactaaccccattttattctttcccctaaaaggccaggaagacaacacttacgatgctttttattgttcaaaaaatgaatatatgaactctcaagtaaaattagtttttaaaaggctatgaagaatcagatggtaaattttaaagaaatgataatccttgctacacttttcatttctggtggttcaataaatatgtactgtttgccacgtagttaaataatggtgatactttaaaccaaaattacagaaggaatgttattactaagattccattaaagatataaattatatagagtaatggctgtggaaaactctagtgataggtgataaacagataattgtgaattaatactttctaagcagaaaattacccatccccacaaccattactcacttccatgctttggtccaaaatatcattaatgagaagtaaaaatttccatttcataattaagaagaacttaaacactcttacaagacctaatgcaacagatttataaataattgaagttaagatatttcctaagagtaggtctaaataagagcacagtaggaaagcaagactgtacttgaatgagagggccatgagttgtgaaagacattggataggaatatcatagacttcagcacacacagcatttatttttctattccagaattttgtttaggattgcctggctaccaagagaagctgaggatatttatcaggttgataaaattaaaaattgtgacaaaatttcccatgaaatattcccctcaaaacaccaacccaaatataaaagacttgtggttcatcaggggcaatgataattggtggaaagaggtatgacttaaatcctaaggaaacaaaacattggaaaggttgacttccctatttctgtaactcaaatctgtatttcttccttttttcttgactcatcccctttccctgaatatgcaactcccaacttttcaagggaatccattcaaaggttatcctaaggtttaaaaaatgttagctggcaaaaatcctgtctttttccgagtttgttgatgaattaggtaaagcaatgactcaggaagtacagatgcaagggtcaagaaattggataaaatttttctacaagtggtacttaaaatatgtgagctcgcctttgtaaacatatatggcatgtaataagatgtggagtccattctgccagcaggccaaaccaggcaaaatctcttcctttcaaatatcttttaagctgaatgctcatcttgtgagaccttttctccttaaagggcataattcatgtttactaaagaaagtcaccatgaaaagttatatatggttaactttgggccagatggcctacaaggatgttccttccatcccttgaggctttaaaaatacctcaatgatagtatgtgttgtggggcccccaaaggcagaacctgagtcaaatattttctttggacgttatttcctggaaactcatgaggggctagggaagtaagacaaggaagggaggaagccatacatggtacattataaggtaatttctacttcaagcaactggcactgagcccaatggggacttatggcctgcccattattgattgaaaactgcttcttgaggtactgactctattggccactttgtcctgcccactacagagactgagctagctccaaacaaagccttcaggcagagagtagcaagtgcttgcagtaagctgcctttagtgtgctaaggtgaatgccaagggtagaagggcatggcaccaacagcatcagttaaggatcccaggccaaaggtatttgagagcacaaaatttccatttctcacctggggcaatccagagtgccatgataggaatctttgaaagcctttgttcttctgcaaggccattcagcatgccaattttgtctccctgtggcaaatatcacatggaatggagacggaggtcaaatattatcttttgctgaaggtactgacatttctacactgaatgacaggcacatgcctatttagaaaatgtgctacttgttaagtttcccactgacatctcttgatctcactgggaattttgagttcatggcaatttctgagctgtgcacttagtgcacagtagaaggttattgctccatattatggtccactgcttaacacaatctgccaacagccagaagaatggttttctttcccaccgagtctctcagatgagatactttctcaacattattgttattgtttctgtaagctgattttccatcagagttagaactttggagaaaacaggttttagcttttttctaagaaatggatctccgtggtgatattaacaatttcaactcagattaaatgctttgttcttgttgctgtaaatatgttgcagtatctgtaaattctttttctgtgtagtttgtagacttattttttgaaccacacacatttttacaataggtttactgatatttcagttgcttaaaacatgaatttagttttagcattattttatgaataaagaacagttaattattatgccatgacaggagcactaatcctcctttatcatttgcgaatcttatgaaagactaaactttggtgataatttttgcttatttgtgtaattgtaagactttttaattgtgtcactaagtattacctatgaaaataaaatatctcccactgccacttcctgcttggattttgtaagaataaggatattttattgcacaactacaggcaattatcaacttcatataaaaaaaagacacataaaaatattaaataaattgttcaaggtcacaaagtttctcaactgtaaaaatgggataatagtaaaatttcataagtctgtcaagaactttaatgtgttaacatttatgaagcactggtagagtaagatctctataattttttattcaataacaaatttctaactggaacagatttatttttccttccttccttccttccttccctccctccttccttccttccttccttcctaccttccttccttccttttttcttttgttttgctcctcatattcattagaaacaaaaggaactaccaattcttccacaaaaatgttgtataagttaaatagcattcaattttatataagttgtatgctttgtgacatcattaaaacctctcttggtaacaattttgaggtattggatgatgtgttaaattgaattgtcaacattgcccttatccagctagcaagttttatgaactggagcattctagactgtgatttacattttctacctttaaatgcagccagctgctttaaagtaaatgactttaagctagtcccattcagttattacttagctttggacatcaaatatttcctcttcctattaatttctgcaaacctttaagaactctgcaaaataactattaagtgaactgataagttcacaaagatcccttttatttctaatattctaggcttaatgtacctgttaagtttttgtgtttgttttggtctctgtattagtcttctcaggatgctataacaaaataccacagacttaaacaacatagatttatttctcacagttctagtggctaatctaatatcaaggtacctacaaggtaggtttcattctgatgcctcttctcttggcttttgctaataagacctcctttttgttcacttggggagagagagaaaactctctagtgtttcttctcataatggcactaatatcaccaaaccttatctaaccctaattatctcccaaaggcctcacctccaaacatcacattaagggtgagggcttcaacatgaattttgcaggaacacaagcattcagtacataacaatctcttacatgatatattctgaacccagcttataagcctcttcccctttttccccttttaaaactcagttcaaatttgtaactcaatggacttgatagcagttgctttattgcaagtatctctggtctcttagccacctggcatcaagttgctcagtatttataagggttcagtagcatgccaggagccattttatttttatctattttattagaaataagaatagctcttcattgtgtagaccacagcttattctcagagctccaggggtctgttatacaactcttctattgggctttgccagagattccacgcagaattattcacataccagatatctctagcattatcagatctaagtcatttgactcaaatgacagtgcaacatatgacacaaactagacatgctaaagagccctctctcaaaatgagctaaactcaaagcaaatacttgagttatcaaatacatggatagcagcattatgagtcaccaaatacatggataggagtcccaagtgcagtataggcactaaatcaacaggtgacatatggtcctttgtatttaacatctagaatgcacataatgtaggatatgtccatttcaccttcagttttactgacccacttatggaatctttagctgcagcagattaaatgtcttaggtctcagaaggggaataacctgacaggtgtacattatggaactgaattggaaggtgcaaccacctcttatcaattttggactccttataacagtgagaaagtaagcaaagtgttactagactgggagatggaatataatttgattattatgaagagcaaggatgttatggcacaatggggggcagaggagagttcatctttcagccagaaattccagagtcatacattgatgcttcctacctaagagattagtataaatgggcaattcttgtaacaccaggtcaacaggggcaaggctaaatagggattaaactcctagggaatgaagctctagttcaccctaccattcaagaaacccatgtgaaactaaatgtttgctgatgatgatggaaatcagaacttctggtaaaataaaagatgatgaatatctattacaacctcaagaccagtaaaagcaacgtttatacaaatatttagaactttaggagatttcaactggcgaagattgaatcatcaccttcagtctcagggtgcaagtagattgggggagtacaattggttaacccagtttatgtactcccccagattctcttgtacctatatgcctctctgtaaccacctaaagatttgaccagcttcttaatgaagagcctgatcaaaatatatatatatgagatggagtctcactctgttgcctaggctggagtgcagtggcgcgacgcgatctcggctcactgcaacctctgcctcccaggttcaaacgattctcctgcctcagcctcccgaatagctgggactacaggcatgtgccaccacacccagctaattttttttcttatttttagtagagatggggtttcaccatgttagccaggatggtcttgatctcctgacctcgtgatccacccgcctcagcctcccaaactcatcaatcattttaatggacacatctcctaacactaccagctctctctgccttcaagggtgatactgggcttccacatggtctgagagcagtagtcatcacagctcagacactcaagtcctacaacccacagaagctattgcaaaccgcaccacttcttggtttagatgatgtcttgcataatggatgggggatctcactctcctagtggttacctgaagaagctaagtaacacaacctagaggtttggggagataaagttttgtgtgtcaaactaagaccagcgtgatgcagtaaacaagaaggttctgttagataaatcccattcactttcttctttccacatattcttctgaggtacaatgattccatatagcctctcagggaatgaccaatgtgatgaattaagcagctaccttttcttatgataagcttgataatactatttctttacattgactttactttctttcttgtattttttttcccctcagttccttctctctctaatcccttactttcctgggatctcacacccaccctcctcaataaaacagaagttaagttttgctgcaaggtctgttttgttttgtttctaatgaactggtactaagataagggtgtttaataattttgtgcatgcatgtcgtaggttgtctatatgagagaatcctgagaagatgagggaaatttcttgtcatgaagatgaacaggatgtcaattataagaaacatcacagagagaaatgaggttatgtgagatacatgaaacagaagatgaagaaaagagaaatgtgagcagcatgaggaagggcaattaccagagttaagcattaagcttcccttgagatatttcttaggggcaagaaagggtaatgaatttggaataataaatgtagagtgttgttgacagaaagagaacacatatagactcccagaaaagagcaggctgtcaagaagctgtcttccttcttgcctttgtaatttttttattgatttttagaactgcatgcagatattcatgtcaagaccaagacgaaacaaaaacataagtgtgaccttggccatttacttacaaagtaaataagaagtgaagactataatggaagtcaaagtatcttaaaagagttatgcaggtcttgtggtcctggctgagctctccaaagggattttcttaataagtcattattgatcctggtttagggacagcaatagacagactaatctacaaagtattatttagggcctaatcaaactaaagagttatctggatcagagcacaaatataaatgactatatcttgtatatcagtggttattaaacttagtacgtatccgaattatgggtttattaaaacatagcttgctggaccccagattcaaggtttctaatttagtagttctgagacagtgttgagaatttgaaattctaaaaagtttccagtagatacaaatgttgccaggcgacgaaaggttgaaggagtggtatatctgtgacaaagatataattttaagatctatgactacaaggaaaaaagtaaaaaaatcctgctactgaatattcataagagactgttggaagaacaaatttgaagtatagagttaggatggtcccatggagatggaaattgcagtgctaaaaattatttcccacttagtttctttgaacatatgaaagttaatttttaaaacagttgtttcataaatagctagcagcagcattattattttgtatgtaaatgagtccattctatagcaatttttctgctacctgggcataaattaatttattctagagaactatctggacgaattagctcagctgtcttttgactttattatgttctgcagaagggaaaaaatgctgaagcatgtatgtacttcttattttttttcttaagacaaatctgatgcccccaagcgtttctatgaatatttgttttaaaaaattcaaaaaggcattgaaaatttgttgtttgaaattatcaaatcaaattagcaatgccatagggtagagtttgtcctaaaatacaggctacaaaggttatggtatgaacagtgctttttctacatcgttcaaggaagttgggtaagaagggactagaccagtggtttgtatgttggctttacattagagcattttaatactcaaaaattctagactcacccaacatcaattaatcaattgaactgaagtgaggttttataagctctagtgtgcagcttagatagaaacctggggtgggacttaggcctcagtgtttttaaagctccccaggtgattcctataagcacacagattgagaatcagtgatctaaaaaaaaagccgttctgccacagaaagtgttatatagtctgtttctagcagcaccagagtgacattttgcatgaagtaaggtaatctttgaccctttctgaaaagaaaatttgttttcttaaattgaaacagtttcattacacttattcagacacttgaaaattgctgaatatttattttcatattcataatgacattggtgatagaatataatcaaagacaataaggcatttatttgttcatttcaaaatgaagaataaatagattcaaacattaatctttgcattttcaaagctgttaatcttagagaatggaaggttatgtttgagatattagaatttgaaaatgttaagaggatctgtatttagacttgtagaaattcctacagataaacagatacgagcataatggaagaaaagtaataaaaacgaagagatcagtagagtcttagaggagcaggaaggcccttgaacagcatgtccagttagaagtgaatgacagtgcagcaaatggccacaatttaggggcactatttaattgcacagaaatgttggtggagttgtcattaccatccactgcccagctctcagtttcaaggcaccttgtattgcctgggccctggcactgaacaagcatctgtggagggctccctttcacatcagccatcacttcgccaaaagacttccaaataaaagtgatttacattcatgcccttagccaatttccttgttagtgttactctcatactcctattgaaacctgtcagaaatatattattaccaggaagataaatcttagctcatttaactggaagttatagtgatgaaaaggagtgctcagcacctatacttcaagccaagtatggggtatgaaggcaacctgagaatcccctaaaaccaggcaaaatcaaagcactattcttattatttatcttttgcaacccctccaccttccagagaaaacagatctgaggtaaattattggttagatgctatatgggagattccttgattgacatgatgtaaattcaagaatcttaatttatgataaaagttagactcccccccaaaaaaaggagtacaagggaaggtcaattttgagagatccagtatggagacatggctggagctgatgtggctggtgaggctctgtagatcaaactgtcgtgccccagggttggtgacgtcgctggcttccagaaaggaatattgtaccagaaacagagatgtttaagtatataaaggacacaatttcctggttgtcctatgattttagacagtgttgagcttttccttctttttcttcatagcaaagcctgatttccataaagaacttcatcagccattagtacttgatggatattgaatctcaatgtttttctaaagggtatatgcgtttctgaggctatcctaaaattacaaaaggaaagcttcatctgttttaaagcaatataagttgccaatatgcattatgaagtaattttgagaggagagaaaaagtttccgaattatatcacttaggaagttgtatgattcactttttaaaaaggtacattattgttgtgcaaagaagacccttaaccccaaaagtatatgtagaaaagatgaaaaagagggcaaatagaagagtgatccataagaataggtcaggtcaattaaatcaataattaatggaggcttgaaaaaaaaggtgaatgacaaaaaattcaccctgaattgtatttgcaataagtaaaataagcaaagagatgggctgatgttataacaggtcacagaaagaaaaaattcctcattggatgctgtttagttttccccatccagtagaataattttttaaaagaaaattaaagaacaaacatacttgttacagagaaattccaggctgtaagttggtgaagtgtttcaagaatcattaaaaagtcaggaaacaacaggtgctggagaggatgtggagaaataggaacacttttacactgttagtgggactgtaaactagttcaaccattgtggaagtcagtgtggcaattcctcagggatctagaactagaaataccatttgacccagccatcccattactgggtacatacccaaaggattataaatcatgctgctataaggacacatgcacacatatgtttattgccccactattcacaatagcaaagacttggaaccgacccaaatgtccaacaatgatagactggattaagaaaatgtggcacatattcactatggaatactatgcagccataaaaaaggatgagttcatgtcctttgtagggacatggatgaagctggaaaccatcattctcagcaaactattgcaaggacaaaaaaccaaacaccacatgttctcactcgtaggtgggaattgaacaatgagaatacatggacacaggaaggggaacatcacacacgggggactgttgtggggtggggggaggggggagggatagcattaggagatatacctaatgctaaatgatgagttaatgggtgcagcacaccaacatggcacatgtatacatatgtaacaaacctgcatgttgtgcacatgtaccctaaaacttaaagtataataataaaattttaaaaaaaaagaatagttcctagttgagaggattgtttttatagcttgattatattcttttcaaatacaatctctttgatgtgaagtaaaatctaggcagatagcctgcctttttctctcccagtgttctaggccaagctgtcagattttaaaagtatatgcggaagacagtgtggcaattcctcaaggatctagaaccagaaatactatttgacccagcaatcccattactgagtatatacccaaaggattataaatcattctactatgaagacacatgcacatgcatgtttattgcagcactatttacaatagcaaagacttggaactaacctaaatgcccatcaatgataggctggataaagaaaatgtggcacatatacatcatggaatactatgcagccatgaaaaaggattagtttatgtcctttgcagagacatggatgaagctgaaaaccatcgttcttaaaaaactaacacaagaaccgaaaaccaaacactgcacgttctcactcataagtgggagttgaacagtgagaacacatggacacagggaggggaacatcacactctggggcctgtcagggggtgggggactaggggagggataacactaggagaaatacctaatgtagatgatggattgatgggtgcagcaaaccaccatggcacgtgtatacctgtaacaaacctgcatgttctgcgcatgttctgcacatgtaccccagaacttaaagtataataaaaaaaagtatatacggatttgaaaatgtgggaattattttcaaaatgaaatttatgtattaaaaagtttaccttgtagagtaataatatataatgaggttaccaaaaaagttattaaaaaaacaaaaagatatgaaaatttgccagtaggttggatatgcatacatacatcttatattttccattttggaaagagaataaatgatacaatatgtagtgccattagaatgatatcattagaaagccagcaattattatggattattaatacgatttttaatattgtacttttaaaattaaacttaattatgaggatcttgcatattgatcctcttgaacatgaggatcatgttcacaaaacataaattatgaaaagtcagctttatttgtttcttgaaaaaaataattagactaacacaatgcagaatatataagagatctagattttaagaaaaattagaatgccctattatcttcttaggaaaaaaagaataagaaatctgtagctaaatgatcatatacttagatgattttgtaactggctcacttataacataaacattgtttacaaatgagttgcatggccaaggtagaaatgccataggggcattttcacaggccactgtcttcatcactaccctctttctttcttccttccttccttccttccttccctcctttctttcgggttttttttttttttttgacggatctcgctctctctcgcacaggctggagtgcaatggcacgatctcagctcactgcaaactctgcctcccaggttcaagtgattcttccacctcagcctcccaagtagttgggattacaggcacccgaactcttgaaagtttcttacttctgtgttatagatcacaataattggtgtgatatagactatgtttgatggcagaatagaaatacaaaaagacctcggtagttggaaaggtgaaatgggcctagtatagtcatttttaaatttttgtttaatgctacagggaaagaggttacattcatgacaagaattgtgtaagaattaattatacattttatgcctgtatcaaaacattacatatattccataaatatgtacaaatattaggtatccataataattcaaaatttaaaaataaaacatagatttccaagggaaaaaattgtataagagtaaaatgaacggccccaagaagtagtgaattagttatcttgcatttattggagtgtaatttgattaaacccagataatggttacaaagaaaagtcagggactaaccacatggcttaaataacagactttaaggtatcttctaactctgagagtattcaatatttctgaagtgcttaccacttatttggtagatcattatttctagccctgtagcagattcaagctagcatagagctttggctcttaaatacctcctgactaagttgttctatcaacatatcttgtcagatcttatcttctactgacacttcatactgaccttcctctttcatttttttcccttcagcaacttatcactacctaacatactacttatacagtattatttttaatcttaaatatgtttctcccccaccaacaggtaggctccgtattttttatccgttttgttctttgctgcattcccagtgcttagaaccatgcctggcacagagttgacaaccaatacatgtttgtcaaaaaaatggaagaaatgataaaagtccatgtattagtcggttttcattctgctgataaagacatacccaagactgggtaattaataaagaaaaagaggtttaatggactcacagttccatatggctggggaagcctcacaaacatggtagaaggcaaaaagcatgtcttacatggcacaggcaagagagaatgagagccaagcaaaacaagtgtctccttataaaaccatcagatcccttgagacttattcactaccatgagaacagtatggggaaactgcccccatgattcaattatctcccactgggtccctcccaggaatcatgggagctacaattcaatatgagatttgggtggggacacagtcaaaccatatcagtccacaacggcaccaaccatatttatgaagcactttttcagggcctggcattgtactaagtactacacatgctaatgtgtccctgagttctcaagacaacaacagctttgccacaggaaccttccccatgtagcaggtgaagaaatagaggttctgagaggtcagataacttgcccaaggtcctacagctactcagtgctaggtcaaaataatgttcaataatctacaactccaccatgcccagctcactaaatcaaaagcaagtcataccttcctcctctgattgtcttcggtttaatcaaaggggtgaggcatgtgactctcagggagaactggcctgttggctgtgatactgttacagggggagggattaaacatatttttccagtatggatttggtagattttacttagtgctgcatctcaaagaggtcaggacctcaagattgtcaggacaacgaagagcagctgctcacaaattcatttcctgtggggcgagaatcccttctttacagttttagatgggaacaaatttggtaactagttataaaatgtctgtggccagtgctcttggttccatttagatctacttgatgttttctatttgataggtatatttagatttgtcttattttttttcttttctctttttccttttaaaagttaattaaccatattacagttaacttggaacaggtgaaaataatttataatcatcaaaccctatacaacctcattgtcattcactttttactactcaggtataatttacatacaataaaatgtatcattttaaagtgtacaatgcagcagattttagtatattaaaagtatgtctccaaggttgtgcaatcatctccaatatctaatcctaaaacattttcactaccaatgagaaactccccactcattagtaaccactttccattcctcactttcctgagtgcctggccaccatggatctactttctgtgtctataggtttgtcaacacttcatataaatggaatcatatagtatgtgatcttttgtgactggctcctttcacataccatggtgttttaatggttctttcatgtttggcaattcattcacttttattggaaaataatatgtcatcatatggatttaccacattttgtttatccattcaatgattgatatacatttggattctgccattaattgctgtgttcatttctccagagagcaattctgactctaccatctactagcactttggcattgagaaaattacttaacacttatgagagaaaagaaccctcttcaaccctcaatgatgttaataatccttatttcataaggtttcttttaatatttttctcttttttgtttattttttaaaattttatttcaataatttttgagggtataggtggtttttgttcacatggataagttttttagtggtgatttttcacatttttgaggattaaatgaagtatgcaaaatctgatgcttagggaacttctagaaatatttttgtctcttcatagattcccttctttttctgaatgttgctctctgccttgcttacagataccaccactcctggttagcatacttagaggtatattttaatatttgaattgtcagaaaataatatgtaaacaataggaagacaataatgatatatgaaatttaaaactccctgtgatgttgacttacccatatgccaatcccttaaaagccctctgcttctctgcactgttagtgctgaggacatagggcttctctttgtctcaaagcgaatgcatcacccgaagttcatgggccagtctcacctgcattctctagactcaaaatcaccattcccagaacttacttagatacacaagtgtctcatgtcctctgctctgttcaacctctgtaaatgctctgaaagctagtattccaactctgtccttattacctgtgtgaaccccattgcctttgtttccacagctataaaatgcaaattataataaacataaattcatgattattgttaggattaaatgagataatgcacgaacgtgctgcatatcacagcgggcaaacattgttcatagaatgaacaccttaccctcaggaagaagaaggaggaaaatctatgttaccttctctcactattcactttcttttcttcttcacttacagactatttggcatatatctatttcagcttgtatttatttaaggaaacaaaatcattccctgccgagcccttacactatgtttcaattcttggtctccgtagtcattttctatattgcaccatcattgtcactatacacacactcatgcgcacacacacacacacacacatcttatttggtatcatatttgatgccatttgatatttttctactcgaaaattaggtattgtattaagaaaatttattcttattcattcttatttagccaaccacatattgttaaatatttagtttatgaatattttactttaccaaatgttactatgatgaacaactttgtaactaaagttttatgcaatttattattatctacttagaataagttcccagattttaaatttctgaatcagaggcatatatatttttgaatattttgttacatgttgttaaattgcctttaagcgagtttgcaccaatgatgagcaattaagaaatttcatctatcttcatcatcacccaagaaaatgaagaaaaatatttgataattttataagcaaaaatatctaataataattatatataggtgttttgctaatttaaaaacctaattgtattattctgcaatgctttataacctaaagtgaacttttattcatatgttgactgggcatttacctttattctgttcagaaatttctggtacttatttttattattgtggcaaaaaaaaaaacccataacattaaatttaacatcttagccattttaaagtgtacaggtcagtaattttaaatacattcacgttgttgtacaacaaatctctacaacttcttttttttttgagacggagtcccactctgtcaccaggctggagtgcagtggcgcgatctcggctcactgcaacctccgcctcccgggttcaagtgattctcttgcctcagcctcccgagtagctgggactacaggcgtgtgccaccacacccagctaatttttgtatttttagtagagtcggggtttcaccatgttggccaggatggtctcaatcttttgaccttgtgatctgccctcctgggcctcccaaagtgccgggattacaggcgtgagtcaccgcgcctggccgaatctctacaacatttttattttgagaaagtgaaactccataggcactaaacactaattctctcttgtttctccattcaacctttggtaaccacctttcaattttctgtttctatgatttttactagcacagatatttcatataagtagaataacacagatttaaccttttatgactggcttatttctcttagcacaatgttcttaagatacatccttgttgtagcatgtgacaggatttccttctctttaaatgctacatattttattttatgtatataccaccttctatttatccatttatctgttgacagatattttgcttgcatatgactcattgctattgtgaaaaatgcagtgatgaaaatgagcgtgtatctctttgtgatcccgctttacattcttttggattaatgctcagaagtgggattgctggatcatatactaattctatttttcatattctgaagaaccactataacattttccataattcccaccacgagggtacgattgttccaacttctccacgttttcaccaaaacttgacatattttgttattttgatagtggcctttctgaggagggaggggattatatcttattgtgttttttatttgcatttccttgatgatgagggatgtcgagcatcttttcatatgcttattgccatttgtacatgttctttggagaaatgactatttcaatcctttgctcatttgaaaataatcaagttgttttgttgctattgaagtataggacttccttatatattctggatgtcaaccttttatcacatatgtaatttgcaagtatcttattcctctatgtaagttttcttcccaccatgtccattgtttcctttgctgtgcagaaatgtttaagtttgttgcattcttatttggctatttaaaaaaatattttgcctatgcctttggtgtcatatccaataaatcattgccaaatttaatgtcctgaagattttaccatatgttcgattctacaaatgttatagttttaattcaattcttacatttcagtatttagttcattttaaattagttttgtatgtgatgtaaataagggtccaactacatttttttcttctgaatattgttttctcaataccatttgttgaagagacaggcctttccctactgtgtaatctgggcacactgttgaaacatcatttgaagatttatctctggactctttgttctatttgattaatttatacatctacatttatgccagtaacatactatcttaataattactgttttgtagtatgttttgaaattaggaagtgtgagacctaccactttgttattttcaaaaccattttgactttccagtgtcttgagttttcatacgaattttagcattttttttctatttctgtgaaaaatgacattggtattttaataggagttctttgaaaatatcaatgaaaacatgaacagacacttttcaaaagaagacataaatgtggtcaacaagcatatgaataaaagctcaacatcactgatcattagagaaatgcaaatcaaaaccacaatgagataccatatcacaccagtcagaatggctatgattaaaaagtcaaaaaataacacattacagtgaggttgtggagaaaagggaatgcttatatactgttggtgggagtgtaaattagttcacctattgtggaagacagtgtggcaattcctcaaagacctaaagacaagtatcatctgaaccagcaatcccattacttggaattgcctttggaaatacccaaaggaatataaatcattttattataaagacacatgcatgcatgttcattgcagcactctttacaatagcaaaggcacttaatcaacctaaatgttcatcaatggtagactggataaagaaaatctggtacatataaaaccattgcatactacgcagccataaaaaagaatgagatcatgttcttctgtattaacatggatggagctggaggtcattatcattaacaagctaattcaggaatagaaaactaaataccacatgttctcacttattagtgggagctaaatgatgagaacacatggacacatagcagggaacaacatacactggggcctatcgagcttggaagctgggaggaaagagaggatcaggaaaaataactaatagatactaggtttaataactggatgatgaaataatctatacaacaaacccccatgacacatgtttacctacataacaaacctgcacattctgcacatgtacccatcaacttaaaagttcaaaaaaaggaggtcaggtgcagtggctcattgctgtaatcacagtgatttgtgaggctgagacagtacgatcacttgaggccaggagtttgagacaaggctgggcaacatagcaaggccccatctctacaattttttttttaattagctgggcatggtagtatgcacctgaagtaccagctactcaggaggctgaggtgagaggatcactgagccaaggagtttaaggttgcagtgagttatggtcatgccactacactccagcttgtgtgatagagagacatcctgtctctaagtacacacacacacacacacacacacacacacacacaaacaaacacaaacacactcatatttatattatttgtagctactgtaaatgggattgcctttttgatttttatcaggaagggatgcagaatttaactgaatgctttttctctgtctattgagataatcctgtggattttgtccttaattctgtttatgtgatgtatcacatgtactaatttgcatatgttgaattattcttgcattcctgggataaatcccactgggtcatagtgtactatctttctgatgtgctactggattatatttgctactatattcttgaggattatttcatctatattcaccaggcatcacattatctgacatcaaattatacttcaagactatagtaaccaaggcagcatggcactggtataaaaatagacacatagaacaatgaaacagaagagagaacccagaaacgaagccacatacctacaaccagctgatcattgaaatagtcaatgaaaatatacactgggcaaatgagaacctacataataaatggtgctgggaaaattagatagccatatgcaaaagaaagaaagactcctacctctcaccatatagaaatattaactcaaggtggattaaaaacctcaaactataaaaattctagaagaaaacctaggatggactcttttggacattggcctagggaaagaatttatgatcaagtcctcaaaaacaaatttgcaacaaaaccaaaaatagataaaatgggacttaattaaactaaagagcttctgtactgcaaaagaacaatcaacagagtaaacagataacctagagaataggagaaaatatttgaaatctatgcatctgacaaaaggctaatatcccgaatctacaaggaactcatacatctcaacaagaaaaaaaactccattaaaaaatgggcaaatgacatgaacagacatttttcaaaaggaaataaacaagttgccaacaaacataaaaaaaagtcaacatctctaaatatcagagaaatgcaagtcaaaaccacagtgagatcttacacccatcagaatggctaacaaaaacaatgaaaagatcagatgttggcaaggatgcagagaaaatgggatgtttatacaccaccgtttatactgatggaaatgtaagttagtataactgctctggaaaacagtgtggaaatttctcaaagaactaaaaatggaactaccattgattcagcaatcctaattctgtgtatctactccctcaaaaaatatattaaaaagatacctgcatttgtatgtttatcatagcactattcacaatagcaaagatacggagtcaacctaagtgtctatcaacagagaactggacaaagaaaatgtgatatatctatagatagatagatagatagatagatagatatctccatgaaatactactcatccataaaaaggaatgaaataatgtcttatgcagcaacatggatatggatgcagctgcaggccattatcctaagtgaaataactcacaaacatgaataccatatgttctcatttacaagtgaggactaaaatatcggtacacatgaacatacagagtgaaattaaaaagttgaaaaattacctactgggtataatattcactttttggatcatagtcacacaaaaatcctaaaattcacgactatgcggcatatatatgttcaccactatgcaacatatacatataagaaatttgcattttgccccctaagtatataaaatttttaaaagaaaaacataaaattaatttgcaatttcacaaatctgtgcaacaagttaatttgaatgtgtttaagataaatcataatttgctatgaagtttggcacttcagttgaaaacaataaaagagtcctctattttatccctgatttttttctagttttttaaataaaatgtttccatatatgtgaaataatatttagagggagaagagcttgaggcctattcagtaaatcatgaacaaaagtgaaaagggatcctgaagctttccagtaacttatgtccaagtgttttgaaccacatgccttatgggtgtttacaaagccagaaaaacaaggaacaaagggaagactatacatttaggatgtgagtgtttttggaggaggagtacaattttatgtaaaattataaaaatgttcggtagtttttttgggaaaaaaatgttatcaatactgacattagcttaagttatttctcttgagaaaacatattcaatacaaaaatgagtattatgaaactatatatatatgtattaatatatagaaaagagcatcactgactacctgtacttctaaaatgcttctttagtacatatattttcttatcaacatttgtcaattgcaaacatgaaaattgataaaattgtattatgtgcatacagatattggtgtgtatgtatatacaaacacccatatatatggaaaacacaagcatgtggtagttgtgcagaagacactattttagactgatgaaaagctcttcaaaggagctaatgtttctattgtataaaggagaagtggtttaaaggtggaaatagcaagctgggacctgtaatatattcaggctttgagttttcctttatggttatgttcttgccaaattttgttatcagactgatgctgccttgatagaatgagttagggagaagcctctccttatacagttttttgggaatagtttcaatgtgattggtgccagttctttgtatatcaaatagaatttggctatgaatccatctggccatctagcccagggctttttttttttttttgactggtaggttttttttattaatgattcaatttcagaatgtattatgggtctgttcaagttttcattttctacttggtttaatattaggaggttgtatttttccaggaattcatctattttctctggattttcattttgtatgcatagagttgatcataatactctctggggatcttttgtgtctcttttgggtcagttgtgatgttatctatgtcattttttttttttttgagacagagtctcgctctgtcaccaaggttggagtgcagtggcatgatcttggctcactgcaacctctgcctgccaggttcaagccattctcctgcctcggcctcctgagtagctgggactacaggtgcgtgccaccatgcctggctaatttttttttctttgtattttcagtagagatgaggtttcaccaagctggccaggctggtctccaactcctgacctcgtgatctgcctgcctcagcctcccaaagtgctgatctatgtcatttcttattgtgcttatttggatcttctctttgtttctttgtcatctagctagtggtttaccaatcttgtttattctttcaaatatccaactcttgttttcattgaactggatctttacatcttaatttcattcagttatttggtaattatagttatttctattcttttgctagctttgaggttagttctctttttctagtttctctaatcgcatgtttcattgttaatttgaaatctttctaacttcttcataaaggcatttagctatattaactttcttcttaacactacttttgctacatcccagatattttgatatgttgtggtcctattttctttaatttcaaagatgtttgatttgtgtcttatttttgtgagagggactggcaagcagaagggtctgcaggacaaatatgtgccgtccccatgtggaaaccagccctgctttctccttgttcaactgtcagctggggctagagctacttagagggaaatgggaagccctgggggttgagtgtatagccacactctgtggtacctgtatcctgcacaaaagcccctgcattccatgcctgctaaagccttgtctcgcccgttctctagggagattccactgccagttcaaatgttcatgatggacatgaagtaccttgtagctaggatcccagagcttcatggtgagaataaactctgtctcttcactcacctattctccaggagctattcaggcctgagaactagccaagcgtgtgggtgtcctgtgcaccatcccctgcctcttccctcttcaccctaagtgtttatttaacttctttatcgactcttgatattttctctcttaagttctgctcaaagtacgtagatttacttgacattttggtctctctcagtgggagcagtacttcctggctgcatctaattggtcatcttcccacattttgtttatccattcatctgtacatagacactggggttgtttctaccttttggctattgtgaacattgctgcaatgaccattgccatgcaagtaactattcaagtcctggttttaaattattttgaatatgtactgatatgttttgaatgtgtcctccaaagttcatgttttggaaacttaattcgcaatgcaatagtgctaagaggcgtgacctttaagaaatgactcatgaaaggcttaacgtaattattgcaagggtggtgtttgttatataaacaagtttgtctcttgctctctttcaccgtttctcaccgtttcacactccatcatgaaatgacacagcaagaaggcctgcataaaatgctgacatcttgataaagttcccctttgtaaaacattaaatcatctgagtcttattcactatcatgagaacagcgtggaaaagactgcccccccccaaccccgattcaattacttcccaccgggtctctcccacaacatttcagaattatgggaactacagttcaagatgtaatgtgggtggggacacagccaaccatttcattctgcccctggcgcctcctaaatgtgagatccatacatttcaaaaccaatcatgctttctcaacagtcccccaaagtcttaactcatttcagcattaactcaaaagtccatagtccaaagtctcatctgacacaaggcaagttccttctgcctctgagcctgtaaaatcaaaagaaagttacttactttctagatacaatgggggtacaggcattgggtaaatacatccattccaaatgggggaaattggccaaaagaaaagagctacaggccccatgcaagtctgaaatccagtggagaagtcaaatcttatagctccaaaattatcttcttttactccatgtctcacatccaggtcacattgatgcaagaggtgggctcccatggccttggtctgctctgcccctgtggctttgcagggtacagcccccctcctggctgattttgcaggctggtattgagtgtctgtggctcttccaggtgcacaatgcaagctgtcagtggagctaccattctgggttctggaggatggtggccctctctcacagctccactagcagtgcccaagtggggactctgtgtgggggctccaacaccacattttccttccacactgccctagaaaagattctccatgaaggctccacccctgcagcaaacttctgcctggacatccaggtgtttccatacatcctctgaaatctaggtggaagtttccaaacctcagttcttgacttctgtgcacacgcaggcccaaaaccttttggaagccaccaaggcttggggctagcaccctctgaagcaatggcctgagctctacattggccccctgttgccatggctaagacacagggcaccaagttctgagaccgcaaaaaacagcaaggctcagggcctggcccacaaaaacatttattccccctaagcctgtgggcctatgatggaaggggctgttgtgaagacctctgacatgccctggagacatttccccattgtcttcgcaattaacatttggctcctggttacttacgcaaatttctgcagctggcttgaatttctccccagaaaatgtggatttattttttattgcattctcaggctgcaaattttccacacttttatgctgtgcttcctcttgaatgcttggcagcttataaatttcttctaccagataccctaaattatctctctcaagttcaaagttcaccagaccactagggcagaggcaaaatgctgccagtctgtttgcattacaagagtaacctttactccagttcccaagtttctcatctctatctgagactacctcagtctggatttcattatctaaatcaccatcagcattttggtcaaagctactcaacaagtctttaggacgtcccaaactttcccacatctccctgtcttattctgagccctccaaactgttccaacctctgtctgttacccagttccaaacttgcttccacattttcaggtatctttacagtagcaccccactctaccagtaccaatttactgtattagtctgctcccatgttgctaataaagacataccagagactggataatttataaaggaaagaagtttaattgactgacagttccacatggctagggaggcttcacaatcatagcagaaggtgaacaaagaggaaagtcacatcttacatagcactaggcaagagagacagcatgtgcaggggaactcccctttataaaaccattatatttcttgagagttagccactatcacaagaacagcatgggaaagaattgccccatgattcaattacctcccaccaggtccctcccatgacatgtgggaatgatgggtgctataatttaagatttgggtaggaacacagtcaaaccatgtcactcctcttcaattttttcgaagtgtttgcaaaaaattatttatttttcttgaagtgatagaattcaccagtgcagacctgtggttaatgacattttttggttggatgttttgattactgctttaatctttttactagtaatagttctattcaatttttttttaatttcttcatgattttgtgttggtagattgtgtgcttcttagaatttgtccattatatctaagttatccaacattttgcataaaacttaacattattgtcttataatgctttatatttctgtaatattgatagctatagtcccacttttatgtctgatcttggtaactggagtctaatttttaatcattagccaatgtaactacaggtttgttaattttattgatgttattaaataaccaatttttaatttcactgattttctctattgttttttctattctctatttatctctgctctaaactttattatttcttttgttatgctagtttttgatttcgctttctttgtttttactaattctttagggtgtaaggttagttattgttttgagacctttcttctattatgtgtttatagctacatcttttcctcttaacactggtttcattgcatctcatatttttattgtatgttgtgtttttattttcatttgcctcaaagtattttctaatttctcttgttactttttaaaatcaattggctgattaagagtgtgttgttaaattttcatgtatctacaaattttccaattttcttttgggtcttcatttctagtttcatttcattgtgataagaaagcatgtattgtataatttcatacttttaaaatttgttaaagttaattttgtgtcctaacatatggtctgtcctggataatgtcctatgcctactaaggaaaaatttgcattctgctattttcgagcagagtggtctatatatatattagtcataaaagtttaaaccttcaaaattcaaagttttatttctgataactatttttctcttggggtgtctcctctttcccttctgtatggtaaatttctatgttatagttgtcctgacctgtattcttaatctcatagaatgttagaccacatttcctgttaccaaactcataaaatgaggtttgcatggtatggtttaaaaatatctgatgggactactttagagcaagcataaatttttcctgagggttttcatcattggcaaatcattttttggcatgtggctcatttctcagcattctggatgctagaggtttttctctgtagcagctaagtgtcatcagtgaagacatatgttttcacaaaagttgaaaaaaagaactttcttccaagatggttttcatgatcctgagggaaaaatgagcctacagttaaggtgcaattaaaatacaactacaaggtttttctagctcagtaactgaagcagaagacttgtttttctcagagtatcagctggcatcacagtgtcaaacatgccatggtatttcctaggtgcatggataatgtggttagctgtgccctggcatctggggaagggaaataataaaaaatatgaatagaacgaccctctgaattacagaaggggatgtgtttcataccgtgcttataaattgaagtctaatgaattatatgtaattaaacttcagcctttataaagagaggaagtattggctttctatcatcaacagatgcttaattaacatgtcatgataaagtctctaaatggctatttttatattttttgggattactttttactatggcacttttgccccatatatagaattgccaactgcatctttttatttgtagaacacagctgttttttcaggtagccgatatttttttcagccttaatacaactaagctactgtaattttacttagacttatgagcaaaatcttccagacagataaaaactaataggtctacaaagggtttggaacgtgagggagaaactacatatttgggaatcagtctgtactttgcaggcgtctgatcttggtaaattcttcagtcttggttaatttaggtcctcctttttaaaataccagttgtaaaatcagccacatagaatctctacgaatttatactaggagaatacacataaagcatagaacgtggtctcaaaaattatgcatttaataaactcagtaatatttttaaatggtaattccttattaccacttctaacatgactgagacatggcctagaaatttccgtttaacaaacttcctgtgcaagtctagttatagatcataagtgatatgtgtcaccccatggggatagaaattaacaacgataatactaatacattttaaaattatagatgaatcaaacatcaacatatattatttcagggccttggaaaatctaacctaagagaagtcacattgctataaatgaatgtaaatgccactgaaattgcccacgtcttttcttataatcagcagttgtgcttcacaaaaaagcaaaatgtatactatgcttttctagaagtaggctctatgttgagattgtcttagaaaatctaaactctttaggctgagccatataaaattgcacatatttgaatgattttgacctgcgcaaatggcaccttctcgtggtttgatctaataccatttaatctgttttcaaaaaacaacgtaatggtttcagctctactgtctccaatattccctattatactattttaaaagtacaataaaataggctatggtagagttgtctgagaaacagtgaattataatatattatgagcccataagtgttgggggtgtggattattcaataacatactgtgtttttaaaataaatttccaaaactccacttgaacaatcttacattgctttgaaacatctggtgctcaaacattatttaaacatatgtattataatggttagaaagcaatctaaccacccaatggcagttttaaaattaaagagtatttacagtcagatatgaattcccttttatgtctgaaaaatttattgtaattcttatccattcatttttcatactatttctttttctcacggattcttcaagatagtttcttttcttttttttcctacacaggtaaatctgaacaatctattgcaccacctagttgtaacctctgttaggactcagcttgtaaaagtcttattcacaattctaccccaatagcaaaagtggcatatagtagatactcaataaatatttcttgtaataaattatcaaattaattattaattctaaaaattaaatccaagtgctttctactgtgttagtctgtttttgcattcttataaaggaatacctgagacagggtaatttataaagaaaaagatttaattggctcatgattccacaggctgtataggaagcatgatgatagcatatgcttggcttctgggtaggcctcaggaaacttacaatcatggaggaaggcaaatggggagtgagcacttcccatggccaaagcacgaggaagagagagagaggggaggtgccacataattttaaagaacaagatctcacaagaactgattactgtgacaacagcaccaaggaggatggtgttaaaccatgagaaacggctcctataattcaattatctcccaccaggcctcacctctagcactagaaattacatttcaacataagatttgggcagagacacagatccaaaccatatcatttcacccctggcacctatcaaatctcatttccttcttacatatccaaatagtgtcattccttcccaacaggcccccaaaatcttacctcatttcagcattaactaagaagtccacagtccaaagtctcatctgagaaaaggctggtcccttccacctatgagcctggaattttttaaacaaaaacaaacaaacaacaacaacaaaaaacaagttagttgcttccaaggttcaaaagggtatgggcattgggtaaatactcctattccaaaagggagaaatcagccaaaagaaaggggctgcaggcactatgcaaattcaaaatctagctgatcagtcattaaatcttaaagtttcaaaatattctcctttgactccatgtcatacatccaggacacattgatgcaagtggtggtctctcaagccttgggaagctctgctcctatggctttccagggttcagaccttgaagctgctctcatgggctggtgtttcagtgtttgtggcttttccaggtgcagagtgcaagctgttgatggatctactattctggggtatggaggatagtggccctcttcttacagcttcactaggcagtgccctagtagggactccgtagaggggttccaaccgaaattttccctcttcactgccctagtagaggttctctgtgagggctccacccctgtagcaagcttctgcctggatatccaggcttttccatacatcctctgaaatctaagcaaaggatcccaagcctcaactcttgcaatctatacacccaaaggctttacaacacatggaagctaccaaggttatggcttgcattctctgaagtaacagccagagctgtacctgggccccttttagtcatggctggagctggagcacgtgtgatgcaaggagcagtgtaccaaggctgtgcagtgctgcagggccatggggctggcccaggaaatcattcagtcctcctagccctctgggcctgtgatgggaggggctggtgcaaaggtctctgaaatgtctttgagtccttctccccattatcttacctattgacacttggctcctttttacttatgcaaatttctgcagccttcttgaattcctcctctgaaatttggctcttttttttgccacatagacaggctgcaaattttctaaatttttatgctgtttcccttttaaatataagctacagttttatgtcatttctttgctcatgcatataagcatatgcttttagaagcagacaggttaattcttgaatgctttactgcttagaaatttcttctgccagataccttaagtcatcactctcaagttcaaagttccacagatccctggaacaggggcataatgcagccaggctcttgactaaagcatagcaaaagtgaccctactccagttcccaataagtttatcatttccatctgacacctcctcagactaaacttcactgtccatgtcaatatcaggattttggtcacaactaagtttctaggaagttccaaacttcccctcatcttcttatcttctgattcctccatactcttccagcctctgcccattaccaagttccaaagccaattccatatttttaggtatctttatggcaatgctcccctcccagtaccaattttctgtgttagtacattctcacgctactataaaggaatacctgaaactgggtaactcattttaaaaatagatttaattggctcatggttccacaggcagttcaggaagcatgatgctaacatctacccagcttctggggaggcctcaggaaatttacaatcatagtggaaggtaaatggggggtgagccctttatatggttagagcaagaggaagagagagatggggacagtgccacacacttttaaacaacctgatctcaggagaactcactatcatgatgacagcaccaaggtgggaatggtgttaaaccatgagaaacagcccccataatacaatcacctcccaccaggtcccacctccagcattgggaattacatttcaacatgagatctggacatggacacagatcaaaaccatatcactaccattagatttatattaaaaagttagaacactacagatatggcataatattgatactatggagataaataggtagaaaaagtgtcaagatgatctaaatattttaattacctctactccacctgtgggctattatgtcaattataaacaattactctttgcaactgcattaaaaaaatcttcacttttatcaaaggcaggcttatcttcattaacaaataaaataacagtaactttagtttgctctgctcattttaccataaaacccagctcatcataacttgtcagaggaaatattcactcccatttttttgaaagttattttatagttatgttttcatgtttactgaggagtaattaaaggtttagatactatgactacattacacattagaaaacatgagtcaggtaaattatgagatataccaatatcatttttaaatctctaaggaaattttagttttactatcccccttaaaaactgttgtcttaaatttaaaaaaatttatttcttaatgatgaacaaaatttaaataaattaaatgctatttattttcaccaatcaactcaggttttttcttgtcagtttttcaggccacaacatgtttatttgctaaataatatgaactcattggaattggagtctgaggctgttaactttcaaaacctctcttataggagacaagttcaatcagtctaaaaagcacaatgaggcatgaaatcattatgttgcattatgcagcaatataatttatttcttgaaacacctaaaaatgaataagcacattttagaggaatgagaacatatattctacagggtaggctgagatgaattcagcatgaaaaagtttcaaaatcctactgggatgtatgtttagatagtttgggtgtaaagtttatgatgacatggaggaataaagtatactatgtggaaggtaaccaaaacagaattccaaaaggaagaagatgagaattaaaattaattacctctgttgcactctgtctctcatataagcagatcaatgtgattaccattttatgtttaataatccatattttcaaattgtggagagttaaaaaatgtgacttcttgttcttcttcctagtttctttacactactctccagatcctttactaaaagagcaaaaataagacaaagataattcacttttggtactgaaggggccagaacatgtactatggagtgcagttttaggtctcaaggagaccgtattggcatagataaagctcaataaaatgagaaggagggagaaaaatggtgatgagaagtacccatttcagaaagcattgaaaatgagctctagtgccttcattgtgtctaatacaatgtcttgaatattggtgtcaccaagaggcccatggaagatgtgcaataagaagtagtggattgatattgtatgtgttgttgatttaagaataaactagaaatgaggtaaatacagctgagtgtgattagtctacagcagcaattgaaaatgtgtaaattcaaagacagcatgccaaatcagtttctccataggacatagcacagagactaatgggatttgttccaactaaagccttttgaaacatgtcttgaagccaaatcttatgtctaaacaagttttacagttctatctttccctgtggaaatatttccactgaattaaaacacaatcatgcttgatgttgtatcaagattaaaccacaatttcagcctcttgctggacagctgattttatttctcacacacttatttgaattggcaagtccaacaaacaactgagttgaagagacctgcctgcaaaattcatgagggagccttctgaagtttgctccttcacttttctatatcaaagccaattgttttcacaggaaaatgaagtttatttagggcatcaaaatatgtaataggaggggtttgtatcttgcctcaggaaaaattgtcagttatatcagatcaccttatttgtccttatttcaacctactttcctgataataatcgttcctctgtaagttagaattacctttcttgctctcacaaagtatttatcacaacattttaatagaggcattttaaatcatgtgttcaggtaacctacagtttaggaattcatagcatcattaatgtttaaaagtctagcatgagtttcttgatgatcctaaatgatttttctttggttttcattctcttgcaaaaataataaaacctgctcaaaataataattccaccaaatatgaaaatattaattaaatatacatagtgagataagttatatgaatgcatactatatataacatataaatatgatatatttagtatatatacatgtatgcacatgctatacatatatatgaaagctccactatgtgaaaaatccatttctaggtatcttaaacaaaattaaaacacatgataaaggctgcctctttcccaaagaagtttaaaatttatgtcaaatgtacataaacagttaaattgataattatgtgcaagggcagtatgaatgataacagtaatatattaatggaagagttcacatgcttttctttataaactatctttgcttatttctacagccatgaaaatattggtaacagacaccccgtccttagaaaaatgcaatggccatgaatatcttgtaggacatttctcattttatttaacaagaacaaaaaaaagcaaattaaaataaagacatattttatttcacatcctaactaatgtaaaaccttttcaatgaccccataatttgggtaaaaataggcaatctgctcctttacagaagttttaattactatggcagtcctaatctttatttttaaatctcaaaactcacaaaggactctctaaaaagagagagtcttactcctgtcagatgatttagtgtgtaggtttctataaactcctacaagaagtcagcatcaatgacaagagaagaaacatttcttcatgaagtatgttgattctaagaaaagccaatcataaagatgattggggacacagacttagaggaaaagagccatccatgagggaacaagtcattaagactgttcttattacttgggcagttcagggattgtgcatccaaattggccatcaggtgagtgaagacttgttcactaattagaccctaatttgtagggcactgatctgaggaagcataaatgaatcatcaacaaatacttttgccacacttgtgtgctttatcctcacaaagaacaggtaaattttcccaaagtaaaatataatattattagagaagggatgaaaatggaaatcaaatagaataataccccttgatatatgtatagtacacaacatgtagttactttaggatgccatttttttccctctgagaactatcaaacttataaaaccaaggtttctaacatacttttttcagaggaaaatctagttttcaatttatcaaagggaaaaaaagtgcttgtaagtggagaaggggatgtaattgctgtaaataaattgggagctcattgagggaaggcatactgaactgacattgtcctgagtcaactggttatggtaaaggcaaaggaccagggagaagaatgtgacggcaggaagctgtggctgtgtcacctggtataacctgatctgccttaacaacaacagcaacaaccaaaacagtgaccagaagtaactactgaaagtacaaattatggagagaattcaggatgttccctaatccaatatgactaatatctttatatacataaaagtttggagatagagttgcatacaggtagaaaatcatgtgaagataaagtcagagatcaagatgatacttttacatgccatagaattccaaatatttccaatcaattaccagaagagagaagaggatcatggattagaaacttcctcacaatcttcagaaggaacgaatcttgccagaaccttgacctcagactgtagcatccaagattgtgagaaaataaattttgttgtttaatccacccattttgtggaaaactaataaagagccctagactttttggatctttaaattaaaaagactcgctccagtttcccactcatcaaactcaacaacgggggtagggtagttttcctaaaatgcatttttatttttatatttctttgtaaactgtattgcaaatgagagcatttgttcaacaaatactgatgaatgctttctagtgacagattctgtttcaggcaatgttaccaaatatggctggaaataagacaggcaagtgttcacactttggagcttacagaatatttggagaaggtaataaacaaatgaacaaatatgataaaataaagtaaactagaaactagagagcaccaacagaatgggaactatttctgtgatttgtacagagaaattctttgtgagaagtagtcatttgagagaactgagtaaaataggaagcaagacatgctactgtctagatgagcagaagggataaacacataacctcaagtgtatcattaccttgtcttgggaagtgagtgcatggtgaggtgatagaaaagggctattgaaagtatagttttataaatacttatctggatgaattagcacaccgagaggttcttttattcacttattgtctgtaatatatcagagtgcttgtactaatcagaatgaaagtacaaggaggcctaaaaaataaaatgcctgaattaatagacaaatgatgttattcagagcattgtcaatattttgtaaagtattggatttcattagaattttgacaaaatagcagacataaactagtgaaagcatacctggaagaaatatataaaatccacagagatgagcaagatgaaggagcaggatgccccacaattatatatgggccaaaatgcttttgtgataactcagtaatctgtttaagaagttttagtactctagttgagcacataactaaaatcagccacaactgagaacaaacattggtagaaataacaatttcattttaccagagccagctcctctcacaaccctgcacagtttagcacctagagacattgcctcagcccacaacatttcccgtgggggaaaagagagtgttggtcatgggtacaacatctcagccttttagttcactgtcagatggctcagtttatagcttgcctcacatagagcacagacagaattggcgtagtttggatgcttagaagcagttaagaacaaagaaaattgagctggtggattgctgcatccagcaaaattcctgagactaagagaagacacagaagttcaggcttctcccccaggagagaaaaagaggagtggaacatatctttaatgcatcagacttccagtgtggtaaggggctagattttaccttgcctcactcagagtgctgatggaaccggcgtaatttgtgggaacaggtaagagcaatgaaaaaggggtgggcaccttgctgcagccactatgcctctgcaagagtgggaaaagagaaataacttgaggcttctccacagagaaggggggaaaggagaggcatgtgcttccaacatcccagaatacagtacataagtcagactccagaggaagaaggagattacaggctcctgacaaaaggaaaactaaataattcatctaagtagaaatctacataaaaaattccagagctaacacatatgtagaaaaggtttgagatgcttccagaatctccatacggctaattggtcaatgactttcctgttaaaaccagtttgtagtgactgaaagaagtggctgtttattcaagcctttgacagacataaaagcaaaattataaaaacatggagaattggaaaaacagaacacagtaaaaggtacaaaatatgtctcccaaaacagacttaaaaaaatggagatctatgaattgtctcattataaattcaaaataatcatcttaaagaggctcagtgtattacaagataacacagataactaaataaaatcagaaaaaatataaatcaacaaattcagaatattgagaaagagatagcaactatgaaaatactgaacaaattatggagctaaagaataaaataactgaaccaaaaaaactcactagaaagctttaacagcagacttaatcaaacataacaaaggattagcaaagttgaaggtaggtcacttgaagttatttattaggaggaggaaaattttaaaaataaagtatctaaaagggtcatgaaacgcttctgattgtacaggatactattaagttaaccaacataggcattatgggagttacagaggagaagagagagagaaaggggtagaaagtttatataaagaaataattgccaaaaaatttacaaatctggagatagaaatgacaataaagactcatgaagcccaaagaatcccagaaagaatgaacacaaagcagtgtagactgagaaactttatagtcaaattttcaaaagtcaaaagcaggcaaaaatatgaaaatagcaagagaaaagtgatccattatatacaagggaatgattataagactgttagtggatttcacagcagaagctttggaagccagaaaggactgagatgatatatgcaaatagctgaaatttaaaaaacgacagaacaattatatactctaaaaaaagtccttaaaaatgagagatacttaccaaaacaaacaaaaactaagaaatttataacccctacctcaaaaaaatgctaaagagggctcttcaagtggaaacaaaataatttaaaaatgcaagatgaaagttggtataagtaataactcatgataaatgtaaacatatagacaaatatggaatactgcaatactgttatgtctagttgtgaaacagttttcattctagtataaaagttaaaacacaaaatgttaaggataaatataactataaaacatatgttaatgaataaacaatatggaaagatgtaaagtatgacataaataacatgaaattagtgtgggggacaaaagtgtagttacatgtggttgaagttgttactatcttaaaatagacttacaactaaaagatgctttacataattgtaatcgtaactgcaaagaaaatatctatagaagatacacaaaagagaaagaaaccaaagcatattggaacaaaacataaatttacaaatgaagcacaagagaaaaataggataaagcactgaaaagacaaacagaaagcaattaatgaaatgagtttttacctatcaataaactctttaaacagcactgtttacaatggctaagatttgaaagcaagcgaagtatccatcaacagatgaatggataaagaaaatgtggtacatgtacacaatggagtactattctgccataaaaggatgagatccagtcatttgcaatgacatggatggaactggacatcattatgttaagtgaaataagccagacacagaaaaacaaacttcacatgttctctcttatttgtaggatctaaaaatcaaaacaattaaactcgtggacatagagagtagaagaatggttaccagaggctggcattggtattgtggggctggaggtattgtgtattgtgcggtattgtggggaggtatattgtggggctgtattgtgtattgtgggactggaggggaggtggggataattaatgtgtataaaagaatagttggaaaaaatgaataagaccttctatatgacagcacggcagcgtgactgtagttaaaaataacttaactgtacatttaaaaataacttaaagagtgtaattagattgcaattcaatggataaatgcttgagtggatagataacccattcttcatgatgtgcttatttcacattgcaagcctgtatcagaatattccatgcaccccatgaatgtgtacacctactatgtaccatcaacattttaaaaaaaattttaaaaataaaaatagatgcattattttaaaaaggctagccattcagtcctcattcaggggacaaaattagggcctaggttagagtagagaggacaggaggaaggaatggattaaggtgatttttagatagaatttaatgtacttgttgactgatggaacatagactatgagggaggaatgactgaaagtgttccaacataggcgtctgaatagatggggatgttgtaaatcagggcagaggcagagggtatgaggaggtctgcaataaagcacataagggaaaatgagtacttggttgtatttgtgttgaattggaagtgcctatgggccatataggtcatgagatggcctagtcttaagtcagacatatacgatagtcagggcccagcaacagcaatcctcaagtagactatgggccaaatggtattgaaatatgggcctgaaactcttgctgccttttgaaaccctgcttttttttcttttttctttttcttttttttttttttgactgagtctcgctgtgtcactcaggctggagtgcagtggtgcaatcttggctcactgtaacctctgcctcccaggttcaagcaattctcctgcctcagcctcctgagtagctgggactacaggcgcgcaccaccatgcctggctaatttttctatttttagtagagatggggtttcaccacgttggccaggctggtcttgaacccctgacctcgtgatccacccgcctcagcctcccaaagtgctaggattataggcgtgagccacagtgcctggccgaaaccctacttttatggtcaaacacattgagagctaaaacagctatattagaaatggaatttggggacataatatatttaaaatttgggatcagcatatatttggatttttagttgactattgaaattgtattgagagtggtataaacatgcagtactttcagaaattgtggtaattaccgtcataataataagaaagccatactgcaaagatacagcacaaaaggggctttagaatttgcctctacctcattcctcaatgtcttctctctctctctggatttttacccaaataaagagaatcacatgtttacttcaatatttttcctgtttgatgcctgtactcatgggagaacagaaatgttttcatatgccttgtgtgcagtgggattatcccctatgccctgaaaatatttgaacaatgtattgagccaggagatctatacctcccctgctgtatgggcacatttgtgcatgcacgcacacacacacacacacacttgcttcagactcactagtctatctttgaatctttcactgtgctaacctccctcaaactcccaagtctttgcccatgctttttcactttctgggatttatttcccttttctgccttcatgctgatttttcttgctaatcctttctcttccttcaagaaccagcttgatgctccccttccttataagcattgtcagagtcctctggctaaatcaggagatcctctgtgttagtgtcattagacagcactgcaatgacagattttattccacgcgttttcttacctatgctgagcatagtgaaaggcagggctgcccagtgcctgcccttaatacctgtgaaatctgtgggtgaactgggtaatgctggagaatgagaagccacagctgaaggttaaggaaaaccttcacagtgatcttgagatgaaggaatagaaagtccaaaagaaaaaatcaacagaaaactaatgagtttgcttaatataatctactacgtttatacacttttcaggaaaaaaaaagtttgattacacaagtaagcatatgctgatgaaattggcccagatccaattttattcctcaggaatagactattaaatttgcttatgagaagaggaaaaaacagccttatctgctggttacatttattgataggtagttgcagggatattctgatgacttattattcatcatttgcttcttatgagcaagcaattctcattctgaccaggcactaactgcctggtagctggcaattgaagacagattcacatctacaggaactgagaagtaaatgggctttctctttttgcccgcaaagacccatggacatttgccactgtcaggtgctgctatacctgttgtgtgatggtcagtaaacaaagcactacagtcttgagtttaagatcttcattgcatttacaaatgatttattatattacattcatctgtggcaagtcaatagcaaaataacagaacttcactgtgaaggccacgggtgactgccaaggagaaatagaaggttcactggctatagaagattatattcagaggggaaaattgaaaatcatggagcatttgcaaatgcagcctgcatggtattgcttcctctagcaacacttcttgaggatgtttctatcatacaggaatcaatctatcatgtcaacttcagccctttatgacctggctcatacacctgccattcggaggctcactttctagtgtatgatattatcatgcaaatacctcaggatactgtattgctcagcgttttggaatgtcctccttctttcaaacaaatcaaaatgcgattcttgttttttttccccccaacatcaagatttatccctacattttttagtattatttaaaaactactctagagttaatgaacaatgtttctcatgaacataaacctgtaaatctcaatgttactttaacaccaaactgacattatataccgagagagacctactatataaaaaggaacttaaatgaatgttatacaaaacattaaataaaatgggagaaagtctccccatgtaccaagagagagatgactttctccttcctgtggagaataacttaacacaatttacctgatggatgcctagatgtaaaatactataagcaaaatacagccatgttttcgaaaaaaaaagaaaagaggaggagaaaactgcaggaaccgtgcagcaattttaaaccaaatttacaggtcaatcttctctcataaaaaaagatcaattctagacagaaaagtaggtatttacagaaaacaagtctgttttaaactttctctttcaaataaatgctatccaggtgaaaaataatttggagaaatgccatatgatataatatgttaatccatccacatatttttatcttgctcagctaacataggtgtggcagcagggtctgggagagactctcttccaaatttattgtgatccaacaaaatactttttattgacattcaaagcataagccacagctcagtgttttgcacatttactgtaactgagggattccaatggagactgacaatcacaggttttcacctttttagatacaaagacaggatagactctgtgccatggagtcagagtttttctctgggacttgacctagactgagcctctctttgatggcaaagctgtgaggaaaagagctgccggggccaggctgaagaacatgtgaggaagctggcttatggaaggcaatggagaccaccaaagagaaagacagtttggcaaagagcatgccactgttcctgctgtctatcaaaggacaattgtaagttcaagaagagagagtgaaaaatagagaaatggtgatgaaataccgacattagaatagaggataaaaggctaagtgtaaatactattgttagggtttacactagcatttaatctttttattatggtaaaatacacataacagaaaatttaaaatattttccatttttaagtatacagtaactgtagaattaaatatatgcacatcattgtgaaacagatctgtagaactttttcatcttgtgaaactgaagctttatagccattgaataacttcctttatccctgctcccttaagcccctgacagtaactattctactctatgtttgtaaaagtttgcccattttagatacttcatgtaaatggaattttgcagtaattgttttatttgtgactgacttatttcacttagcataatgtcctcaatgtttagtcatgtgatacccatacgataggatgtccttcatttttaaggctgaataatgccccattgtattttctttatccatttttctttggattagcatttaagttgctttcacctcttgactattgcaggtaatgctgcagtgaagatgggtgggaaaatatctcctcacaatcctgtcttcagttattttgaatatatagctacagtaggattgctgcatcttaaggtatttatatttttaatgttatttgagaaatgtccacaatattttccatagcagctacaccatttaacattcctcacaacagtatgtgaaggttctaatttctccatatctttgtcaatacttgttattttctgtttttttgatagtggctattctaacagatataagtggatatttcattgtagttctcatttgcattttcttaataattagtggtgctaaacatcttttaatgtgcttcttggcaatttgtatatcttctttggagaaatgcctattcaagtcttttgatcatttttaaattagtttttttttccttgtcaagttgtatattctagatattaatcctttgtcaaatgtagtttgcaaatattttgtcccattctgtaggttgcattttcacagtgttgattgtttcctttgctatgtaaaattgaaatttaacatagtctcatttgcctatttttgctttttttttttcttggcctatgcttttggtgtcatatccaagaaatcattgctaaatccaaagtcatgaagcttttcccctaggttttattctaaaaggtttaccattcggcatatggatattctgttttcaatcatcatttattgaagaaactattgttttccccttttgtaggcttgacacccttgtgctaagattatttgaccatatatgccagggttgatttctaggctctctattctgtttcattcatctatatgtaggtcttcatatgagtaccatactgttttgattactgtagctttgcaaaatattttgaatcaggaagtgtgagacctccaacattgtttttatttttcaatattgttttggctatttaaggccttttgagatagcatatgaattttaggatttttctctattttgcaaaaaaatgccattgaaattttgatagaggttacatttaatctatagaagactttgggcaatatggtcattttaagaatattgtcttccaatccatcaacatgaaaatctttcaattaatttatgtattatttaattcctttctgcaatgttttgtttgttccttttcattcttttttatctattcttatctggctgtcttattttagaaagtcaatcttcaagctctgagattctttcctcagcttggtctactctgaaattaatatttatgattgcaatatgaaattcttttagtgtgttttccagcactattagatcagcaacattcttttctatacgggctattttgtctgtcagctcctgcatctttttattgtgattcttagcttctttggattggatttcaaaacactcttgaatcgcaatgatctttgttcttatccatattctgaattctatttctgtcatttgagtcatctcagctcagttcaaaaccccttctggagagctggtgtggtcatttggaggaaggaaggcactggctttttgagtgtcagggttctggtgctgattctttctcatctttgtgggcttttattccttcaatctttgaagctactgacttttggatgagttttttaaaaaattatatttgttaaacttgagggtgtgattgtggtagaaggtgaattcaattgacaggcttcatttctggaataatttagggggccaacgctcaccttccaactcttggactgtgtgctctacctctgggggatttgtgttgggccctgactttgttctttggctccttgaggttagaaatccattgtgctagggtgcccaggtactcccagactactgatcactgcactccaaagcatttcatagtgaggcagcagtgggatttatccttgttaacaggtgccagcagtagtagcagtgtggaggggtgcacacttgccagctgtggcagggtgctagtgggtgctgagatgtctgcctctgtgcaagcattcaccacagtggttgaggtaacatggctcagggggacaggggcaccgtgctggcaactatgtgagcagtcatgctgctggtggtgttggcattgggagtgggcagttggcagacataggcctgtgcgctttctctgtgcacacagagctgtgcttgcttgggaaaagggctatcacaggtgacatgtaatggtttgtttttacccatttcaatgtggatgttctttgctttaccctacactggtaagctgcagttttttgttgctttctgcagttttcataaagcttcccggactacatagttttgcaaagtcagtgtttttgttgggaaatgagatctgagacttcatgttctacctatctttctggggtcactcctaaatctccgcacacattttatgaaaaggattaagtcactgagatagaggaataagttttatatacttaataattattttagtagctactctgttttgactgcttaccatgtgcctgacacacagtatataatgatattctcacagccctagcaataagaactcaaaatgccacttcacctctcgaatttagctagtaagagatatgaaagaaaaaaattaacaaagtagcccaagagcacccttccagtaaatggtatgaaaggcattttcaacaaggcaatctaagtccatagccaatggttttaatgaattgtttcaaagtctttagtatttaaaactttaggaccagataaaaggcaaaataaacaaaagatcaaaacacaagcagacagtgatttagtttagcgaattaacattaattttattgcttaacatcacaggaaacaaaaaaggtcacaagtaagaaagaactaaataaaatatgacagtagatacaaaaaattcataagctcctagactttggggaagaatgcatttttaacttaatatttatttaaatctgataggtgtaccattcaaagagaattggagttactctggtttctaaattgaataatcattttgcctcgtgtagtaaattctggatatttattaggaaagccttgaataaagcatatcaacaagccctagatatgtttaatcaatggaaacctgcatgaatggtccagagacaattttccaaacccaatcagatatagggatttatggcacattatctcccccaaggaaaattttacgttgaatcccacaaaacccagcaaaaccttataaattggtttcctccatccctttaccaacattgaattcaatattactttggtatacaattaactggggagttttatcttttccaagactccagactcaattttgctatgttttctaaaggaaaactttacgttgacccccacaaaacccagcaaaaccttataaattggtttcctccatcctcttaccaacatctaattcaagattaacttggtacacaattatttggggagttttatctcttccaagactccagactcaactttgctacgttctcgaattatgcaatcataggaacaatttctaaggcagattatatcagtaaattatcttcaactacctgcttttcttcattatttgtcttgctgttggttttgttgtttctgttgttgtagcttcagcacctcctaccacatgggggagaaggttgaggggcattggacagatatttttattagatatcttttgttctaaacagtccatctaaagttacagtatttagaaaatattcacctcatttttcatgtcttagcaataccaacaaaaaactaacaaataattctggatcagaatttttaaaaatcagtgcaatgtttcttgtttataatttatgactctcttaactatcactcaccaaggacgtaactgattggcaagttagtggcctccagatgacccaccctgcttacagccaattcacttccaattatttaaattaaatagcatcaagtaaaagtcattgctaagggtaaaaagatgaataaattaaaatatgttccctaaagcacagtttctattaagccaggcatatatgagaaaataaatttaaattaaaagtataaatgtaaaagaaaaaatcaacagcagagcaaaatttgaataggactttagatgagattattcacgattgatgggctcattaattttttggaaaagtaagaatatagatgagggaaaataaagttggtcatttattcttagtgcttcttatttcctcagcaaatatcaccatttcactgaacttaaaaaaaatgaataagtattgtgcactggttcttggaaaacttcctctgtgcattgaatgccttttagtttgacctcaaaaatctttgcgaaatgctttaagagtatgtactgttagttttgttttttttttgttttgttctgtttttgagacagagtctcgctctatcgcccaggctggagtgcagtggtgcgatctcggctcactgcaagctccacctcccaggttcatgccattctcctgcctcagcctcccgagtagctgggactacaggcgctcgccatcacgccgggctaattttttttttttttttttttttttttttttttagtagagacggggtttcaccgtgttagccaggatggtctcgatctcctgacctcgtgatctgcccgcctcggcctcccaaagtgctgggattacaggggtgagccaccgcgcccagccgtattgttagttttaatattagcggataggacggtggctgagaaacttcccttcaggatacagagaggctgtgccctcaaggtattcaagtcttatgcctcccaaaatattcacctgacaatacaaaaagaaaaattatatttgtggatacattcacattataccaaaaattacagattgatttagccagaaaaatgacttgcacatatatggaattgtatactcaaacaaatatgaactgacagatttttcatattttcattttaattttggtgttgcagatatagctgaaagtgtggtaaagtcctagatagtaattaattcagagttgtcaattttagaaaacacttgttgtgttgatattccacgtgagttgttcccttttgacccaaacttattaacaaattctgtttcctatcactcatttatgttcttttaattgtcatcacagccaaacgtttcctatgtgtgagatacatcagagtgtgaagtgctactactttctttagatacaataattttagagcaatgcatagagaggaatgaggagattctttcatttcatggtgatagtttttcttttattgattgtacataaatctagaaagagtatgtatgatgtggtaaaaagagaaatggcctgggtgacaaaagggatgttcctcgtaccaattatacccataaccttaatggacaaactttgaaaagtcacctaggctctcagccttagtcccctcaatttcagcagaaggaagagagagagagagggagggagagagagagagggagggagagagagagaggaaagaaggaagaatgaaagaaggcaacaaggaaggaaggcaagaaggaaggcaggaaggaaggaaggcaggaaggaaggaaggaaggaaagaagggagggagggagggattgcaagagggagggaggaagaagggattgcaagggaagagatgaaaatgaaggagagaggaaggaagaaaacaataaataaaggaaggaaaggacacaaattgggaaatatatgtattattacattatgtccaaataatttatttcttatcttctgcttcattttacccttccacttgaactgagatatattcaatatgttcattcattcaagaacacatattaaacacctgccattgctaaatattatgcttcaggctggaaatgccacaataaatatcacatcatacctgcactgaatgttttcagagtgtagttagggtaacatgtaaaatatacaatgtcaatgcctgcatgtcagtgaataaagccaatcagaaagtggaagatattttcttccataagaaagaatttttcaaaaatttgttttgtttcttttcagtgctcttcaggtattacttcctttatgttttctgacttctccactatttttaggcctctctggatgtggagcagatagcaacagaaatcaggaggtaggctgtttttgactagaatgagatttcgttagtgtcttgccaggatcacctttaattttggaatttcattttttagctcttcctctgctttagcccccttaatatttttctctctcatctctcaggttttccttccattggacgtcaatttcttgacaaggaggctgcactgataattatcctgacagaggcattttttctaatggtcctcacctgctttgtctggtgatacaagcaatggaattcaccacacaggcttttggactgtggtctgtatatttccggggattcacacaaaaagccaagaagtgatggtttgtgccaatacctaggtacactgcctctggaccttgtcttatctgtaaaataattaaactataaacaaatcctgttagtcaacagaccttttaagcccagacattctgccacctgtgtttttgagaattagaggcagattgtgcttggcaggtatttatcaatccgtacattgactgatttcaaattctccactgagcaaacatcacagctcatttagtaggtttggaagaagatgttttcactattggactcagaaacactttgggaaatattgtttttacagagcatcctgtcaaatcatccaacagacaaatatactcacttcctaactgccaggctatgttcgaaaggcaggacaagaaggcagattttttgcaggaagaaaggttcaactactagaggcaaatgtttagattaacaagccctatggcccagtcaaacttggttcacgtattaaattcttttttggtaaataaacaagtgcagccaaaaggttagagatggataagagctgatagtgtcccaaaggctcactttcaaaatataataaaagcaggcttcagatcaaattccagtatatgcttatttattaattatccattttcaaatgtccataaagcaattccggaaacttaggaatggcccctgataattatatttataaaaagtatcctggatgatcctgaagcacacaaaattgttaaaaccacaccatcaagctgtacagacatcaaaattaatgcctcccttagcaaccttctatttggtttttgggaaactgggaaagaataatgaaaagaagtccagggatggtaatatttgagacagattgtgcattatccatgctcttgagctttatttattttttaaaatatagaaattatgtgtgaacattattcttaaatacagagagataaaacctaccccaggcctgctgaatctgcaaacttactgttggagagtcatatgtattttgcagaaacttgtggttgattctaaagcacagcagcatttatgaattattcatatagagctagctagctggaagccaattttcatttctctcatccaagttctagagcttccagcaacagaaaaacactcacttttctgcacccacagttgctattagttagcactgtgatctcaggcaagtcacttaacacttaagatctctagttttctcaccgaaaaaaatcatattaaacataagctaatacagatatcttgataaaatgttatctcaagtccatccattcaaaaacaagtcattgttacaggggtggtagtaaatagtattttgataataaccgaagcatttctttctcttataatttctgacaatattgggcaccatactcattggctcagtggtgttccttgaatcaggggagtgatagctcagctgagactaaagaagtcaagagagtttacaagtaaagtcttaaaaaacccacagaacacacaggaattgtgaaagtctagcattccaataaagttgccttgaagcaagcagacctggaatgtatgccatattcagttaactaaaaaaaattgtataatgatgtgagagcaatttcctgtccctcgccagaaaaagaacccacatattagagaagccagaataattggaagatatgatcaagggagttaaattgtggataaaattttctagggctatgtcctcaggattttttgtgtgttagaaattagacaggcttagtgaaacccaaacataaagaaagggttagtaaaagcctcctagggtggtcacaaggccactttagcaccttaattttagagtagcaagttgtgagtcaatatccctcgatgtgtatcactgctaaattttgaaagtagcctacacccttcaaaaggacataaaatggctgagtggactggagacttcgagagtcctcaaaatgacagaaaagtgaatacacatattaatatgcaataaactaggcaccacagagcagagggacatggacatttgaaccatagaggcagtggatagatattaaccaataagatcaattaagtttatacatctcagccaaagtcaacatgggttcttgttggttcaaatgttgttatacacaataaaatctctcactctctcttttccaaatgccaggttatttatagatcgttgctgcaacgtagatcaccttcagggcaaatagaaggaaagagaagacagaaaattcctaaattaagagagtgttacccttaaaagattgagtttcaaaacagaatttactgaatttgcctcaatttaaaacattgtccagaatatagtagacaaaaatggtgactatcttacaccaaagagctcatggttgggtagataacagattataccaccagcacccctaaatctgacttaggccaatttggtcttgcacaatccttagtttatttttgataggctatgctgtcctaaaggtggagatggataaaggtattatcataaacttttctctcgggttaaatcaagtcttagaaataatacagccacatatgcagacatagattactcaaacactgatcatcaaacaggaacaaaatagttcatgcaacctgttctgttgactccatgaagttcagctttctgtccgtttaggtgctttaactacctctttccataaaagggtcattctatgctaataaaaaccattgcaaaggctggaatctccagcatttataatagttagcattatatatcctctcaaaccagtggtttccaaccttgattgcatattgaaatcacctaggaagctttaaaaactactaattcctggactcctcccctaaggattctgctttaattgttatgagttgtgacttagacatttgcagctttttaaaagcaagtacttctaatgtgcactcaggtttaagaaccataatcctaaacaagtagtgggcacatggctgcatggaagattttcagtttaataaagccttgggtttcatccaaaagtgtaaagtctaccaacctcatcagattcttaaaatctctgtgcattgggtgagcaatatctcctatagtttgagccagtccataaaccttaactacttttcattttacctataagagttcattaacaaaaattattattctatttattatgactaaccaataaaatttaattttctggtatttaatatgttaattggcaaagtctagtttgttgactgagatacaaggaacagaagctctttcaggaactgtctcttgagtttggacttcctatttgagcaccagctgactttgtctagactgcgtcctttagtgtaatatttgaatcctagttagtgcttgaattaaatatttaaatgacacacatattttgtgtgtgtgtatgtggtatttgaagtatatgataaacattataacacttcttcctactgtaatcctggttgggcagattctgtaacctaaattaaaggtgccattttcaatgccttccattgggaaggtattttccaatgtccttctattgggagttgatttttgtttcccacagtagactctacatcttttcggcattgggatcatctttcccttacttcagcaaagaaatcttaatcataagaatagtagtactcagtcttaaatgactttgagaaaacaacatagagtgttgtccttgcatagaaagtgaaagtaaaatggtctgattccaaaacacaaatctgtggccatagtttcctgcctataggaaaatcacagttcagtctcttggcattaactgtctggctccaaataaaaataagaaaggacaacccctacactgtcccagtaacacggcgactctagtcctgaagaccctttcacttcagtgacctcctaatcctgcctcactttccatagcactggccaagatttctgaatgcttatagattattacagaatgtgttgtttctgttttaatttacacacatacacacacacacacacaaaatagtggaggagtctgaggttttagtgcacacatcacctgagcagtgttcattgtacccaatatgaagtttttcattccctacctccctcctgcccaacgctttctgagtctccaaagtccatcacaccatctgtatgccttcatatagctatagcttagctcctacttacaactgaggacatacagtattaggtgtttcattcctgagttacttcacttagaataatgacctctagctccatccaacttgctacaaaagacattacttcattcttttttttatggctgagttgtattcatatatatatatatatcacattttctttatcattggctgatgggcacttacattggctccatatctttgcaattgtgaattgttctgtgataatcatatgcatacaggtatctttttatataatgacttcttttcttttgggtggatacccagaagtgggattactggatctaatagtagatctacttttagtcctttaagaaatctccatactgttttccacagaggttgtactaatctacattccaccagcagtgtaaaactatttccttttcaccacatccatgccaacatctattgctttttgactttttaataatggccattctggctgggataatgtcgtatttcattgtggttttactttacactactctgatgattagtgatgttgagcatttttatatgtttgttggacatttgtgtttgtatatcttcttttgagaaatgtttatgtcatttgcctaatttttgacagattttttgtttttttcattctaattttgttgagttccttttagattctagatattagtcctttgttggatacatactttgcaaatattttctcccattttgtgggttgtctgtttgctctgttgattatttcttttgctgtgtggaagcttttcagtttaattattttaattttgtggcttttgtttttggactctaagtcgtaaattctatacctaaaccaatgtccacagggtttttcctagggtttcttctagaatttgtacggttttaggttttagatttaagtctttgatctatcttgagttgatttttgcatatggtgtgagatacagatccaatttcactcttcaacctgtgactatccagttttacaaacaccatttattgaatatcgtgtcctctctccagtttatgattttgtatgatttctcaaagatcagttgattgtaaatatttaatttaattttggggctctctattctgttttacgggtctacttttataccatttccatggtgttttggtaactattgtgttgtagtataatttgaagtctggtagtgtgatgcctccagatttgtcctatttgtttagaattgctttggtgattgtttcttctaattctgtgaaaaatgttattggtattttgatatgaattacattaaatctgtagattgctttgaaaagtatgatgattttcgagatattgattcttccaatccatgagcatgggatgaatttccatttgtttgtgtcatctatgttttttttaaaagtttcgtagttctccttgtagagatttttcaactacttgattaagcatatttgtaagtattttttgcagctgttgtaaaagggattgagtccttgattttattctcagcttgatcgttgttgatgtataacagtgttactgatttgtgtacatttactttttaacctgagactttactaaattcatttatcaaatctcggagtcttttggaggagtctttgggggttttaaggtggacaatcatatcttcagtgaacagagatagtttgacttcctttttcaacttgggtttcctttatttttttcttacctcattgctctgattaggactctggttacaatgttgaatagaggtggtgaatgtgggcattcttgtcttattccagttctcagagggatgcttttaacttctccttattcagtatgatgttggctgtgaatttgtcatatattgtatttttaattttgaggcatgttccttatatccctagtttgtttagaattgttatcataaagggatgctgaattttaacaggtcctttttctgcatctattgagctgatcatatggttttagtatttaattctgtttctgtgatgtttcacatttattggcttgtatacattaaaccatccctccatcccagggagaaaacccatttgataatggtaaattactcttttcatgtgctgtttgattcagtttgttagtattttgttgaggaattttgcatctatgttcatcagggatattggtctgcaatttttttttattatgtccttttcaggtttggtatcagggtgatagtggcttcacataatgagttaagaggaaggattccctgtttgtcagtcttttgaaaaactttcagtaggaatgataccaattcttcactgactgtcatatagaattcagctgtgactccatctggccctgggctttttgtgttggtattttcttttttattactgattcaatatcactgcttgttactaataacaagcagtgttacttctattactttccgattcaagctaggagggttgcatgtttccagaagtttatccatttcctctggattttctagtttgtgtgcatagatatattcatagcagtctcaaataatcttttgtatgtcagtggtgtcagctgtaatgtctccagtttcatttataattgagcttatttgaatcctctctctacttttctatgtatatgatagtgtatatatatatatatatgtgctagtacataaacatatgctagtgtgtgtatatataaatgctagtttatctatctatgcactatgatatataggtgtatctgtatagatatatgttagtgtgtgtatttattttcctgatgaaatctttattagctgactttatctcttataatgcttccttgtcttaagacacttacagtgaagcggtgtcatctgaggtaaatacctgaggttcgttgtctcatgccagggaaatcgaggacatggacacacaagaagtgagtttaagagcagagatttaaaaggcaaaagaaagagaatagctctctcttctgcagagagaggcttctgagtgggtcttctggttttgtggtgaagtgcacggggttttatagatgagcttgaggaggttgtgtatgatttacatagggcccgagagactggttggaccagatgtgctgtttgcatagcatgcaaagaagctggccatctcaccctaatcttttattatgcagatagggtctctatctggccggcgccatgttgcctgcctttttactgcacacgtggtgacaaacaaaagggaacagggaacctccatgttgaacatgcctggcccccaggtagccttttcctattggcacagctgctggcatttacctacgcaagattccagcttgcttatttatgtctgcagcttgattttacaggcttctctttcctagaaaagaaatgatttgggggttgttttttgttaaaagggacaccttactgaggactctcttaacctcattatctgcctaaataatttctttccagctcttgtatcaaccataaggccaattcatgggcgtgtgttcttgatgtttttcctttccctttttctcccattctgttcaacacccacatggctttcttcttgattccctgaggatgagataagttcttgttttcctgaacactaaggatttagcccttttaggtcccagattcccctttctgggcaagctctaacttttgacttttgtacccctctttctctctttccctcatttttacttaagccagataatctaatcacccaaaatgaagaaaactcaaagtcttttggggatgagagagaagatgaggttaattgttctttgttctgctaagctccctggattttcactttagggtaaaactttgacttggaattttccaatagttttgcttgctctttgacacttttaacatggttttaatttcttatattcaaagttttgaggtgtgtgtgtgtgtgtgtgtgtgtgtgagtgagagagagagagagagagagagagagagagaatttatctaaatagcttaccatttccaaaaagcaaaatttgacagaaatagtactctagcatggaactgttgaggctcagaaaatgatactcaaaagtatggtgctttggcatgctgaatattttaaattaaaggagattggaaggcatcacaatcaacatctctctgactttctcctgctactctatctcttgcccctctttctccaccaaagtgagtcatagaaacaagaatttctcttcagcaaacagcaaacagccagtgcagtccacagaacaatgagctgattaaatctattttctttataaattaaccagttttaggtgtttctttatagcactgtgagaatgggttaatacagaaaattggtaccagggaagtggggcattgctataaagatacctcaaaatgtggaagcagctttggaactgggtaatgggcagaggttggaacagtttggagggctcagaagaagacagggagttgagagaaagtttagaactttctagagatttgttgaatggttgtaaccaaaatgctgatcgtaatatggacaatgaaatacaggatgaggtggtcccagatggagatgaggaacttattgggaactggagtaaaggtgactcttgctatgctttagcaaagagactggaggcattgtgtccctgctctagagatttgtggaactttaaacttgagagagatgatttagggtatctgttggaagaaatttctaagcagcaaagcattcaagacatggcctggcttcttctaactgtgtatactaatattcacgttcaaagagataacctaaaactggaacatatatttaaaagggaaattgaacacaaaattctggaaaatttgcagcccagccatgtggtagaaaagaaaagcccattttctaggaaggaattcaagctggctgaagaaatttcataagaaaagaggagctgaatgttaatagccaagacaatggggaaaatgacttgaaggcatttcagggaccttcacagcagcccctcctgtcacaggcccagaggcctaggaaggaagaatagttttgcaggccaggcctagggccctgctgccctgtacaatctccagacactgctctctgtgtcccagctgctcaagctccagacatgactaaaaaggccccagatatgtctcaggctgctgctttagggggtgtaagccacaagctttggtggcctccacatggtagtaagcctgcatgtgcacagagggaaatagttgaggcttgggagcctctgcctagatttcagaggatgtatggaaatgcctgaatgtctaggcagaagtgtgctgcaggcacagagccctaatggagaacctatactagggcagtctggaggggaaatgtggaattggagcccccatggagagttctcactgggacattgcctagaggagctctgagaagagggtcatcatcctccagaccccagaatggcagatccagctggcactgtgcacctagaaaagccacaggcactcaacacctggctgtgaaagcagccatggaggctgcaccctgcaaaaccatagggatggggatgcacaaggccttgggagcccaccccttccatctgtgcagcctagatatgagacatggagtcaaagaagattattttggagccttaagatttaatgacttccctgcttggttttggacttgcatggggcctgtagcccctttgttttacctttttgttcccaagactaaccaattactgaacggatggctttgtcttgatgccattagccaggatgatccttatgctcaaagggacaagcaacaccaggttcatgattcaaactgcaaggttttacatgcacttttgttcagtgtgagatatacttaaggcaccacaaaacaaaagttagtgtttggttgtcacttctttgatgagcaagtctccagagaaccttgaagaagaacttgttaagagactaggacaaaccaacccacaccaggactcggagagaattctcagcaggtattaggcaccagccataagcttgagtttctggtcaggataccagtttctagtaagggaaatagaaagaggagacagctccaaattgaagaggggaccttagaatctgtaagtaattgttataggaaggtggggacaaagtttaagaaaaaagcccatgtcccagcaggacagttaactcgattctgaaccctggtgtattaaattttattttcctccagaagaaggcaaaatgattctacttttgtttttctgtcagctctagcatacatgtcaaatggtggaagtgagaataggtaacaaaaataacaaaaataccaaccttactagccacagtcaacattggtttgtactcatcattgtagaagaaataatctctgtgttttgtttgcaaataaatatattagagtcataaattaacttttttgcaaacagccttgaaaggagaaatttaaaattaaaacactttcttatgaacaaataaatccatgtctcatatagtagatgcattagtaaatatttagcaatggcagacatagacattaagctaaacatcaaagggctattttgtactttaagatttggtaagtaaatccaatttactgtaaaaatactccaacaggcaacattttctataaaaaagcatgtgcaagttcctttttgtaattatagtctttaggttaaggattatattctcaggaaataaaaataataatctgcaaataaaaacaatattacaggagggtttcttccatctgcaacacatttgcctccaaatcaattttataatggcagaataaagaatatgtatagatttgttaaatcagtacatggctaatcctttttgtatcttgtgcgtttatggtaactgatttgtaaatatttctcagttttctctatttactttcaataaagattatgaagagccgtgtatcctgccttcacaaaagcatgtgtgtcaaacacaatgatttcccctaaaattatttctctcaataatgttgaaatatgtgccttatcattttattttaactaaagtggatcacaatacagttactctttgacttatagtggggttatgtcccaatatccattgtaaattgaaaatatcataagttgaaaggtggatttttatacacctaacttccagaacatggtagcttggcccactctaccttaaacatgctcagaacacttctgttatcctagagttgggcaaaaacttgtggcaacatagtacaatgtagagtaacagttgtttatcctcctgattgtatgtctgactaggagctgtggctcattgctgctacccagcattgcaagagagtatcttatcacataacactagccaagaaaatatcaaaattgaaaatacaacgtgcagtttttactggatgtgtattaattttgcaccaatataaatttgaaaaatcttaagtcaaaacatcataaattgggcaccgtctgtatttggtatgtaaacatttgcaattccacagggatattatgtatataggatatatgtatttctatatatccaaggtaatatgcttaggtgttttaaaagtattattttatttgaccttccttaaaactttacaagctaggtgttcttattcccattttacaaataaagaatctgaggattagaatggagctgcatacctagcctgccccagagcaggaattggaatccagacactttgcctccaaagcccttcctcaaagatgtaggagaaggtgatctaaaacagtgcaatggtagagatcacagtccagttaggaaaagtgcactcattacacagtgttccacatgaagtccaggccttagtggatacttttgaagtcacgtagcaccgtcacctatgtgtaaaccaccaaactgaactcaagtagactttggagttgtttggctaatgtctgattttatagacacaaatgttcctggtgctttctgtgagttgacttacaaactgcagggaactgatggcattgtgtctttgtgatggctgcttgttttttgcagagatagagacaggccgatgtttcacagcaaaaatcctagggtggtcggaggcagggacacttacactataaaataactcatttgcattaaataaatccttagcaattaagacaacttgtaagcatattttaatgccactgctctttcaaaaatagtggtgaagtttcttttttttagaaatagataggttgcagacaaattgtatcccatttttattgaaatttgctatagtagcaaagtaatgtttgtgtcaagatataataatattctatttaagaatgaaactcattttcatttatttaaagggaaaaacaatagtttggggatgacatttaaataatactctaatttaccatatgtcattatcttcagaaattagtagattactgtctgtgcagaatacaatagttctattgactcaaagaagaggagtactaaatgatatttaaaggtcccttaaaactaattttatgattatatttaaaaaatattgatatatgggtaaccacaatagagtagggtaaggaacacagagctgggaatccgaaaattgatattctaattccataatttgtaaaataacaggaatcaagagtaagtcatcatctcatttgactaatgtctctcatattgaatatgaggatgctgaagtaaatcatttataagatgactttaagctgtaaaatctacagctttaatgcatttgaatctcactgcattaagatgattttggatcactttgctcgagtttgcagttttaaatatcagatcaatggtataaataaaatataaaaataagccttttttttttacaatttaatgtatctatacacctgttctgtgaatataattcgtctatatttccagaaaaaatataagttagtcagtcagcaggatataaaagattcatttatacaaaaaataaacttacagtacatacagcctgggtgttatatttgaatgattatgtcaatattgtgagaaaaaaagaaaatatctgatgtaaatataaagtatatccttttgtaattataaagaatatccttttcctgctcttaaaaggaaacatcgtaaatggttaagagttagcaatattggctgggtgtggtggctcatgcccgtaatcctagcactttgggaggccgaggtgagtggatcacgagatcaggagttccagaccagcctgaccaacatggtgaaaccctgtctctactaaaaatacaaaaattagccaggtgtggtagtgcgtgcctgtaatcccagctactcaagaggtgaggcaggagaatcgtttgaacccaggaggcagaggttgcagtgagctgagaccgcaccactacactccagccttggtgacagagtgatactctgtctcaaaaaatagataaataattaatagttagcaatattattgaatgtgcaaagaagtactgaacacctcaactagtgccctgaacataccatttgatgtcataaccaagagcaagcagttttagatacatgagaagtctcacaaattagagtacatgcatttatcaatgccaatttttataacattccccaatatcttgccatcatgaaccactaacattttcagagttttccttgatcatcttgagggcaacccatgacaccctggaattaacagcaccatttgaatgaacaacattatgaagtggccaacaacactactttgcctctttaggctaagtatgacgtcctttgagcatggtctcaacataagcatttttatgtctcacttaactcaagcagggatcaagtaggattagaccctgactgtagaaataaaagttttaaaatatgttttcatgaaatatttacggaatcatctaatctgttgttggctggattaaccaaatttccccccacaccccttctgcctgaaatacccttatgctcattttgtctatctgaaaaattcctctttactattccatgcaagatcaaatattgtctcttacaggaaatctccccatacacccagatagaatcaatcatgtcctttcctgtagtctcatagcatgttgcatacagcttctttagagtactcacaggctgcattagagataattgtttatgtttgtgcttctcattgcttagaatttggtagaggagtggttcatcatggcatattcctggacaatgaaaaagtgataaagaaccactaaaataaattgaaattggattgctaataaaattcaaacatttccaaagctgtttgcacaaatttatggtatgcaaaccaatatagattgtaccccagagtagagatttaaaaagaaagaaggaaaggaagaaataaagaaaggaaagagtaaaggatagagaggggtaggaagagaggaaagaagaaagaagagaagaaagaaggaaagaaggaaagaaggaagtcctttgtcagtttttattcctatatttggtatcattcatatatgatttcgtggtgtagctacatgccatttcaccaaccctgatacagtaagctagtgattgcagtagttaataggttattttcactaagaatacaattatcctacatggatatagtagcaaaaccttgctaaaaaatgcataaaacctttttgtcctgattttcaatttggcaatatatttctcagtttactataagttttctgatctccaattttccatttttcttttaatttttcagttttatattgtggttttctgaaatagacatcttaaaaatacatgacgaacttttaaatacgataatgatctaaatcactcattcacagaaaaggacataattttgtaatacttgatctcagaatttcagatttcagatttcagaggtatttttgatgagcattccttcacagaaagttgaatattatatggattcaatggagcatgaggttagtatgggattagattatgataatgggacaaaaaaaaaacaaagaaaactataatttgcaatttatatattctgaacaactaaaacaatttatgaagctgtaaatattaatttgtacaaaacagacagacaaattttcaaggtaatcctgccattaatcttcccatgggaagttagttctttctgtttcattgtcatatggatcattttttcatcctgctgagtagcctgagtggtgtcttctccctgcaatgacttttaggttaactttcacattttctggcttcatgatatatcttagacatattaagacaagggtcatgtaatatttttatcaatatttcctctattatagatttatttctctgataatgctgataatgagggctttgaaaggcgatctcataactcttctgattatttttctctagcttttattcatttcttattgcattacattaatctttgatgtaaatattgctatgaacatcaaattactctgctttgttttcctgaattgaactgctttcttcctgcaaacaaactctcagatgttggctttgttgctgagtatcactgatattgaagctgacattcacataaactataatcactggcaatatctacatgatttaatttaaacaatgtgtggcaatttcaatattccacgggaaaacaagcatctattagaggacaaagaggattgttcttacccagatagtaaacattaatgttaccaccttccattagaataaacaatgttgtgcattatctgtttatgaataggtactaacctgtttcaccatatcagatttcattgttgacatttggtttaagattacagctgttggcttcatggcagtgtttcagaatgcagatgtgactagactggctaaacaatttgctctggcctttcaggtgcctgggtgtgaagtcagggaagtttatagcaaaggcccttctaaacaaagcctttgctgttttccatctaaattaagaactaaagtggaagccaaagcacaacaaatacaggtcaagaggtcaggggaccagttctgccctgcttgctgcttctgatggacatcatttctgatgctctgtggtcactgaggtgacaatggcatggttatggggcctggatagcattttagttgcatgactcctgtgacgttaaataagtcacctgacctcttaggacctcaaattcatcatctgtaaaatatgacctaaaagccctgccttttaacaagagcgttgtgaaaattatataaaataattatgcaaatattttggaagcaggaaaatgttataaaataccatttattgtcattcattcattcattcattcctccacctattcaatatctattgagcatcttccttgcatctttggaccttttcttttgtctcttgggtcgctgacaatccaccactccctgtctagccatatccacacctgccactctacacccctgtgtcttaactttccttgatttatccttcaagactccggttaagtgatacctttactttccctatccaatgcatgcccctctcaacagttaattattccctctttaggctaatattctaccaagtacataagcaggattttatgttttattagaattgttctgggcccctcttgtttttgaaaggctttgctctcaaagagtacatgttcatctttgtactgttaatgctgaccagaggatgctgagagactgaggaggtatgatggaggaacagtgtggaaagaggctggtaggtgtggtccatattatttcagcttcaatgtgtattttgcagaggtggcaaggaaggcttaaacctatgctttgtatactgcaggatttatgtctgtccaggcagtctaaagaactagtcatgtgaatgaacaaagtcctgtttacaagaaggtcttgagaaatttctcagagataatagtttttaaaagattccttaatcaataaggcatgtttagccttaatctgttagcagaagaataattcttattccagagtagggtgatattcagatgcctctaaacagcatccttttatgaactcgtctcttaactcgaggggaataaatgtaagatatcaaagagctaattttagtaaaacacctctttatgaaataaaagcagaatgcagtggcaccttgttatttcccaacttccatccaacataggatataacacagaagggaagagaaattctccctaagttctcaacagaatagagctttggtacctcaggggtcatgggacatcagcagtgatagccagcagaagaagcctgggcttcaattatagccacagtatccagaagaaggaaaaaaaatgccaatcaaaagtgtcaagaatcatgtggcagcattgttcacctttccacaaagcctcacctgaagacaggtgagaacaggatgatgattaagtggcccaagactctgttcctaagcagtcacttatttgctcttagacatcccctacactttcattttccccagccaatgtcactctccatttcacataatcctctcatcccataatttagtgacatcttttattccttcatactgttgtgtaaattccttttagcttgattcctccctctgccaggaaaacattatcagcacctttgtgacccccaagtgcccatacaattctgtcctctttttgctagacccaattcaagtgattccttagtgatgatctaggagacactaggattgcagggggcttgtcctccatcctctgggccaggggctgggaatgtgggttcttgagacagagtgccctggttttaacgggaattccacagtttatctgctctttaacaaattcctgtctctaaacctcaatttccttatctgtaaaacgagaccacagatcatatccacccatggtattagctggattcactgagttcatgcagaaagcagttaacacagtaagtagcatgttgaaactgttcaataaaagttagctatgcttattattcatttacctgctgagaccagctcggtcggggagaccctaacccagcagcgctagaggaattaaagacacacacacagaaatatagaggtgtgaagtgggaaatcaggggtctcacagccttcagagctgagagccccgagcagagatttacccacatatttattaacagcaagccagtcattagcattgtttctttaaatatcagattaactaaaagtatcccttatgggaaataaagggatgggccgaaataaagggatgggttgggctagttatctgcagcaggagcatgtccttaaggcacagatcactcatgctattgtttgtggtttaagaatgcctttaagcagttttccaccctgggtgggccaggtattccttgccctcattctggtaaacccacaatcttccagcgtgggcatcatgaccatcatgaaaatgtcacagtgctgcagagatttcgtttatggccagtttgggggccagtttatggccagatttgggggggcctgttcgcaacattttcccactccattttgtgaacccacaattacttttccagataggctaggaacttttggggaggagagaacggtctctgtatttctttcatctttatatcgccattacttagtacaatgccctggcttggcttgtaatacacgtacaataaataattgctaagatgcatgcattactgaataattaactgaatgaagaatatggtaataacatatggactttttatatttgttcagcaggtgctgtcttcaagaatgacaagtagacagaggaaataatgccactaaaggagagttgaagaaaatcaagtctgtagtgttaattctggggttatatggatggttcctccaagaagtcatttgtccagcatgactttttgcagtcagtagaatatggttaaccaagaacttgatgtctctctattgttctatttattattccattagttgcttaccctttaacctttttaaaaaagttcttgtatagttttacttccttttatcttagttccagatagtttaacttgttaaaagcattataatttttttagccattgaaagactttattctattgaaaacaataaaagccgtgctctcacgcctctaatcccagcactttgtgaggccgaggcaggcagatcacgaggtcaggagatcaagaccatcctggctaacacatgaaaccccacctctactaaaaatgcaaaaaattagccaggtgtggtggcaggctcctgtagtcccagctacttgggaggctgaggcagaagaatcacttgaacttgggaggaggaggttgcagtgagccgagatcgtgcctctgcactccagcctgggtgacagaatgagactccatctcaaaaaaaaaaaaaaaaaaaacaaaaaaaaccccagccctgctcaacatgacatcatttgttaaaaaaatcccatgtttccccaaagtgtacattgttttgtttactcttttagtttcttacatttatttgcttcctcattttgaacttaagtttcctttttttggtgccagttttctggggacagtctcatactgtccttttttattttaattaaacttaaaattttgagattattgtaggttcacatgcagttgtaagaagtgatacagagagagtctacgtagctattacccagttggttccaatggtaacagcttgcaaaattatagtacaatatcacaatcagaatattgacctctatccttgtgatgatggaaatgttcctttaaccttttttttttctatactttaagttctagggtacatgtgcacaatgtgcagatttgttacatacgtatacatgtgccatgttggtgtgctgcacccattaactcgtcatttacattacgtatatttcctaatgctatccctcccccctaccaccaccccacaacaggccccggtgtgtgatgttccccaccctgtgtccaagtgttctcattgttcaattcccacctacgagtgagaacatgcggtgtttggttttctgtccttgcaatagtttgctgagaatgatggtttccagcttcatccatgtccctacaaaggacatgaactcatccttctttatggctgcatagtattccatggtgtatatgtgccacattttcttaatccagtctatcattgatgggcatttgggttggttccaagtctttgctattgtgaatagtgcacaataaacatatgtgtgcatgtgtctttatagcagcatgatttataatcctttgggtgtatacccagtaatgggatggctgggtcaaatggtatttctagttctagatccgtgaggaatcgccacactgtcttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatgatgagcattttttcatgtgtctgttggctgcataaatgtcttcttttgagaagtgtctgttcatgtccttcgccattttttgatgaggttgtttttttcttgcaaatttgtttgagttcattgtagattctggatattagccctttgtcagataggtagattgcaaaaattttctcccattctgtaggttgccggttcactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctaggttttcttctagagtttttatggttttaggtctaacatttaagtttttaatccatcttgaattaatttttgtataaggtgtaaggaagggatccagtttcagttttctgcatatggctatccagttttcccagcaccatttattaaatagggaatcctttccccatttcttgtttttgtcaggtttgtcaaagatcagatggttgtagatgtgtggtattatttctgagggctctgttctgttccattggtctatatctctgttttgggtaaactcacatgttgcttttttcttttaaatgaacagtgaaccattgactagaagtaaaatatataaatgagaactaggaaatatgaataagtctcagagatagcaggcattttcagtatataaaaaaaaacaagttctttcaaaggctacataggaagagtcttttatttgaatgagacaaatatcagtatgagcagacttccacaagtctcatatctctttattttgttctcttcatcctgtacttggttagccatattttggtctattttcttttattttttctaggcaaagtttttacagaagtataacagagattcagatgtgtaacagattataggtggacaacttgcgtttttagaaaatgaacatacctgtgaagccagcacccacatcaagaaacagaatatgactaccctgtccaaaactccttcctcatatgacccttcagtcactacccagcaggagcctcaaattttacttcttttatgaaatattttaaacacagaagaaagaatactctcatgaacctctatgtacccacaaaccagcattgtcaaaacttagtatgataccacattccacatctgctgtagctcttttttgtttctttctttttttttgaaagaaaaattctaaatatacttccgatatctcagataaatggaagttttaatgaacaacattcactgcacatacataaatatctttaaagcatctaccatgtgccaagtcattacacatggatgtcctctattttaaaataatacatgtacataattatgaaataaatgtaaatgattcaaaaattatgccagaaaaatacatctcctttgcctgtgagaatgtaaaatgctgcggcctctgtgaaaaaatctgctggttcctcaaagttaaacgtagagttaccatatgacccagcaatttcacccctaagaatatatcccaaatattttcaaaaagagactcagatacttgtatgccattgttcatagcagcattattcacaatagccaaatgtacaaagtgcccagcaacagataaatggataagcaaaatgtgatatatacctagagtggaaaagtatccagccataaaaagaaaagaagttctgatactgctgcaacatggattaaacttgaagcattttgttaagcaaaatgagacagatacacaaaaaagaaaaacatgtatgattagacgtgtataaaatatctagaataggcaaaatcttacaaacaaacagtaaattagaggatagcaggggctaggggcagggaaaaagttgaggagttattgtttagtgggtacagactttctttttggagtgatgaaaagttttgacacagatagtggtgatggctgcacaatgatatatatatataataattgtcactaaattgtacacttcaataataattaaaatggcaaatatgttatatacattttatcacaatgaaaaaagtaaaaaaggccagatgtggtagctcatgcctgtaatcccaacactttgggaagccaaggcgggaggatcacttgagcccaggagttgagaccagcctgggcaatgtagggaaaccctgtttctacaaaaaataagccaggtgtggtggcccactcctgcagtcccagctactcttgaagctgaggcgggaagatgactggagcacaggaggttgaagctgcagtgagtcatgatcttgtcactgcactccagcctgagcgacaaagagagaccctgtctcaaaaaaaaaaaaaaaaaagaaagaaagaaagaaagaaaaaggaaaaaaaaaacccatagatagcatagatagacaataattgcagacagaaggcaacaggataatatacttatattgagaaataataagttcaaacctaaaaatgtatactcaaataaacaatcacttacaaatacagggccaacaaagacctttcagatgaacaaaagacacattgggggaagatatttttaattcaaataaatgataaaatattagtatctagagtaaattttttgaaagcttataaatcatcatgaataagacaaatcaagagagaaatggacaaagtatctgaaacagcaattcacaaataaaggaaacattagtgatcgataaacacaggaaaaattgtttagcctcatcctcctgcctcagcctcctgagtagcttagcctcattaggaatcagaaacatgcagagtaaaacatcatttatacccatcacatcaggaaaaaaattaaagttggataatatgaaatttggtgagatttcagtgagaaaagcactattatactttactaatgaataggatcatataccgtgaaaggcaagttgttaatacacatatcctgaatttagcaatgacacttctgagtatctaccaaaaagaaatagtccacatgtaaacaaggaaacaagcacaagaatgttcattatagcattgtgttaatagaaaacttttagaaaccacactttggatattaaaatggctaaataggatttagtgtatcgtggaatataatattctgcagcatacaaaatgaattaactggctctctacatttatcaacaagtacacatgaatccataaaatttagagaagaaagcaaatttgacactaattacatgcataattctaccatttatatagaaaaacacaaaacagtgttgtatatttttctcgtacatatgtggatgcaaaattaagattttttttaagtgtaaatatatttctgaggagtctggaagggatcagaatagaggatagtcaaaggagactttcactttacctgtactcatctatttttttgagtgtatgttagtatattgcacatgcatttttttaaaaattgggaaaaaatctttctgagaagaaatgtagtaaattaatagtggttacctctggaaaggagcgtagaagagtattaggtggtcaatgggaaactttttctctaattttctaatttttttctatctttaaatttttttctctcaaatcttctgcattttactcggtatgtattcacatactacatgtttttaaatgttgagcacatgattgtaagtttcctgaagcctccccagccatgctgaactgtgtgtcaattaaacctctttcctttataaattacccagtctcagttatgtcttcattagcagcatgagaatgaaataatacacataccaagcctgacagccaatctggaatgttgatgttgtttacatgggaattgcactgaatctgtacattgctttgggcaatatgaatacccagattttaaggaggtccttgatagtcctggagcaggaaacacaccctggaggatccttgatcatcctggtctctcccattcatgtacgattaatagaatatatttatgcatattcaatgcttttgtaaagaaaatttgaggttttcactaatttatatattttaattctcttttgtgggatagatattatcttacacattgcttgaaattttaacaagaggtttatagtcaaagtttttttcctatgttgttcccacccatattactctcagtcaccaaggacagcacatgtcatcagtttcttctagagttatacacattttatgtgtgtgtatatatataaatatatgtgtgtatgtatatatatatttcatatagagtatatccatctactaccccattttttcttgcatttactttactttttaactcaaaacaacttgaagtttgcttcttatcagtgtatgattactttgttgatttttcaatattttcttctgtgaatgcacagtaatttagagagcccatcccctactcacgaacatttgtttccagattgctattacaaactttcctacaagagtaatcttgtatttatgtcatttcacaacaatgtacgcaagtataacttcagaataaattcttaaatgtggaattactgattccaaggataggagcatttgcaattttgatgggtttaataaaatttatattcccttcagtaattatgaacttgccttaacccattacatactcacagaaacattaactaatttatccttaaccaatatattccatttgatttttacttccacttcagaagtgtaaatatctaattgacactgatgtaatgttgatttattttttaacacatgagatttaataataaacatattgcaaggggtgcatttatatatggtttatttgtaatgttaacatgactagttgaaaaatcgaaacaaaattcagtagaacaatctttaacaatgaaggaagacatctgagaacagtttctttccaaactgattgatttaataaaaaatgattttgcttcctattaaagtatctaaaaagttttgtagattccaaaatatttacttgattaaactaaaagttattaccccttacttttattaaatcaatcctttctttttctgaagttgttgctacttctataaatatacatatttatatttatatataaatgtaaatatagatgtatatataaaatgtataaatatgtaaatgtacatatacacatatttacatataaatgtaaatatatataacatatatacatatgtaaatatatacaaaaatatttgtgatatgtggtaccttctggcctaagcaatctgaatttgaatcctgtatgttggcaaacttttaaaattaattgaatcactaattaagttgttactaagaggctttgttttttgttttatttttgctttaaatttaacatctaaacatttcccctattgggatcaggggagcaaaagagatgagagtacccagggttgattgaatccttgtatgatgtcctggtgactacagaagtgctaataatgggtgcccagttacagattatcagtatcaacctcagcatttttagatcactattcctttgatgtgatcttgggtgtgcccaaccagtgcctaccaaattactgagcctggtactttacccttcctgcagattccatgctatctttgtaaaaaacttcttttcctgcctaagtgagccatagttgtcacttgttttgttccaagtgaaaatcttgactaaactcaatagtaaacaggcatgcatttaatccttgatttataattgtttgaattggtcaaacttatatgatgagtgacttataagcagatattgactattaacatgttatcaataaaaggcattacagatgatacaatacagattaaaacctgtatgttaattagagcttgtagtccatattgaaaaggaagtgtttcaaagttttattgtagtgtcatttcataccaatgtacactgtaaagacacttacaacttcacactttaagtctgacataagcagtataacttctgagcaattttttgagagaggatttctggaattctttcagttccttaagattacagttgtgtctgcctccatggaactttatttcccatctatgtattcaagtattctcaagatgaaagaactaaaggggaaaaaaacattgtaccagtcatttaggcacttgagagtaggtattatctccaaggggaatacatatgaaagaatatgttattttccatgatttgcatttagaaatattaacttagattttcttccaactgaagaaactaaaacagaaattaaaagcaacagtatcacatctctatagcaaagaatataaggattttctgttccataacctgaagcctatgagtgttattccctgcgaaaggtatttatcgatcattatatttcaggggaattcatagaatgtatgtatctataataatgtaattgcctaaaagacagaaaaaaaaactgacaacagtgacttaaacacacagaagtgcatttttattacctaacctgtgaagaggtatcctgtgcagtaggacgtcctcagggaatcttggctccttccctcttcccactccattattcttcacttgaatttcaagtataaagaaagaagagccaaaagctttctccttccaaagcttgtttattgattttttgaaggacttttacatccatttatttacttaattactgctcatctggccattctggctgcaaggaacggtgagccactgctaattagctgtctactctgcagtggagaaaggcaggagaaacgggattgtaaagaacttttgagtagccaatgaacatattcccccactgtatgtttccctgttagagtaagtttaaagcacttttaatgaattgaaacaactaatcaaacttgctttttgtttccatatttgatggtaggtttatctgaaaggacccaatcattagttgttttgctgacacttggataaatatgtagagaaggactagtgcctttgggaaaattacacaataccaaaattttaaaaaatatacttggccaaggaaatattttgcttgtgaagcagaagcgtgaaaaagttatctaagagttcaatttctgtctgggaagtgtgtatttgtttcctaaataaccatgagtgcagaccaagtcttataatgccactttcttcaaagaagcaacgataggtcatttgaaatttgaaggtcatttaaaactctgccctagacaaatagagtctgattttgtcaaatatattcatgcttttgggatatggcacatttgaaagaaaagcctacattaaatgtcatgcattactttagatattaaataaaaatgaactctaagtacagttttctaagaatctatagttccctttttttctattcaattttattttttcagaaagctgttccttttttgtcagtttaattttgcttgctggtgcagactgtgttgtgatatgatatgctgatttggtctctcttctcatgttatatgatgtcacccaataggggtctgcattgctgaattatacttccctttggatatgtcaaacctgtggctctaatttactttttgtcaattatgactttgagagcaaatgaacctatgtgctgaagacacatgtatatgttgcctcaacccctacacctccacacacattgatgtatttgtagaaactcaaagaaagtgagtaattacaaagcatttgatgtaacattttcacaaattggtcttcataacttgttatgcattccactttctcaacttttttaaaaaaacacacaatatataataaataggtgaatagggacaagctgtttcttacagtataattccaattaatacatgaaaaaggaatgatgaaaaatgaaaattttatttagtcaaacactagagaaccatcactggatgctaaaattagtaggtaaagtgtgaccagaaacagaatacttgcctcatcacaaagtatctccccacaaaatacagattaatataaagtgaaaaatggtaactttacggtagaggaacgtggcagacagtaacttacccacctgaatacatttcacattgccagtatgagacagtctttctgcacctcttcctgacaggatccagagaagggcacagcatcacctgacatccttatggctctgcaggctctcctcagaatacagggctccttcacatctctttttgctaaggtgacctccaagctcatatttcaaccttataggtatatcttgcctcaaggccaaggaattctcaatttctccaggaaatttctgcgaatattttatacacagaaggctgagttagtgtaataggggatataaacagaataaaacatactgttcagcctccccaagttcagagattaaccaacgatgcataaatctgagtatgtaaatataagaaaaatgtaaccaaggtctatgatgcaggtagaagcagtgtcaccagcactagtgagctagacctagacataatgagcactggttactatgtttagactcttccatggttcacacttctggggaagacatgcatcctcacttaagaaccataaaatcacaagacagtatgtacgaacaaagggaaagcagaaagttttggatgtactggttcaaacctatgctagactgtcattctgatatgatacaaaatattatcttctacttctcttcattcattttatccctcaaattgcccttccatgttctctctccccttctcgagcacattctttctattcttctgttttcaatgtggcaacaaaaatttcacaattatattgatatccatgacctcttatttttaagtcaacttagacttcacaattatacttttatgatctttagaattgataaccactaaaaaatgtacatatatatgaatgaatcttgaacaaataaacaaataaatatctctttaccctttgatgcataaaagttaaattaccacatgtgtttggaactgatttaaacattttcttttctgaaggtcagaatatcatcaagaaggatctttgaagtacattctaattttgtatcatcttcccgttcaaggcacttcaacaaaagatcgccttgcacttacacatagccatgaatactggtatcatgtgtcactgattagcagactgtttctggagatactgtgtagcaattgtattgtgcggatagtatttgaaaatggaggaccaaagagtcattcagcagtggaaacaatgagttacagaagctagggtatcattacattactggttggggaaatacctggaagaacaagttaaagattagcaaaaagaagttagtatagtacacaaagaaagtcatcaatttccctgtgaggaaaggagatagtaatacaaaaattacaaaatgtactattgctgtgtaaattaaattccttcattttccctgggagtactaggtttgtgttctgttttgtaataaaatgtaatgcacctcataaatatatacacctactatgtacccacataaatttaaaatataaaacattataataaaatgtattaaaactttaatcctgttttataatgtaatttaaaataaattacaattggtatatgtgtggtgtttaccttgcacaaataggtttctctcacacaatcttatgtgtttttcacaatagtcctgtgagattggcatggaaaatattttcactttatacttgagagagctgaatctcagtaagggctgatactttgtccaagttaaattggtctaacacacagcaaattgagttctcaacaccacacttcctgttccaaggaccatgctcttcacaaatcactcagctcatcagaaatctgctagagaaacaagctgccaatagttgttttctgataagttattgatctagactctttgtttaaattccttgacttttaagcaacccaaaaagaaataatggggaacttctagtacaacctaagaaaacataactttgaagatgttccaaaagaagaaattaagaatcaattggagccatgcattgtgaagccaaaggccttttctctatcataaaggtttcagggagagtgactacctttttttttcttccatctactcccctccactccctgcttagcaccaattatggatatcattgctatcttacagaatcccagggagatggagggcactaacaaatgcatcattcttcccctaacctgcttgttagtcaatcaaacatctaatttatatattgagtatgtcttgcagaatggtttatagatatttccttttataatattctccaggaagataggatacaatgcagacagttcaatagattgtttttacaaagctgtcatatcttcaaaaaattacaaaaatgtgctgcatccttgagagatagccggaaacagtgcaacacagtgaaaaaagaaaccatacagatgtcctttgagagcctttaacccatcagtcaatgtcctcctctagagtcacttctattcacagcactaaaatgaataaatatcctgtatagcatcttttaggtgaaaacagttcatgaagctgtttgacattatttaatttttagtgccatatttccacagctttttcctttgaggaaagtgtttatgtaagattatttattttaaaccagtgcactgatgttaaatagatgctcattcacacataggtgttacctaaacccactgacaatttcagcttctgactgattcattgttcaaactcctgacattttcctgaacctatcacaactcataaggaactctcaacaaactataaactgtccataaagagccactaaatcaagcagaacttttgtgtgcgtgtgtgtgcaatttttccatcttttgtgaggtataattaacaaaaaattgcataaattcaaggtgtacatgtcatgatttcatatacatatgcattgtgaaatgactaccacaatttaattaacatctaccactacatctttcccctcctctccccacaccctcagcccctaagaaccaggtttctactctgcttctacgagttttactttttatattttacatattaataagatcacattatgcagtatttgcttttctgtgtctggcttatgtcacttaacatagtatcctccagtttgagccatgttgccacaaatggcaggatttacttatttttttatggctgaaaaataccacattttctttatccatacatccatcaacagacacttctaggtatataaccaaataaaataaattcagtatcttgaagagatatctgcacccccatgtacattgtagttgtgtgatcatgagcttgagggtgcagatatctcttcaaaatactgaattcattttctttggctatttacccagaagtgggattgttggatggtatgttagttctagctttaattttcggaggaatctccatattgtgttgcatagtggctatatcaatttacatgtccaccaaaaatgtacaaggcttcctttttttctacatatttaccactttttgtctctcatctttttgataagtagccatctacacaagtgagagatgatatctcattggggttttgatttacatttctgtgattattagtgatgctgagcatcttttcaaacacttgttatctagttgcatatctcctttggaaaaatgtctattcaggtccttaggccatttgttacttgagtatttatttatttgtttgcagttgagctgtttgatttctttatatattttagatattaaccccttaacagatacatagtttgcaaatattttctctcatttcagaagtagcttttgaattttgctgattatttcccttgctgtggaaaagctttctagtttgatgtagtcctacgtgattatttttgtttttgttgctttgcttttggtgtcatagtgaaaattcattgccatgaccaataacagggagatttttctctatattttcttctaggacgtttagtttcaggtcttatatttaaacctccatttctagttattttttatatgtagtttaaagtaagtgtccagtttattatttttgtaggtgaatatgtagtttttccctaccatttatttaacagactatcctttgtccattgtgtattcttggtgtccttgtcaaagataacttgactgcacatgtgtgagtttattttttatctctatattctgtttcatttttttaaactttattttaaattcaaggttacatgtgcaggttttttatataggtaaacttgtgtcatggggtttgttgtacagattactttttcacccacgttttaagcttagtaaccactggttatttttcctgatctccctcctcccacctgccaccataaagtaggccccggtgtctgttgttcccctctatgtacccatgtaatctcattgtttagctcacacttaaaagtaagaacatgcaatttttggtttcctatttctgcattagtttgctaaggataacggcccccacctccatccacattcctacaaatttgtttattggttctacaagctctttggtggagtctttaggggtttcttttccttccttccttccttccttccttccttccttccttccttccttccttttctttctttctttctctttctttctttcttccttccttttctttctttctttccctctctctttctttctttccttccttccttccttccttccttcttccttcttccttccttccttccttccttcctttctttctttttctttctttctttctttctttctttttctctctttcttttctttctcttactctgttgccaaggctggaattcagtatccgatcttagctcactgcaacctctgcctcccaggatcaggatcctcccgcctcagcctcccaagtagctgggtctaaaggtgtgtgccactatgcccagctaatttttgtattttttgtagagacaaggttttgccacgttgcccagtatagtctagaactcctggactcaagtgatctgcctgcctcgggctcccaaagtgctgggattccaggcatgagctactgtgtctggccagtctttagggttttctatatacagccatgcatcacgtactgacagggtatgttttgaaaaatacatcgttaggtaatttcattgtgtgaataacataaagtgtacttacccaaacctagatggtatagctactatgcacctaggctcgatagtacagtttattattcctgggcggcaaacctgtacagcatgttaccatactgaacactgcagacaattgtaacacaatagtgtatttgtgtatctaaacacagaaaaagtacagtaaaaatacagtgtaaaagataaacaatggtacatctgtattgagcacttatcatgaatggagcttgcaggtctggaagttgctctaggtgagtaagtgagtgagtggtgagtgaataagaaagcctaggacattacggtacactactgtagatattataaatgccgtacacttagactacaacaaatgtattaaataattactttttgttcaataataagttgatgttagcttactgtaactcttttaccttatagactttttatttttttaaaagatttttactcctttgtaataacactttgcttaatacacaaattgtatagtagtacaaaactttttatatccttattctacaagctttttctattacaacaatttttttaacattttaaacttgtttcttaaacactaagacacaaactcacacattagcctagacctatacaaggtcaggaccatcaatatcactgtcctccacctccacatcttgtctcactgaaggccatcaggggcaatagtatgcatggatctgtcatcttctacaataataatgccttctactggaatgcttcctgaaggccctgcttgaggatgttttacagttaaccattttttttaaataagtgaattaagtacactgtaaaataatgatgaaaatgtatagcgtaataaatacaaaatgagtaacagtcatttattatgtttatcaaatatgtactgtacataattatatgtgctagatttttatacaactggtagcacagtacatttgttgatgccagcatcaccacaaacatgtgagtaatgcattgcatgatgaaggctaagatgtcttaggcaataagaatttttcagctccattataatcttatgggaccatcgttgtacatgtcgtctgtcattgatccaaatgtcattatgaggcaaatggctgtgtaaaatcatgtcatctgcaaacagatacaatttaacttcttccttcctgatttgaaggcattgtatttctttttcttgccttattacttttaagcagaaagattaagagtggaaatatctgaaggttgtgtgaccttagtagtaatcaagatgaaatgagtaaatgaaggggtgacattctattggctcagtgatatacctttctgactagtattttctatatgcttaggtcctcatttgttttatttgattatatatacacatatatgtattatatttttaaattagagggccgcacctttcccaatccaaccttaccattctcactaccattctcaggggtcacatgtaaaataagtgaaactacatcactttaaccgcttttttcaaagccatcactaattccagtggaattcctctgtcagtccttggttagtaaattatacctgctgaccccatgtagaatctcactgaagagtggggaaaattcatcactgttgggttaaaaatggcttatagaagctggggaaatattttagtttttctttgtgattgaatcacgtgatcaaagtcaatagcctgcaaacatgacttacatcaatatatttgctctgtttttgtttttttaagaatgggtttttttctcaccatgggttctgtagaactctagtttggtcaatttgcaagataataaatattccattagctacaatctccagggaaactgcaattgcttttaacaaattttgtctttattttattgaggattttggggagagtagccactttctttttctccactctcctcattttccttttcagaattgtaagtaataagtttaatttaattacctttttgcttgaaattttaaaacacaaaaatcattgtgtttggtatcattttagatcatctttacattcacataatatttaaaaatttatcaaccacatacctatattattttcctatgatgtggattcataagctacttgggtcaaacatcatctgctaaaattcaattttatgtagtaaatgcacatatatgtattttactctaaaataaagtacattactattagttcttgagcctcacctcaagctcatatatcaacactgcacaaactttgttctaggaaataccatttttactgagtatgcatacaagctcacagctctgaaacccaaaaacttcagaaattttcttagaaaatttggcaaacaattccttagtatctaaacttaaaacttaaaagagtgtgaggctatttatagtctttatttatcagagagtgaaactttttccacaaaactatagaaatgttgtgtttgattcgctgctggcataattatgtaagatatgtgctttccacctcattatatttctgaaatctgaaatattttggtttccaaatcaaatctgacaaaaaagtttcacgtaagagactgtggatcacacacacacacacgcaaatgagtgcattttgtgggacataagtttaaaaaattctatgtgaaataaagacaaaaacggtctctttttcatttcttaggtcttttactttgctcatttccttggactttccaaggattgatggagtatgcagtattttcagaatatttgaatgagtaaccactttatcaagaaatttcttatatgcccagtcttcagcaaaccttttttagaaaaccacataactatagaaagactaattgtcctgaatttggacagctgcaccattatttcatttctatcactcacaggaactttacatgcaaggtcatcaattctgtctgcattgccaaattcaatagccattattcagttctcatctttcctctcatagcattttacactgttgattgcctccttcttgaaactttggcatccaggacaccaccaagtcctttttttttttttttttttttttttgctacctcatttgctgctacttgggtctccttgatcagaacagtaacctctttttaatctctaaagattgaagcgcctcagaattcaaacctcagatctgttcttttctctatctttctttaccctctatgcaatctaattcccatctatattttgaaacatatcatgaaatgcccatctatatctgaaaaccctcagtagtgaatatgtaccctgaatctctctacaaataaccaacttcctttacttcggtggagtttctattgattttacttttcttttgtgattatctttacacagagataacagtttgttatatgtacagatgtagtcttcatcccgggtaattttatttaaacaatggactttccccatgtaaaccagaccttggtatgcatacttcagagaagataggataagctaattcatggcttttaagcttgaaattctgaagttttcaacaacagagttgagattattcttgagtatgcctgtacattatttcctgtctgaggccttggaatatggtggttattatctgcttcctctcttcccaggtctgttatctgcctttctcttctctgttctttgccccaagaggccaatcactataaaatggattattgaagatccctggatctcgcacttccagttgggttcagtcaatgggattcaccatcaggaggcaggaaaagggagaagccaaggtatttatacttcttgcttccgactaacttcagtgaagttctggaagtggctgtctcccgcagtgactataccctttttagttttcccctttataatggttccaggccctaaccaaagctccactaacactatttctttcccttatcatcccttctcacctggggttggggaatagcttcctgctttactagcccttaggtgcctcagtacctcttgtagagatactcatggtaacctcttctactctatttcagcatgctggtaaaagggaacttttaaaggctgtgtatcaatctgtttcctggacagaaaccaacagcactctcagaaaatataataaaataactattggcatagatgtgggcaaagttttgagaaatatcaaggtgagttgtaccttaaatatcttcatagagatctgattgaatgctttggatctgaaattatcatagagcatgacatagatatatctaaatatctggtttatttcttccttgttttgctagatttacatgcatcctgcctgagaattttactgcataattttcagttttcattattataaaagagggagactatagatgaaaataagtgctcaatgaatagttgaaactaagtttcaaaattttattctgagcccaaaatatatcctgctcctataaaaaaatgtaaaataacagacatatttatagatgtatttcattgaggctcagtagttgtgtatatatgaagaaagaaaacatgcaaaaattcagcagaagggaacagaaggatatagagcacaggcacagaaccagattttacatcactatttcatctattttaattctacaactaacaacattcagtgaataaaaaaagtgtgcagaagaattgaaattttaggaagtaatgaaataccctctagcaaaagattctaaactcaaagtttatcaagtaaataagaccaggaaaacttctatgtctttattttctacataattaggaaagaagagggtacttggatatttgctttagatagtagaaaaaaattaagttggaattatgggagaaaaaatatctgatctttcaatggcaaggaatatttctaagaacaagagaggacaagaaggcaagagggcatatataggtacagacaaaaagatattttaataaatatataaatctagaaatagacaaagatgtgttggagaaatgtgagactatggaaagttatactttatagtataaaactaactattaaatgtagaaagaaaagaaaaaattattatttggtaaccatgataaaaattaattcaggtaaacaatcatcaacaaatgctaaaactagtgggttgaaagtctacagagcagtaagatttgtacaaagtttcaaggaatttcccccaaaagaaaaataaaagcattgactttataatggagaatcctgacagatattatcttaaccaagaagtcaaacataacatcactagaaatgagaccaatagacattatatgcttccagatgtgacgcactgaagagagtacacatccctattgtaatcttcctgagagaaaaaaggctatcatgatctaatgatgaggaaacaaaccaaaaatcgcagagtgagacatattctacaaaataactgtgccgtatcttccaaaaatatcaatgtcataaagcaagtcacaaactcttttttgaaatgtgcactgtttgctgcatagggcatagtcttatatcagaactctatgaatttgtattgtgagtcttccctcaggtcttgccagaaactctgcatggtgtcttttgtcatctctggcatttgtaataacctaagatctgccagagcatatggaccaagcagaaccacttgtgttgcagcctgttcctttctgctctgggctccactcaaagcgagaccgttttatgtcactcaatatatgggctggaacagtattgccaaggattatgccttgtccaagacccaaaagttcttctcagtaattatgcttttttatttgtggatgaatatgtgagatacaataatatgctctttactttggaggagatatgctgccacatcccagatcattagacctttaatatgtttaccaatgtactggacccctgttttcagaatgcaagcttcttactaggactctcaacatacttgccacttttcactggtagtgttagagagatatagtcaatatgttgggatattctgacatttttcagaatgtccagacggttcaggtgtcttcagaataaattacatcagagggcaagagagctaacataaacctgggacaagactgtaaacatatattgttatctgcccttagtaaatgcaaactgttcatggttctctcctctcttctaataaaaacaaagaaatgcattggccaagccaatgatggcttagcatgtacctgtggctgtgttaatctattctagcagaaacaccatttctggcacagtggctgcaattagggctattaaatgtttgagtgtgcaatagtactaatccagaatatgtctggattctgcaagaactatacggatgaattaaatgaagatataatagagataaaccatctgtcattctttggctactgctgctatcaggaggtaagattgcttttatttactatcttggttgagtgttggggcagtttcaaaagtttctactttgtcttttccactatgatatctcttaaccctactggccaaggaaccagagtgggattctgtcaactaccaaagttatctattttaattgcatatttcatgctatataccccatggattaactgctagacagacctgggccaggattctattaattagctggtcattacaaagcaggttcactgtgcaccagcatcaatcctagaggaggactcaaatcccttacccactgcatgttagggtgtgccaatttctatcacttgcatgagtcctgtgagacagaacactagcacagaacaggttacacggagcagatgggcaacaagaaaataattacttgtttttaatataaaataataataagtaataataattaataataatattattacttgcagatgggcaacaagaaaaaataaaagcctaggatctgtggtgagctggtctcctaaggctcaagaaagctgcacatggtggttggagtctcatctccatgtgccccacttgcaccacacctgagggaccctggaaagctctccactctggactttatacgctgggagaaacataaattgctggactgaagcattgtagaagatcctgctctaggagggacaggaacagagcctatgctgttctggctaattccttcttatcccaggatgctgcatttcgagcaccttctacagttattcttgagaactacaaacaagaaagggggaaaaaccgagtcagtccaaggccgctaaggaaactgtcctgtagtctttatatgttctaaatctaacgggtgttcatattgatgttttgagttgctggaagctctaattgggagagcactgggagaatcattattgtgtatactcatcattgatttgaagagcccttcttggcgaccaggcctctctttcactccaagagttaagtgtctaaaaactaactcagttccggaaactgaataagggtggtgtcttatattgggtcatttctttcagtatcctgataatccatctttgatttctttcgattgcatcaattgaacagagtactcctcagttccatctgtctgactcctagagatgtcatgttctaataaccatctctataaccttctccatgtcagacttccctggctgccactttgtctttttccactcaatacaataattacaaccatctgacttacagttacatactgccacctgtctattgttttaagtttctaccacctccattgctatcatgagcccaattctgtaatagtatctcttcccatcatccctgacctacagatgagagcaaccactgaaatatttagtggtctggtggcccctaacactagcatattccttaccattttgcataagatacaacctgtgggccatactttgaagcatatgtatctgataggttttccaatatctcatagtacagtagtcttcccttatctgcaaggaatacattctgaaacattaagtgtgtgcctgaaatcgtggatagcactgaagcctatatatactaagcttttttcctatctgtacatacctatcatagagtttaatttaatttaattaatctggcacagcacattgatgtccatcaaaacattttctgtctatgtcttccaccaacaactttaacgtcttttccatcttaaataagcacttatattgcactgtggctgcaacttttgcagcttgaggtatatggcataactagtacaaatttattttttcttcttcacaatttcatggaaaggagtttcgtttttaccatagatcttagcaacctcagcatacataattttttcctttccttattgaaaacttttacctttttcagttaatggagcaatttatggcttccctttagcatatctgaattgcctgcatcactactcttacacgttggagccattattaagtaaaataaaggttgcttgaccacagtactgagatactgtgatagtcagtctgataactgagacgtctactaagtgggtaacaggtaggtagcataaacagcttgtttctgctggacaaagggatgattcatattccaggcaatgtggagcagaataacgtgagatttcatcatgtttctcagaacagcacacaatttaatatttacgaattatttatttctgaaattttccatttgataattttggactggggttgaccatgggtaactaaaaccatggaaaatggaggactactatacagcaaatccactctagcatgcttactattatgaaaattttaatatcttacttcacagtctgcagtgtgatgtgtgaggtttccatctccattgtaaaagttattgctttttccacacttcagtatgtccgcaggatagagtgctcttgccaaggtaataaagcccgtatcctaaaagagtactaacaaatcaattagctttctatgttctaactttatattctatccacacttgatccagcatcctttatcttcagtcctatattgacttttaaggtttctggtggtatacgttagctaggttctttagattttttaataatatggtcccttttcttcttcatcaaatattctatatatttgcatgggttgtgttgtaaattaaacctagtgaagtcttagtatcctagagagaagataggagcagatcctggggtgcaatgtgagcgcatattgctgtacgggagaaactttcaaatcatcttcaaagaggggtggtgctagccattaacagctaggagtgggccacttcttcaggctcagataattcagggaaatttagaaatataataatttttaggtgtattaacacagatgtctctaggttaaaagtttttacttgtaatatttaatgttttatgttggattattgcctgcatcactacttttacaccttggtgccaaaaatgaaaaaggcattacaaaaagaattaatattgatcagtctgttattactgaccaacaatattggccagtctgttattactgacttaacctatttatgcctgatgttgcaattttttgaatttttgcaatcagaccttgccgacaaccttgagcagtaggatataaataactcccacatgcttataaaattatgacttgtgaagatccatatctttaagcgaaacttagctgccctgcaaaaaaaaattaaataatagtctctgatatataaatatcagccaaaccaagttataattttatttggaaaaatgaaatatttcaattttctatatcagtatgcctctctcttggttgctaggtattgttttagcaaggaaccattgtgatcctgaggtaaattagaaagatagggagggcataatatcagccctttgccaactggattctacattttgtgctatggattttataaatgtctaattaaattttaaattttaacataatattaaaatatgtaaaagtggtaatagaaacaaaatatattaactcaaatttttataattaagttgtagtgtattagatcctattaaatcttatgctgacatattaattatccttttataataactattattttataactgttttgactatgtttttggatttttagtttattttaatatcaaaaggaaggaatgcaggaaagaaaagaagaaaggaaggaaagaaggaaggcaggcaggcagacagatagtccagagaaaagcaaagtagcatgattatatggaacaggatagtcccttaaaggaaaatagaaaagcaccaaccagaagaagtaggaatggatgctgaatatggaaacatcacttacagctactacacatgagtaacacagaaaaaaaatggacttggggctatatgcgtggcttcacaatcactttggtcatcaataaaccaggacattaagaagtgtttggaaatataatatattttgagcagtagggaaggggcaacttttcaaaatcttttgctttgtgttatcatcttcattatatatgcattgcataaaaagagagattttaaatatcagaagttgatctagaatagcatttctgaagaattctcaatatatcagtgcctaataagcccttttaagagacacagtgctggggtcacattacacaccaaatggaaagggagagttggagcatcacaaaagcttggtgccagagaaagacattgaagcaaaaactgcacagatctgccttcactccctcagcctggaataagtttttcatttatcaaggaaaaaactaaattaaaccgatctataaaattcttatctattttaatcagtgatagagaagattatagtgttccactctttaaggaaatacttcatcaccaaataaataccttatatcacctattagaggtaatagggcaataaaagaacatacttaaagattagaatctaatatccataaaggagctagggaaatcctatattatatttgagtttatgacaacttttcaatatttttcactttgtgttatcatcttcattatatatgtattgcctaaaaagagagattttacgttgggcacgatggctcacgcctgtaatcccagcactttgggaggccgaggtgggcggatcatgaggtcaggagatggagactatcctggctaatacggtgaaaccccgtctccactaaaaatacaaaaaaattacccaggcgtggtggcacgcacctgtagtcccagctactcgggaggctgaggcaagagaatcacttgaaacccggaggcggaggttgcagtgagccgagatcaggccactgcactccagcctggggaacagagcaagactctgagtcaaaaataaaaaataaaaaaaaagagagagagagagattttaaatatcagaagttgatctagaatagcatttctgaagaattatcaatatatcagtgattatatttagcaacaaaggatatagtttcataagatcacagagttgttctcaaaataattttatccaaccctttcaaatgagttgatagagatcctgagagataaaatgacttggccaaggtcatccaaacagcttatctcagagttagaaggataacccactgcttgtctcacactttaatgtctttggtgtgtaagttttctacctacatgtttcaggtttccttacacacacacacacacacacacacacacatgcacacacacacacatcaggaacaaaggaactagcaaaacgaagacatgtctatataattgaaataatttacttcgaatgatataattataattatgcgtatgagtatatgaccatgagcacattaaattgatgtggagttatagctataaaaacagatagtactaataggagatgatattagatttataagatgtaattattctaaaatctttattgttagtaccaaggattgacaaatcaaggagagtgtatagacgtgtaataccttattttcatcaaaaactataattaaatctcatgactgcatcgtggacaatgtggaaaaggtgctgacaggaagaataacacatccagataacctacagactaagcagccagattccccaaatcactggacccatctcaatctggaggaatgggaattgttcattcaactgcattcacaagtactgcatatccttaaaatagtttttaaaagacagcttgtttcatagttacaagaaaaattacaagaaagatatttgtcaataattatcaaggttctgagattttaccctacttgcaagctaacaagttggcctaccacattttcatggatgttggcagagatacaatatccctgggtcgaagacaaagatctttattatacacagcacagcaggcagcatgagcttcatacttacatttgttcttcttatcctgcaaatcccatagaattgatatggagaagtccagtcgatgctgctgcacatatggtgggcctgtgtcacagctgagcagccctgcacttaaaaaacctgaatccttcacagggtactgctgataaacatgctcaatttttgcctcaagggagacattatctttataatcctggagagctaacaaatttatcttctgattaaggactgagaaactatctttattgcccaagcctgttccttcatacagacatccttgaaaagacagtccagaacaaaagctctcagagcctctactcaaaagccatgcagaaatgtgagagatcagtaggaaattatttctcaacaggtggctgtatcatcagccattcatgaatttgcacaagttgctccaaaagtaatttcctctaattgaacacctaataaactttactgggacagcaaatagaatgtgacagctggcacttgctttcaggggcaggcatctaaaaacccagaaaagttcaattctacctgttatctcaaaaccccacacaaatttccttagaaaccataaaaagcctatgtgtcttatatcgacaaattcctcattctgcactggtaagaaaaagaaagggaagaaaaagaaaaaaaattgtgatatagtcattttatgaacttctgtttgctattatgaacttccttccagaactttttctggtttcaatgatgaagctgggatgtgccacatgagctcacacattgggcaactttctggagaagggaggtatgttagcccattctgcatgagaggtcagtgggcacagggtctgaaaccaccatatcaaataacaatctcatcaaccactgttactttttattgggttgcaccttggatttacctagttagagtttttcccaggttcgtttgaagaaagtggtacaggcagcaacctgatgggcacagagccttctccaaattgcaaagaaatcagaccccacccctatcaacaacaaccatatctgcctcagtaagacattcaacaaatccacagtcggaaggaaattcagagttggaaataagtctaaatatccttatgatagtacttaataaaggaatatacaacctattttttgatttctgattcaagggttagaattcttaattatttgccctctatctaaggggcaattagaatgtttgactctgtcactttcctacttatttatagagaattcatacgcaaaaaaggccatttaatgtttgatggtatttttaactcttaaaaactctgttattattatattaacaaacaagaaattataaatagcaagcaggaattttcaagcttttttcttttacaggtacatgctttgacttcatatttgtatatgtagtcttcagaatcacagtgacctatttgtgaaaaacgaatgttcttcctaaatcaaaccatcttgcttataatgttttacacatgaagatggagtgtatatcacagttgctgaggaaagagtagagctaaacattcattcaatttcgtcatgaactttcagaatttatgtgaattctttgaagcctgtgtcttaactcatttgaaattattcatctttcaaataagtattcactctttcccatgctttgtattaccaatgtgttgcagaagacagaaacggagaaagttgggaactatgttataagtcttttgtcaaatgataacatattcaggaatatattattggactgaagcatatttcctgcttgattctgaacaacttctttgtctgtttattgcccctccttaccaggataatccaggctgccaaattggattttggcatgtggcttggatttaccaatgttttgttgccaaccctagatctaaatatgcaactctaataggttctttgctgcatgcacacagcaagtcaatacaccaagacaacggttgcagcagagaaagaggtttaatcacagaatcactgaatgagaagatgggaggaaacctcaaatccatctccctgaggagtttggggctagggtgtttaagggttttgtaatgagctaaagtgtggtgatcattgattggttgaagagtgcagggtgaagtcatgggtcagggagatgaagaaactgtattctcatgctgatccggttcctctgcggggctcttcaaactggttgctagaattctaggcctaataaacatcttaagcaatctttaaacaaaagccttatgattctaatgtcagagattctatctataggaaaaatggggatgcagatcaattcttcaagccttatgaccccaatgtcagaaatcctatctatagggataatggggatgtaaatggtcagcatctagtgctgcaggacttttagcaacaaggaagtggaccaaactgcagcctgattaatgtttaattaaaactatatttctgtccagaacccagcatgcaattcttgtcaacccagtgggaacagtttcaaatacattttgcagctaaacacattgatgattttttctgtgtgaaaaagataagtctctacaaaagggtacaaagtcctttagggtagcaattaatgaactcctcaaagtctatgttagaaatcctgatttatggacactcataatttatggaaatgtcaacctactttccaaaagataacatgagataaatgcaaattaaactcaaattcaaaattcaatgacaacctatttggaaaattcttgtgtaataaacaggtgttttgttttgttttgctcgtttcttctgtcttttgtttgaatgtataactttaatagctgaaccagtttaaaccgggatagaaatttgtttactcaccttagtagaattcagtgcaaatgactgagattagctgtattttctgtgctaatagacaagtttacaactcataatgtctatcatttagtactctttttctgaatattcctttgttatcacctcaattaaaagggagaaaacaagaagtgtcatttatccacacaaatgcttgcttaaaaaactttttgaggcattttgttaatgagttgatgacttgcccaaggtatcatgattattccatgtaagaatctgtatcctctcataggtaaggctgcctctaaatcctgttctctttctgctgtcctcataggccaaacattactatcttattacataaactgtctcttcccttatgctcagctgtggctttttctcagaaaaaaaaaatcagagttttttataaagaatatctttaagacacattgctttcgtgtttgtcttcagccactttgtgctgctataacaaaatatctgacagtagataatttatcatgaacaaaaatttatttgagacttatcattctggaggctggggagtacaatatcaaggtactggcatgtagtgagggcctttttgctgagtcatcccatggcagaaggcagaaggtggaaagacaggagagggtgagagagatagggggtttaaactcacagcctgtagcctttttataatctgcattaattcatttatgagggcggagccctcatgatctaaatgcctcccattagaatacactacccaacacctttgttttggggattgtgttagtgtgtttgcattgctattaggttggtgcaaaagtaattgcggtttttgccattaaaagtaacagcaaaaaccgcaattacttttgcacaaacctaatatgaagatgtacccaaggctgagagtaagttatttaattaaaaaaaaagaggtttatctggctaagggttatgcaggctgtataaaaaggatggcactgggccgggcacagtggttcatgcctgtaatccctgcactttgggaggccggggcaggcggatcacctgaggtcaggagttcgagactagcttggcccactctactaaaaatacaaaaattagctgggcgtggtggtgggtgcctataatcccagctacttgagaggctgaggcaggagaatcgcgtgagcccaggaagcggagattgcagtgagtcaagaccgtgccattgcactccagcctgagtggtaagagcaaaacactgtctaaaaacaaacaaacaaacaaacaaacaaaaggatagcactggcatctgctactggtgagtcctcctcacctcctcaggaagcttacaatcatggtagaaggtgaagtgacagcaagtgatgtcacatggtgagagagtgagcaagagagagagagagagagggaggaagtgccacactcttttaaaaaaccagatctcatgtgaacacagagcaagaacttattactgtgaggaaggcaccaaaatattcatgagggatctgccccagtgactcaaatgcctcccatcaggcccgaactccaacattagggattacatttcaacatgatatttggaggaaacaaacatccaaagcatatcaggggttaaatttccaacatatgctttttgtaggacacattcaaaccatagcagcattttttattaattacctgacatatttaaatcagctctttaccctatatcttttcctcaaatttatttaggatgcatagtttcaagcttcagtgtgctcaactgataaaattgaaatgaaacacttactgacttttttcaaatatcaaaaaagtaaaaataaatgcatttgcttaaaactgtgcgctaaaatgctacagcataggggcaataaccagcctgatgtcagcagagaaaaaaattgaaaggtacaatttctttcaagttcaactttgatcgccattgatcagcccaccttactgtactctatgcttgtctgtcaaatcaaaggagcagaggagacattagggagaatcaataggtgttacagggtgttccacaaagcacttggtgcttaatttactgcaaagtgaaatattgactgcagagccagaggaggatggcgatatgtggtttagattagattcaaacactttttagccctcagaatactattaatcaggctaatattgagtaaatatttattaagcacctactgagaagaggccctagatggttcctgagttgacaacattagtccccacccttgaagatctaatgatctagcagaagagtagccagagtaataggtataaacactgatgagtcttatgatgaaagcttctttctttgtgccctgggctcacacagttgagctttattgatataccaagcaaaaaggggcaaatccatattaggaaaatagtcactaaattgggtggggggcggggaataagagtggatgtctcctgaagagttttccctgagtgtggaacagttctgatttcctggattgccacttttattctaaagctgtgtgtttcctaaatttgttgctaacctaacagtcactttttgcccacccctgacccactggatcagaatctgtatgaaatgcatctgggaagctccattattaacaggtaactttggtgattttatcgggatgtttacaaaacactgccatagctactccctgcaaccctaccatttgagcttatctctttcattgagcagcaggtctcaaagtttagcttgcaaaaaatcacctgaatctctactatttctatttcaagtccctttagtttaattgatcttctcaaagtttagaggcattcatgttaacaatgttaaggttcctgagtcctatcttcataggcattaattgagtgggcctgctgtggagcccattaatccgtattttgacaggcatggttgggtaagagattctgatgaaggtgatccttggaaggtactttgagaaatattggctcaaatagtctttattcctcttgaaaagaaacacattacactcttgtaatttggtgcaaaagtaggatttaagaattggatttaatttcaggttataaatctagcagaatgaaaactatagtgaggacaggagtgtttttttttttctgttctgttcaatgatgtgtgcccaacacctaagagagtggctttcacatagtagatgcccccaaactagttgttgacttgatgaatcaactcaaggcataaggacattatgtccgttactttgcatgctccccatatcctctaatgaagtgttatagacagaaggaatttacaaacaaatttgcaaatagagagcagggtggcagtgataggagtagaaggaccaactctgaaacacattggaccttcaggaggaaaaaaagagggtcaagacagggaagcaaccatggatagcatcacccccaactcccactctgccaaccttactggctgtgtaaggctatcctgcccttggtcactctattggtttcctagggatgctgtaacaaagtatcacaaactgggtggcttaaacaacacaattatagtgtcttacagtcaggtaggctagaacgaagattaaggagttggcaggattgctttcttgtcggggttatgaggaagaatctgttctgtgcctctctcttggcttctggtggtttgctggcaatctacagcattccttagcttgtagattcatcacccccatctctgccttcatctttacatggattcttcctgtgtctgtgtctgtctctctgtctgattttccttttttaaaaaaaataagtatggccgggtgcagtggctcatgcctgtaatcccagcaatttgggaggccaaggtgggtggatcacctgaggtcaggagttcgagaccagccttgccaacatggcgaaaccccatctctactgaaaatacaaaaaattagcccagcgtggtggtgcccacctgtaagcccaactacttggaaggctgaggcaggcaggagaatcacttgaacacgaaaccgggatgttgcagtgagccgagatggagccactacactccagcctgggcgacagagcaagactccatctcatgttaacttgaacatctgcaaaggccctatttccaaataaggtcacattcacaggcatttattactgatttgccccagaggctttgtgttgtcccctttgatgagagattacacttttaaagctacagcatgggaatgccacagggtgaggtgaggtgctgatgaggaaatatacataaatcaaggctgcagctttctccttgccttactttattttctgaactttccttatgcaggtgtagatatataatttcattttgtctttcaacaggaactgggtgggcagggggaacagtggcatcaaatgtgttggggtcactatcgccttcgcctctcagttctttttggctttgcctgggattctgtgtcccttcattcagcccctgattgttcacttgctcctatgttagtgaaagagagatgctgaacgttaatgaaaaaaagccatcctgcggtatgcagctcttatgcattctgtaagggctgctgccttcaaatatttccaaggcattagaagtgtttgctgtggagacacccaccatctgttcctgccttcactcctgggtgtgagaattgttatgaggacagtacaatggctcctcccagctgttcctggatcttggtctaagtccttcgggaactgatattttcaggaactagggtatagagattgttgaaataggattttagtggaataaatgaaatacatagcgatgtgtgttataatcacaaggaatattttccccaattattaagtgccatgtgagagatgagacagattaacggaatggtatatattaaatgacttaggttcatgtaactttattttgatgttttctgaatgtatttgctctaagattgaactggtgttgcttctaatggattttccacaacagttgctcctggaatatgtaggatgccagaatgtttccctttgtagaagatgagctctgcactgtgtgtgtgcctcttcaggaaatagcctcctgtcaaaacttactacagcatttcttttatatatatgaaaggataattttggtgaaactagatttgtaggtggcaaaaggaacagaggtagctccagttttaagaaaacgtgcttggtcttctgttatttcacttttgatagctcccttgggggcaaccccttatttcagagcaattataccatttgtagagcacttgataatttaccaggcacctttacacatatgttatattttgagccacataataaacttcagaccctggatttattttcttcttttaagcaagcaaaaagaggcttaaagattttaaagaaattctctaagacaacactgccagcaagtggcaaagcagatgccaaatatatcttccaaattctatacttttcttcccataaaagtttatgattctcacaatgaaaggggaataacatcttacttactctgccatttggatccctagatgaatcaggaagtgtctcaggttgtttgattcaaagcagtggttctcaagcttgggtccctaaagcagcagcatcagcaacatcacctgggagcttgttagaactgcagcccctgaggcccaccttaaacatactaaaccagaagatattggggcaggttccagaaatctcttttcacctgtcctccaggtgattttgatggataatattacttgataagctctgacttagaggagacagtctcacacaggccctccatccctccctcccgttagcccagaaggcagcatttagtttgaaaacactttctgatgacaggtaagaagcattttcttgtcatttagtacatcaagagagtttttctctatgacagagaaacagggacaaatgcaatgtgtgagtggatgggtgagaagagtgaagggaaaattataggctgtgagattgtgttatttggggagattgttgaggacctcacatcttgggacttctgtattgagaagatagagcagggaaggaaatgcagaaagaactgaattctaaatttccacttcccaattatgtccaagactaattctctgacaatcatttttcctgaaatgccactgccttttagaattgataattccagcctattgattcaaccaatcatttgatatattctacaaaacaatagaaaaaatagagggtaagtctcatagtaggaatcataaatttcaaggaacaagatccctgctttaactctggaaggcacctggctaaagtggaagtaagacatgcttgctggatctgaaggctactgggtatgtccaggccgctcctaagaggtctgccaagactctgtgggtttagcagagtacaaagccaaagttaattgctcctcataaagcccaacatgctcagagtgaaccttcttcatggatgttttccagtcatcagcatatttcatgagtatttgccatacagtttaatggtaaccaaaacacttattgggtagaaatcatctggatcatcaattctgttcatttaaaaaattaatagagaaatgcaatgtttctacacagcagtgaaagtccttttgctgttattttggtccacattttgactgaagttgaaggttagctgccagaaaacttttcatcatatatgaaagtagccctgctcctgaatatgagacagaaaaggtatataaatcttactatacatttgatgttgctaatgctaatggagttatttacatacataaattttgcataataatatagacttttttcattttctatatgcaggataaaactgtaaatcctctgtgctgtttagacccccaagtggatgtactgcaatacaattctgacactaactacctggagttagtatcattttgtcaatactgctttgataggtataatgacaagggaaatatttaattcagttaatggtaggacgatgatttggtttgtggggagcctgatatgctgaatgacaggcttaagtgctgcagccctccatgcgtctacctccctgcagtggcttcatcaagggcccactgcccctccaagccccttgactttggcttggcccgctgagttgctttggtctattgcatgtcggtaaaattgaccaagagctgagttccaaatctaggccttaaaggccccacatgtttctgcttgcccttttccacctcaggcgtcactatgagaagagttttcaccagctgttgcacattcagcctcagccccaaatgaggcatgtggcatagagctgagtcagccaagcccagcctagatcatctgactcccaggtgtgtcaactgcactatccaacttcagatttggtgaaataaatttttttgacgatatgtcttgtgacaatagctaatgagtaaaagaaatgtttccgttcttttccgagttaactgtcaggggcttgagttcaacaatatgctacaataagcgatgaaattttgctttctttctcccaacttttgattctttaaagagagttaaacgtcacagatggcccagggctgagaagctaggacagggtcagccaaatgaagagccatgggtatgctccaatctgtcaagaaaagcagcctccttgggctaactctttaatgtagggattagttctgtttgagcaagttggacttgggtgtttgaaataaaattcttaatattatctacaattttctttaaatatggattgggatatatatatacgtatatatatacacatatatacgtatatatatacgtatatatatacgtatatatatacgtatatatacgtatatatacgtatatatatacgtatatatatacgtatatatgtgtgtatgtgtgtgtgtgtgtgtatatatatatatatatatatatatatatgatgtatgtgtgctgtttttcagtctaccctctgaatatcattagtggacagttgtggcccctaatcaagagtatacacgaaagggcctacttagttaacattcagagtgtttattccgaaattcaggctccagaagtgtccttcaactaactttatttttgatcaactccagatggtttgctacttagtataacgtaaggaataattgtaattgcttactagaatgctgttaattatgtgtggatttgctagaatattgtctatatttctgcctttgcatgaatcagaacaggaggtctggagaagcccagattctataccttttagagtggtaccctaagtacaggattatttctgattcatgtgttcagtcactttttgaggattctgaaatagtgtcacatctaccttacatagagatttcaggcaaagcatttattgaaatgcatagaagaacaaaattatgcctacatctctataaatgtggcatgtgtagcagaatattatccatgacttgtaacataccacttggttctgaggtcccaggggagaggagttagacagctttttctatatctaactattggatgttaccaatatttaccacaacctaatagttgtgcataactaaattgccttagtccagtataaaactgtttcataaagaggtttagttaaaagctaattaaaagtggaatgaataaagggtggcatattcttttcatgaaattctttcagcaacataaaaatattgctttatataatgtcaaagataaacaaagctagatactaggtaaagcagtaaagacatattttattcagtaattactatggcaatagggaagagaacctagtgtcacctgaactttactgaaacaaaaggcaggagatttttaaagagtggagtgtactaaaagaaaaagcattgaagggtgttaaggaggagtttggtccttgtgactaagctctctggtttgctaattggtgcttatctggaagagaaacaaggttctcctatgtggatgacaggaggcagtaatacaaattggagcaaggcacccactaaagttaggaccttatcctcccatgagaactgttatcaagagtgagagagttgtctcctcaaaggtttgcacttcaaaaagatagctttcaggttttgaggggatagtattgaacattgaaagattcatatctcaaaggggcagagaaagaatttataaatgcaaggtttcttttttttcttttttctttctttcttttttttttttttttttgtgacagagtttcactcttgttgcccaggatggagtgcaatggcgtaattttggttcactgcaacctccgcctcccaggttcaagctattctcctgcctcagcctcctgaatagcttgggattacaggcatgcgccaccacgcctagcttttttttttttttttttttgtatttttagtagagacagggtttctccgtgttggtcaggctggtctcaaactaaatgcaagctttctaaagaaactgctctaagaggggttgagaggcctgtgaaattctattcagcaacataaaaatattgctttatataacgtcaaagataaacaaagctggatactagggaaagcagtaaagacaaattttattcagtaataactatggcaacaggggacagaacccagtgtcttctgaactttcataattattttgactgaaaagacctaaattctcctggcagcattgagatttatcaggcaaatattttaagggggacaaaggtcatcctagggacacagtcttaggctgctagaagccatgctagagcttgtcaagtctcttagtggcaaagtttggttggataatcatatgctaggaggtttttctgtttttcttttttttcagttcttagtaacaataagggtgaatatcaaaaacattaggttgggctctacatttcatattagagcattttactctaccctaattcaaataaatgactactcataagaaagatatcaagataatggaaagatgcatggcttgctaacaattgtcctaccttttcagaactgtgattcttatccagaaattctttttaaataaaattttaggatgcagactgccaacttttaatttcctgtttgcccttttgaagtctataggaactttttttcatatacttgagaaaaaatatatatactacaagtatcattcacatacctgaagaggtgaagccatctcattggagatttgcaatgacagctagcccattcccacatgaccacactagagctagctcagaggggtaaagcaacttgattaaagtaatatatatagctaaccacagcatccaactagaaactagaactctattttgtttacaatatgttctagcataaaatttccatacatgcatagatgtggggttaagagattccttcagtatcttataatgtgaactcaatgtatttattaccagagaaattttatttatcattctattttttaaataaatagaaattcagaaaaataaaacatgtattttacatggttttatctctcttttaaattctgaaataatcgatatatgaaaattgatttaacttatatctgttccacacttttaacagtttagccaactcttttcaggcttagtctttatttttattataactttcccattataatccacatttatttgatttttagaactctgagtttttctccttcaacatccttttcgttaatatttaagacaggttcccacagcttcaaactcagtcaaagtgaactgaatgttgatgctaataatgtaagctttctgagacttaaacctgaagttcagattgagatgcatgccaccagggtcaatgtggaatgtccagaagtggcatacttggtgagagaaataagacacttagtgagactgtgctcaagagattctggaccatctcctgctttaaaatttcaggttcctatacagtagaaagtaatgcagatgcaattctttttttgaagagtgaagaacatgaaacattacactctgcagcgtgcactacatccaatgcctttaaaaaaaaagtctgtacctgttcatactgctgtttctcaggcaatcaaacatatttgaatgtgaacaatctcttctagtttcccactatatatttttgaattggatgtcaggaggtgtaacctttgaataaattcagaacagagagaagatgaaagaagacagtagaagagagaactctgattagttcatggtttggttcttttgttgtagggaaaagagacgcattattctggtcactgtagcctggaatcctggaattaggttcataccatttttgggtaccatctttggctttttctagttcagcaaatgtgcttctaaattcgtcctccatgctaatgcaatcaatgaaaattgcaccttgaattcatttcaatgtcttccttgatctccaccaagggctgttgccaagtgggtattgcaccatgtatcagaagagggagaggccattaccccaaaaacacacccactctgcctctgtgaagatgcttaggcaggattcggttttaaggagaagagctaggagcagaaggagctgagagactgaaatagtttaactaaaatggggcttagagtattacctaaaatgactgcatagcttatttaaattagataagtttaaaacaaattatgcatacacatatatacatacacacatatatacacatatatacaataaatgtgtttatgtacgtgtgtgtgtgtgtgtgtgtgtgtgtgtgtgtgtgtgtgtgttccaccacaaaagaagcaggttgcggcttggacccagattagttacaacataaagaaaacaaaggtgctgcacttttctacccattaaattgattgtgtaaaatttgcagtgcagctgcattttctaccctagatttttctttaattgttttgaagtgcctttaactatatctcctctttgactgaagtgtcactaagtttcagtttccagaaaaatcacatgtatgcaagatgtgctcagtaattaatttttgatgcaggagtgaagatatgtcttcagtatactgatttcctttcttttgggtatatacccagcagttggatggctggattacatggtagctcaatctttagttttttgaggaacgtccaaactgttctttaaattatgactaattaaaattaattctctcaatttcttgaagatggtagaggtgagtttgaactgaaattctactatcacatgtagtcaaatacaataggaatacttctatgctctccatttaatatgatgaataatggaagccttgggatgaaagggtaagtctttactcttctgaatgactccactattaaagcagcattgcctccaggggaaggatattacctcaaagcacaggtaagatgtgaacagctcaaatgagataaaacacacaagcttaataccagagagccattattccaaactgagagaggctcctggagtcttgagagtgagcaaccataggggttttcatcttcagggaggttaagtgcacaatggcatccaggaatacccgtaagcactacattggctgtggacctgtgaatgaattatgctgaagagcttggttgcctttgcataaaacacttttcaaggaaattctgacaagaagtgtaatcatacttctctcctctcacacaattatcagaggggaaatagttttagcaagaacatgacagatgtaaggtttattgtttactaaatatgcaataaatcatcagtacttttcatagagagaatcccagaatatgtcaggaaatttcattaattgatattaatcttgacgtatctttgcaaagatttgaaaagcaagcattgtgatttattacggcaggaaaacgtgtgagttataaatatgaacttcaagttggctaaattcttttttttaatttttaaatttttttattatactttaagttctagggtacatgtgcacaacatgcaggtttgttgcgtatgtatacatgtgccatgttggtgtgctgcacccattaactcatcatttatattaggtatatctcctaatgctatcccttccccctccccccaccccacgacaggccccgatgtgtgatgttccccaccctgtgtccaggtattctcattgttcagttccaacctatgagtgagaacatgcagtgtttggttttctctccttgtgatagtttgctcagaatgatggtttccagcttcatccatgtccctacaaaggacatgaactcatccttttttatggctgcatagtattccatggtgtatatgtgccacattttcttaaccagtctatcattgatggacatttgggttggttccaagtctttgctattgtgaatagtgcacaataaacatatgtgtgcatgtgtctttatagcagcatgatttataatcctttgggtgtatacccagtaatgggatggctgggtcaaatggtatttctagttctagatccttgaagaattgccacactgtcttccacaatgattgaaatagtttacagtcccaccagcagggtaaaagtgttcctatttctccacatcctctccagcatctgttgttttctgactttttaatgatcgccattctaactggtgtgagatgggatctcattgtggttttgatttgcatttctctgatggccagtgatgatgagcattttttcatgtgtctgttggctgtataaatgacttcttgaagcacatccctttcttcctattaggaaactaaaattcctttgacaaaatttccaaagaaacacaccttccacctcaattctatatagtagctgatggctatagttcttgagtgctcagacgtttcacacttagatgttaatttgttccatcataaatcaatttaaggtagacatagttaataaggaaaactagtaaacctttcaaacatctgccaagattctagtacctgatacgtgtggcctccagctagttgagcatcacaacattaccaaggacagcatcatgaagtgaagggggagataacgtacctagtgaaaaaatactgatgagataaaagcttatgagtttgacgtcctcagaagtctgcatcaggggctacttgtgggcctaatgaattgtactacattaaacaaatcacaaagttttaccaatcttgaaaagcaatttttacatgatttataagaaatgaaagcaaagctataccaaaaggagtgtgctgctgatgaaactcaaaacagcaacttttgatgaacttaatatagttaagtctatccctgtgataaaacatggtttgtttcaggcaaaaggatacacatcatcctgggagttttgccaaatactaacaattttttctatttggcaaacaagtattttcaaagtgttcttgctttttaaagaaatcttttctaaaccaattttgctaagaatgtcttctaagagagtatgaaaaaaaaaatactccgtgtctttatagactctagggtgtcagaaagtggaacaggtgatggagatccatgtaatctcagcattcttaaagttgaagaaaatgaaatagaatttgaataacctgattaatgtcatcattaatttggtggcagagtcagaagcaacagctgaaacagggaatattcattcactgagcccttacttcctatgtgctgggtgtgaccctatgtgtttcacatgtactaacttctatagatgacaaaaaccctgcaagacaggtattataattatccctatagtataaataaggaaacagaagcagagtaatttgcccaagtttacattacatgtgagtggaacagccaagtttcaaaccagacagtttggttctagatcttatgctctgaaaaattacaccatcctgccagcttgttttatttcccatttttgtttgtggagttgttgcattaatttttaatcagagttattgagatacaatctgcatacaatgaaatacaccattttgttaacttttaagttcaggggtacatgtgcaggatatgcaggtttattacatcggtaaatgtgtgtcatggggatttgttgtacagattatttcatcacccagatattaggcctagtatccagtagccatttttcctgttcctctccctcctcccaccttctaccctctgataagacccaatgtatgtcattcccttctatgtgtccatgtgttctcatctctaccacttataagggagaacatgccatatttggttttctgtttctgcattagtttgctaaggataataacctccagctcatccatgtccctgaaaaggacatgatctcattctttttttatggctgcatagtatgccatagtgtttatgtaccacattttctttattcagtctatcattgttggacatttaagttgattccttgtctttgctattgtaaatcctgctgcaatgaacatacgcatgcctgtgtctttataatagaactacttatattcttttgggtatatactcagtaatgggattgctggattgaatggtatttctttctttaggtctctcaggaattgccacactgtcttcctcaatggttgaactaatttacattcccaccaacagtgtacaagtgttcacttttccccacaacatcactagtatctgttattctttgactttttaataatagccattctgattagtgtcagagatggtatctcactgtggttttgatttgcatttttctaatgatcagtgatgttgagttattttttaatatgattgttggctgcatgaatgtcttcttttgagaagtgtctgttcatgtcctttgcccactttttaatggggttgtttgctttttcttgtgaattagtttaagtcccttatagatgctggatattagacctttgtccaatgcatagttcacaaatattttcccccattctgtagcctgtctgtttactctgttgatagtttatttttctgtgtagaagctctttaactattagattccttttgtcaatttttgcttttgttgcgatttcttttggcattttcttcatgaaatctttgtctctgcctacatcctgaatgctattgctttggtcgtcttccagggttttaatagttttgggttttacatttaagtctaaagacaaaaaccacatgactatcccaacacattcataaaaggctttcagtaaaattcaacatccctttgtcctaaaaactcttaataagctaggtattgaaggaacatacctcaaaataataagaaccatatatgaccaattcacagccaacatcatactgaataggcaaatgctggaactattccccttgaaagctggcatgagacaaggataccctctctcaccattcctattcaacatagtattggaggttctgggtggggcaatcgggcaagagaaagaaataaaaggcattcaaacaggaagacaggaggtcaaactgtccctatttgcagatgacatgatcctatatctagaaaccccattgtctcagcccaaaagattcttaagctgataagcaacttcagcaaaatctcaggatacaaaatcaatgtgcaaaaatctctagcattcctgtacaccaacaatagtcaagctgagagcaaaatcactaataaattctcattcacaattgccacaaaaagaataaaatacctaggaaaacagctaacacaggaagtgaaagatttctacaaggagaactacaaaccactgctcaaagaaataagaaatgacacaaacaaatggaaaaatattccatgctcatggataagaagaatcaatatcatgaaaatggccatactgtccaaggcaatttatagattcaatgctattcccattaaactaccattggcatttttcacagaactagagggaagtatttcaaaattcacgtggaaccaaaaaaatagcccaaatagctaaggcaatcctaagcaaaaagaccaaggctggaggcattgtgttaactgtcttcaaactatactacaaggctacagtaaccaaaacagcatggtactggtacaagaacagacacagaccaatggaacagagtagagaacccagaaataagaccacaaacttacaactatctgatcttcaacaaacctgacaaaaacaagcatgaggaaaggattcccttttcaataaatggtcatgagataactggctagctgtacacagaaaatggaaactggaccctttcctttcaccatatacaataattaactcaagatgtattaaaaacttcaatgtaaaacctcaaactatgtaagcatcaaaatgtgcaattcaaataatttttacaaatataatacagtagttgtgtaactaccaccacaattaagacattaaacatttttattactcccgccaagttattttatgcctcatctcagtcaatcccctcactccaaccctggccactggtaactgatgatttgttatttgtgtgtttgcatttctaagcattttatgtaagcaaaataataaattatatatttatttgagtctgtcttcttttgattaatataatgttttcaagatccatccatgttgtatcactagtaccctgcctttcattgcttagtagtatacctttgtatagatgagtcacaatttttttattcattcaccagttgttggacatttgggttgttactaggtttttactattatgaataaagctgttatgaatacttgtgaaaaatttttgcatgaacatgtgtttccctttctcttacagaaaatacctacaagtcagattgctgagttacttgataagtataatcttcactttctaagacaatgccaaagtgttttcaaaatagctattccattttgtatttgcagcaaaaacatacagaagtttctattgctgaaaggtggtacttaaattttagccattctggtggatatgtagtggtatctactatgatttaaatgagcattttattaatgatcagttacattgagcatcttttcatgtactaattgaaattttgtatcttttgttttatgagatacctgttgaaatttttattcacttttgaatcaggatgcttgtcttttaattactgagtacttttgaaaacaaatcaatttgaggaaaactattttcaagttttgtttttttttttttctgaatagactttttttttttttttttgagacagagtctagctctgtcgtccaggctggagtgcagtggcgcgatcacggctcactgcaagctccgcctcccgggttcacgccattctcctgcctcagcctcccgagtagctgggactacaggcgcccgcaaccacgcctggctaattttttgtatttttagtagagacgaggtttcaccgtgttagtcagaacggtctcgatctcctgaccttgtgatccacccgcctcggcctcccaaagtgctgggattacaggcgtgagccaccgtgcccagcctctaagtaggtttttaatagatgcccactatcaatttgaggaagttctcttctactgtactttgcagaatttttttaaatcatcaatcattgttatacttctgtaaattttttctgtatctacttagaaaatcgtatattttacttacatactgtcagtatgtcaaaaccctttgattttcaaatgttaaaccaacattgaatttctaatatacacctcacttcatcatgatttattattacttttttatcttcctggactcactagatttttgcataaatattcatgaggcaaattgattttggggttagtttttttttcctttaatatatttgtcttgttctgggatcagagaaatgctttcttcataaagtgagtaaagaaggctttgcttatgttctattttctagaatttgtgcagaattggtattacttttatcttaaatgttcagtagaatttaccagtgaagctatctgggtctggagtttgctttttagagtttactatgaatccaatatttgaatatatgacgtccttttcaaatcacctatttcttcttgagtgagctttggtagatgtgtctttaaggaatttatccatttcagtcatgtttacaagtctacagacatgaagttgtttataatatcctcttttcattcttttaatgactacagtaactggagtgatcatctctctttattgttgacactagtaattttgtcttctctttttatttgggtcaatttagcatgatacttttatcaatttataaatgttttcaaatatcatattttgttttcattaatctttttgtatcatatgtgaattttctgttttgtttgtttcagcttctccttttatcattcttttcttcaccttattttcattttatattgctcatctttcccaggcttttaaggtggaaacctagatcactgaatcaagacctttttttctaatataaatatttaaaactataatttccctctaagcatgtctttcactgtaacccccaaatttcaatatgtggtgtattcaccttaatcttttcaaaatatcatttcatttttattgggatttattctttcacaaatgggtaatttagaactgtagcatttaatttctaattatttgtggatttcctatgtatctttctgttactgattttttttcttttttctttttttcttttttactttattattattatgctttaagttttagggtacatgtgcaccgtgtgcaggttagttacatatgtatacatgtgccatgctggtgtgctgcacccattaactcctcatttagcattaggtatatctcctaaagctgtccctcccccctccccccaccccacaacagtccccagagtgtgatgttccccttcctgtgtccatgggttctcattgttcaattcccacctatgagtgagaatatgcggtgtttggttttttgttcttgcgataggttactgagaatgatgatttccaatttcatccatgtccctacaaaggacatgaacacatccttttttatggctgcacagtatttcatggtgtatatgtgccacattttcttaatccagtctatcattgttggacattgggttggttccaagtctttgctattgtgaatagtgccgcaataaacatacgtgtgcatgtgtctttatagcagcataatttgtagtcctttaggtatatacccagtaacgggatggctgggtcaaatggtatttctagttctagatccctgaggaatcgccacattgacttccacaatggttgaactagtttacagtcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatggtaagcattttttcatgtgtctgttggctgcataaatgtcttcttttgagaagtgtctgttcatatccttcgccattttttgatgaggttgtttttttcttgtaaatttgtttgagttcattgtagattctggatattagccctttgtcagataggtagattgcaaaaattttctcccattctgcaggttgccggttcactgtgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcaactttctacatatggctagccagttttcccagcaccatttattaaatagggaatcctttccccattgcttgttttttcgcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattggcttggcgatgcaggctcttttttggttccctatgaactttaaagtagttttttccaattctgtgaagaaagtcattggtagcttgatggggatggcattgaatctataaattaccttgggcagtatgaccattttcacgatattgattcttcctacccatgagcatggaatgttcttccatttgtttgtatcctcttttatttcattgagcagtggtttgtagttctccttgaagaggtccttcacatctcttgtaagttggattcctaggtattttattctctttgaagcaattgtgaatgggagttcagtcatgatttggctctctgtctgttattgatgtataagaatgtttgtgatttttgtacattgattttgtatcctgagactttgctgaagttgcttatcagcttaaggagattttgggctgagacaatggggttttctcgatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagattttgcccattcagtatgatattggctgtgggtttgtcatagatagctcttattattttgagatacgtcccatcaatacctaatttattgagaatttttagcatgaaggattgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggtggttaaactttttgatgtgctgctggatttggtttgccagtattttattgaggatttttgcatcaatgttcatcagggatattggtctaaaattctctttttttgttgtgtctctgccaggctttggtatcaggatgatgctggcctcataaaatgagttagggaggattccctctttttctattgattggaatagtttcagaaggaatggtaccagttcttccttgtacctctggtagaattcggctgtgaatccatctggtcctggactctttttggttggtaagctactgattattgccacaatttcagagcctgttattggtctatccagagattcaacttcttcctggtttagtcttgggagggtgtatgtgtcaaggaatttatccatttcttctagattttctagtttatttgcgtagaggtgtttgtagtattctctgatggtagtttgtatttctgtgggataggtggtgatatcccctttatcattttttattgtgtctatttgattcttctctcttttcttctttattagtcttgcttgcggtctatcaattttgttgatcttttcaaaaaaccagctcctggattcattaattttttgaagggttttttgtgtctctatttccttcagttctgctctgattttagttatttcttgccttctgctagcttttgaatgtgtttgactactgggtacacaacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacattacaattaaaagaactgttactgattttttgtataacttttttggtaagataacatactttgtattatttcaatccttttacaagcattaagatttgttttattgcatagcatgtgttctaactttgttgtgctgtgattggatagagtgttctgcatctgtcaatttggtcaagctagttggcagttttattcaagtcttacatatcctgcactattagctattgtactgtcaactgccaggaatgttgtagtcttcaactattaccatagattttccaatttcccttttcagttctattagtttttgtttcatgtttttgaagctctctaatcaggtgcataaatatttaagattgttatgtcttaataaaatgacttgctttttaatataatacctatctttacccctggaaatctgtgttctaaagtcaatttggtcttacaatcacatagccactacaacttccttttgatgctgatacagcttcctgttttcatgtttttcatacttttacatttaacctgtctttacatatgatttaatgttcggtagcacaatagggcatctataattaacaataacattgtacatttcaaaataactaaaagagtgaaattagaatgttcataacagaaataaataataaatgcttgagataataggaaaatacaaggtttttttagacagcatatagttgggtcacactatcttatctaaatgacaatctctgcattttatttggagtatttagacaatttatatttaatgtaaataatgatatgatttggttcaaatctaccatctttctatttatggttgtttacttcctttttatatattttgtatttttctgctttcttttggattttaataattatttttgtgattttgttttatctgcagtattagcttacttgatatactactctgttttatttttatcaaataccttgggatccaaaatatgtatttttcacttatcacagtctatcttcaaataaagtcatgtaacttcacatatggtgttataacaatatgcttaggattctctcctgtgttctttgtattattgttatatacgttatttctacttatgttacaaacagtgaaatatattgttaaaatttctgctataatcattcagttatcttttaaatagactaaaatgagaaaacaatcttttatgttaaccacacttaccatttctgatgttctcctttacttcatttagaaccaaattactatcagttattttttcctttagaagcatttattttaataattttcatagctctagcctggtggcaaaaagtgtctcggcttttgtgtaaaaatgtatttattatatgtttgttttcaaaagacatttttgttggataaataatcctatatggactttttttttctttctttagtacttctgaggtgcatagttgatggtaagtatgctctcatacttatctttgtttctctgtacataatgtgaatttctcctctacctttaacatttttttgtttatactgagtcaacaatatgattataatgtggagtagtgtgagtgtgtatatgcgcatttgtgtgtgtgtgtgtgttttcagtttattctgcttgagatttattgatcttcttggaaatatggttatattgtttacattaaatttcaaaactttttggccattattttttcagatatcctttcccctctttttgggacatcaatttcagggacattcattttccattacttattattcagtcttaattctctctgtattttatttttgattgtttgtattgctaagtatttaaattaacatcccttttcttctctagtatctaaaatgtagttagttccatatatttatttttctttttcatatattgtactaacatcactgatagttccatgtgtgtcatatcaatcttccacttttcccctcatcaggttcaggtttttgtctatattcttaagcatatagtacataattataatagcaattttaaggtcatttttggtcaattccatcatctccataattcatgggtttattttttattgaatgattatttcttctggctataggtaatattttttgctcctttcctggcaatttttgatttaatgctggcctttgttaattttactttgttgtgttctggatattgtatttctttaaagagtattgcatttgttctgtcacaatgaaatttggattcaacttaatcctttcaagagctgatattaagctttgttaaggcaagttcagaaaaatatttattttaaggatatttagcattactatcatggtgataattttctgataactccattggatgctccatggattatgaactctctatcctggccagggggatgcaaactatccatagccttccgtgagatcctagaattttttgggttactgctttccaatgattctgtcttcatccttctggaaattctcctcacatatacacagatcagcattccaccaaatattcaaggggaactccgcaaagttcaagggatgtgttaaccaccatagaaaacatggttttgcttcttcctctttaatagtctgctactgaaactctagccaactcagcccctctgaactcacatttctgtcttcttaactcagtgagatcactggagcctattttaaaactgttacttgtcctccaaattacctagaagcttcctatagggtagctgaagaagtcatagagctcaccttatttctttctctcatagatcccaatttcacactgccaattgaccagtgtctgaaaacacttgtttgatatgttttctctaactttccagcagcttagactgggatgacagtttccataataattaatctactcatcagataattctagtgacaatgttccatatgttatgttgtaaactatgtttattttaattccttacttactgtgtcaccttgaaaagaatgctaaactttaataagccatttctgggactagccactggaatagcggggaagttcatccttattaaactgtatagaattttgttaatatttgaagttcccaataaaatcttgagtctaaatcccgggtcttcagcaagttaataatgatatttaatcttaagtttctcatttttgaaatagacataaaaataatgcttactttatgaaactattgtgaaaaataagataatgtatatagagaacttagctcaatgcctagaatgtttggtgctcaataaagaatagctttagtttctatttatgtaatttaatgaaatggatacatagtaacttagtatgtaaagagaatattataagaagaaacattaaagtttattatactgatgcataatttttgattatgttatttcttatagtgtgcaacctaacaatgagcaagtctattgttttattcccatgaggatgcctttcaacaaacatttattaaaaacttactatatatgaaacacactagtaggcacatgggataggaaaatattgatgataaacagtccatgacattaagtaccttacaatctaacagtcaaccctacaataaaagtcctccttcattgacacgagcatataactaccttaaactagtctggaataagatctctaatataattattctttaaaatatttaaaattgtatgctgtttttattttcacctgaattgttatttctccttttctactatctttggatttgtttctctccgggactattgtgacatccaaaaagagggctctatccttcctacctatgcatctttgtgcatacccaaactgccccttgcctcatagcatagtttgcccctccccatcatatagtgaatatatattttactataatttttaagaatctctgttcttttcatttgaattcctaaattaagtttgttgccaattcctcccaaaattcattaaagaaaaatatctgaggaactctgtgacagttcaaatagcatatggtatagtgacctagcttttgataataacccacccttatgaggtagtacttaaaacccatgatggagggagaagagctaaacaggcaccatgtatctacagaacagaaacatgagccactaaacactaaagttgaagacaaaacacatgtgaaagcaaatacgattagcacattatgcttctagttgaccaagaaccaattccccacagaaacttcttacaaaagttagagagtgctttgtccgtgtgctgatttcctgtgtcatgctttcaagtctcatccacactcattcccagttccctgagatttgcaagttgtcacagagccattcctatgtcttaacatgtaacagtattaatgcatttgtgtgatgtatttgtgtgtttttctatgtctgaaaggacttgttgaccataacataacacatattgggaactaatatggtgcttctgatgtttaatcacattttgactgcaattacatatttgctcctgcttttactgaatttggtctgtctttgccatgctttcctgtacatggagcctgctcatgaggcatagttcttcagttttattccttatgacctagtgttcagtgtaatcctgaaaattccaccctctgtgactcctcacaacatattctgacttctacaaagacctcctggataccttgcatgttatacacctttggcctttatgaattcgaaattgcactgatgctgttcttataacagtatccttctctgtgtgttattttaccacagatttattctttgtagtcctggcttgcaagatcttgcatgtccctttcctcctagttaaattatttgtctatacattgccataagaagacatgcatagcattgaagatcacctgccagttataaaataaaatcctgacattcagtgtaattataacatgatttatttatggttgcaagttattgtcttctactagcactataatgctatcactatactacttctatcatagtgtgctcaaaactgaatgattgttttgaacatgtccatagacttccttgtctctgctttcctttacttcaaatgcccaacccagacatctctccgtttacaaaaatgaacctcatttatttcagtttttctgtctccctattctggtccagggcacactatggtttttaaaatcatgaagacatatattattcaagaaattaaggtacaaagactgaaacaaaaatagaatttcatagtgtcctgtattccatttttagcatcactgcctataaacaccgagatatttctcatagagtgtaccagtgaaaccatcctcacagggttaacaagaattctggacagaaacatagttataattaagcattaatcaggctacactttgacccactttcttgttgctaaaagttgcatagcactagataatgaccatttgcatccttattgttcctatagataagatttctgacattaggagtataagagtgtttaagaagtaatttgcattcccattgtttctatagacaggatctctgacattagaatcataaggcttttgtttaagaattgcttaagattttattcagatcctgaaacatttgatgccaaccagtttgaagatcctcaccaaagaacagaatcagcataagtataatttctttatctccctgtttcatgactttgccctgcactcttcaaccagtcaaggatttccacattttggcccactccaaaactctaataaccccagctccaaactcttcaagaaaatggctttgtgggttcctcccatttattcgttcagtggtcctaaaataaacctctttctctgtggcaacccagtgtctcagagcattgatgtgctgcaggcatcaggcaacggacctgttatagttacaccagcttttacctaaagaaggaattcttatgttttccagacaatcttgaatccctgacatgtcattgctcagtcacttataagtgtcatgacattaaatgaagtattctgctttacagcatacactgtccctagaaagatgtatttgagggataatcactgtattactttgcctgggacaaaaatttggggccaatatatgaaacaagagggcacatctctcccacatctatttttggagacacataacttaaaagaacaaccaaatggaattcttaaacaagaaactttttaaaccagaagatttattattatcattcattttcccttagagaagatatgcaatatgtcttctgaggaaagggctctgtgatttgtcctactttgcttatgtaaggcagaaaaaatatcttttccttactcatcccaggtttatgttttaggcctctataagaaaagatatattggcctggcgtggtggctcactcctgtaatcccagcagtttgggaggcagaggcaggcggattgcttgagcccaggagttcaagaccagtccgggcaacatgccaataccccatctctagaaaaaatacaaaaaattagctggtgatggtggtgcatgcctgtggttccagctactcaggagggtggagtgggagaatcacctgagtccaggaagtggaggttgcagtgagctgtgatcacgccactgcactacagcctgggaaacagagtgagactctgtctccaaaaaagaaaagattaacaggagaaaagcaataatattatttcatacaagttttacatgacacaggagccttcataaggaaaggaaaatccacagaaatgttaaacttgtttatctttaaaaagattgaacaatcatggacaaacaggattagacaagggtatgatctaatgataataaactagggaaaacttagcaaataaggcttgttttcttagattctccttggcatgtctgtgcctttggctcctttcctccaggtataggtagagcacttctcaaatgaaggttttattatctttttcagggaaaaacagcagagaaaggtgagagtgacctttcttctgccattttttttaaatgccaagggtcatattttggggtagaatgtcctgaacctcatcatttaacattcagaacatgttttcaggaaaagggaaaaaatttaacatactattgggtataggttttaggattcatttgggactttctgcaggattgcttatgacacctttcatttagatcgtggttaagtgccatgttcttctcaaagctcttccgattacttaatagagaagtgatatcacccttatttcaactcgtatcaaaagggttcttgtagtacatgacattctgtaatgttcactccttgaggacaaaacctgttgcttatttcattgtaattccaatatcaaccaaaacaatgatttaaacatattaagtacttaaaattgtgactttggagttacaaaatcctgactctgaaacctgactgtattatttattatcagggtacctattgtttcctcccccagcaagtattaatgaagcatcatgcaatgtcaaactaaaaagattaaatgatcttaaattaataaactacctttatacattaagaacctacaaaaagaagaacaagctaatttttagtattgtgagagtacagttggtacaaacagaaacccatgtcttcaattctgatgtgctagagctgggtaccagcctctaagaacacaaagaagtttattgaatcatgaaacactttcaccttcttttgtgtcagactctcattcatccttcaattctttgataagtagctctttcttcctaaaagcctcctgtgttggttattctttttgctgtgtactaatccgtaaccccaccccaccttggccaattctccatccttctgccctgctctgggtcctggttagctgacccaccaagattgaataacctgggctcccttgcctcaagggtttggccaatgaaataaagtcagatgaaaaagggaacaggatgtttcctctcaagctccctccctgctctgggtaatatctagtgaacaccttctaactcaaatttttactacaattagtaacactgttttccctctttttcccttcagacacaagggtgggggtaagagtctcctgttctctatagatagtacctgcagtatttattgattcccttaatcccacctacatctctgtaaatgatccctttcttcaaggtttttatgccacctgagttgtattttatttcttactaagattttgacggtacaccttctctaagtttttagattaggttagttgctcccactgtgaacttacatctcaccctgtacttctacattacagcatttatgatacattactgcaattatttatttaaactcttgatcttttcttccagactttgtgaagaaaggtatgcattctatattatgcactattttgttagccagttctcctcacaaagtttagcatcagcaagtagtaattgagcgttaacaaatgagtaattagtaggtgggataattatttctcttcaaaatatttcataacataataaagataagctctgaaggatgacaatatttcatcaaaaatagctctatgacagatcatcaaagaaagactcatgacccaattctttatacatgatgccagagaatcagttcctttctgtcctggtttagactctggactgcaagataactcaggtcttttagatctttcaaaatatttataaaccaaaaaactattcccttgcgtaaaatatttccagccctgttagagttggagagctgacattgataaaacactgggcaagttaatgagtattatggttaggtgtctaccggtgtgcagacctgtgtgaggctctgtggcatgatatagtatggactactaatgttgttgtctgtgtttgactcgtatgctactataagccttatattataggcatgaatcattttccctggaagccttctttaggagccctcctgagttcccactacctcttaatttgtagatgaggaaaatgtaaggcatttcagaaaccacttttgaaagtcaggaatattttgccttttcaatggaatattctgttctgccttctgtaataaagctgcatcttatttgtctttcagggcatgggatggtgtttggcaccatagtaaaaacaggataaattcataaaataaataaagaaaaagttaagcagtaaataccagacttgcctaactcagtccccagaagcatatacttctttacagagagagaaactaaatggacatgaagaaaggagcatcgaaatgatgaagcatattccctgggagataatatatgtcattctaaaatacagaggtatgtgcaaaccctccagctgcagacacactgctctttgaaattatacattgcatggatttgaacaacaatacttaaaaatgaatgtagaaatggcaagagcagcaaaacatagttgctgaactttaagaagcagaatatttatatgagaaagactaaagcttctgctatcagtatatcagttctgaaattcagagaaagtagtcttacacaaagaagggttagaggtagaatttggacacttttgttaacaaaaagggggatgcaaaatcaaggcaatgaagtaagaagatccataataaatttggttttgagttactttagtcactttcagtaaccacatccatgatgcatttatttgcaaattcctataaatctataagtgcattaagtgatgttgatcatcaaaatatagctcaatctattcctttacttgcatacctttactctaatccccttttgttgtcttcataaaatcataagtaataagtcatgttagggattattaagtagaaagacatgaaataggtgtatgaagccaaaataaaaatcatgatattgattttctaacttcacaaactaggcaactataacttaaaaaattaatgccctacagataattagttatcatccccatatggatgattactccctttcaggatgaccagtgatttgaggaaagcctggggaaagtgttggtgatggtcaagtccttctttttacacttcctgttctgtaaaaactaaaatacatttactcaatacttttttcttgtctcaaagacctcctgaatattttccagatacaaaaattccttcttccttcattgattccatggcagtgaagtaatgatttttcttcccaatagcgtacgcttctgaaaagcagtaatgatgaacacttcccactattagtggaatttgtttattgagtagtgtaggccctgatatcgacttttagaatttcagttctctgtttcatcataagcaaattccacatgcattttattaaacacccactttcttcacattcgactgactaatacaatgtacagatattgtgtaaacctctctagtgctggagaaatgctattttatggaagtggtaacttgatatgaaatagtaatttcatccttaaagaatgtaaagcctctccactgttcaaacaaggctgtggtgagatggacaaacatacaggaatagaaaagcttatcagagtctcagcagaatcttaaaaacatctcagccaaaaacattgctggagtgaaaggaaagcagaagtacagggactagaatgagatcatagtgggtaagggtagaaattcactttcttggggaagtgaaattcactttgtgggaagaggtaaaatctgcctgagaagttaaaaaaatgtgatttgagttaagctttgtagaaagtgattctaaaatagctgttacatgggatatccactagaagcaaggagactaagttggaagctattaccaagactaaggaaagatttgttatcatgagccaaatattaatatgtggtcaaaatccaaagaatctacccaggaagggagaagtcaatgattgccagaggtcctggggttcagccctggaggagggagattcactgcacaggtaattagcgtagatgttcaagtactgaagtttctagcaggcagtggaggacctgcctggctcgagtaaaaagaaatgactaagaaatgactaagttataacaatgctagtgaggaatctattttcaaggtcttatttcattgaatactaacactcaacacatcatacaaagatgacagccaataaatgttgttgatgagcatgactaagttaaagttcaaaagtttccatttttagattgagagtgtcaaaaataagaatgataaaagaacttaaaaaaattagaaaacttcatatggaagaaaggaaaaaaatgttaccttggaataagtaaattttatgtttcagtatttccaaagaatggcataatttatatcatagaggtttttttaaattctcaaattatcctgattagtcagatttggacttctgattgagaaaaataaggcttcttagaaataaactaaacctaaggtgagccataaaaattagattactattactcttacacatacaataaaatagtgatactgaaattactattagccaaagagaaagtaggtagggtatgacagaaatgtaatggggctagagagagtaaatgaaagtattaaaccaagtcctaacaggataacaagagcagttatgtttcttggaattttactaataatttttggaagaaatatttccagtgttaactgttcattttaggattatataatcttcttccattaccttaaagttttgtcaaagtctgctacaagcaggagccttttttaaatagcactttggaggaatgaaaggaaattgatgatgtccagcatgggataaactaggtcaagaagaaaagagcaattggaaaaacagttgaaaatgctgcagaaacaatacatagaagcaagagagaccaaaagaagtatggttatctgcaagggaacccttggagatgttagggatgcatggcataaagctgattcactgtgcaccggctaccaacctgtgtgagtctggtgagagagaatatactcacaacaagttacatgaagtggatttattacttacagataggcatcaagagacagaagaaattttggatccattgtgagctggtaccccaaggctcaagaaagctgccaggggaggatggtctttagtgtgcatgttctgtttgcaccatggctgagggacctgaaaaaacagtccaccatgggttatatacctttgggataacataacttacttggcaatgatttgaaggacactctgcttcaaggggacagagaagcaaagcctaggctgtccctggaatttcctttctacctcaagaaattacattccctaggagggacacaaacaaggcgtaggctgttttgggcagttctccctatttcatggtattgaactctcagcacattctacagttattcttgagaactgcaggcattaagaggagaaatgggtcagtctaaggccacccagaaaatggtcctgcacatgtgacttccctcagtaactgggttgaggacttgagccattgtgtttggctatgaaaggaaagcatgaaggtgaccatatcaagcttgagactttggaggatacagcagacacttggtgtacacttagatctgcattatacagaaagaaaataattcaaaatttctcttttaaccaagtgaaaatagacacagaagagtcaagagttttctgaattcactaagctgatgctagagtcaggtctccaaatgcttattttatggtattttctgctataaaattctcattctatatctaaaagaaaatttagaaaacatgcatcaattttatgataatttctaaaataagtaaaccctgattattattttaatttatccaaatgtttattccattactcattctgactctcagtgacttttttccacatgtggccgtgtgtaaagcttaaaaaaacaagccacattttcttaatccagtctatcgttgttggacatttaggttggttccaagtctttgctattgtggatagtgccgacatatacaccatggaatactatgcagccataaagaaggatgagttcatgtcctttgtagggacatggatgaaactagaaaccatcattctcagcaaagcatcgcaaggacaaaaaaccaaacaccgcatgttctcactcataggtgggaattgaacaatgagaacacatggacacaggaaggggaacatcacacaccggggactgttgtggggtggggggcggggggagggatagcattaggagatatacctaatgctaaacgacgagttaatgggtgcagcacaccaacatagcacatgtatacatatgtaacaaacctgcatgttgtgcacatgtaccctaaaacttaaagtataataataataaaattaaaaaaaaaaacaaaaaaaaaaacaaaacaagcaaacaaaatgcatgtgatctaataatagaaattcagagaagctctaaatatattaattaaaaatacagtgtttcccttacaaaatgtacatcaaccataaaacaaaggtgtatacgtacagaatacagaaaaaaatacataccttgtcaaccatatgacagctcctgaatgagataattttctatgagtctactactttaagaagtcatgcaattctcaagcaagatagccaactagatgcagccaggaagaccttctctcatcgagaaacctgatgataaagaagactagcacacaccaagcattgtcggaaggcaatgagactggatagaagagggacacagactctgggttgaagagggtggtagctgggagccctacatggggttgccaagcaccaggacttgtttctggcattcagcagcttttggtgaatgagtgagttaagtagatgcagtgtggcccactcttggcacaggcctccataatcctacctgcagtagaccccactaccaccatggacgcttgggctggctgcgtggagagttgtcagggacaggactccagcctgcatggagcccagagtgtttggcatgataatggctaaagtggagcactgccagggatgcctgtctcccaaagtttgttatgcgcctttaggtggctttggcctttgtcgactcttggatttgacaaaacagggtttgttgcccatgggacagggccagactgatctgaatggcaacagttttccattctcccccagggtccctgcctagttgcacccacttgcagtgcagcttcaaatgctcaaccagggcataacccagcagccactgccatatagctcttttgccagaagaccccgcctaatcataagagaacttttgcagataggcccctgccagcatgcacctgaccacagccacccactgacactttgctggcacacatgtgtagatcttgccaccaccatcctactgccacaagcatgtgaatggaccctactgccaatggagcattcatacaagcatgggctctgctgacaccacctcaatgagcacttttgccaacaactcccataggagtgttgttgccaggagaccaggaacacctctgcccatctagtgcactacgtgcttaaccttgaggggccaaagaacacagccatgggcctggtaccaacaccccagggttagagcatgcagccaggagtgctgagctgagccttattcccctgaaagcatccagacatgaagccagttgtctcaactcaacttataccacagtaaaaccctcaaaaacaccaaggaatatagaaacaaaaagccacatccaaaggacagcaacatcaaagatgaaaggaacatcagctcacacagatgagaaagaggcaatgcaagaactctagcaactctaaaagccagagtgtcttcttacctccaaataaccacactagtttctcagcaatagcccaactgaaatcgctgaaatgacagacatagaattcagaatataaatggcaataaagatcattgagattcaggagaaaattaaaacccaatccaaggaatttagtaaaatgattcaagagttgaaagacaaaatagctatattaagaaaaaatcaaactgattttatagagctgaaaaactcactataaggatttcataataaaatcagaaatgtttgcagcaccatagactaaacagaggaaaagatctcagagcttgaagaccatttattcaaatcaactaagtcagacaaaaataaagaaaaggacaataaaaacaaataaacaaagccactgagaaatatgaaaatatataaagagatgaaacctatgactcattggcatccccaaaagagggagagagagcaagcaacttggaagatatttttaatattgtgcatgaaaatttccccaacctcaatagagaagttgacattcaaattccagaaaatcagataacccttgagagatattatacaagatgaacatctcccaagacacgtagtcatcagattcttcaaggtcaatatgtaagaaaaaatatattaaaggcagctagagagaagggacaggtcacctatgaaggaagcctgatcaggctaacagcagaatattcagtagaaacatgacaaaccagaagagacttgggatatatatttggcatccttaaagaaaagaaatgccaaccaagattttcatatccaaccaaactaagcttcataagtgaaggagaaataaaatccctttcagataagcaaatgctaagggaatttgttaccatcagacctgccttacaaaaggtccttaagagagtgctaaacatggaaacaaaagaccattaccagccacaataaaagtccacttaagtacaaagtgtattgacacaataaagcaaatatacaatcaagtctacataataactagctagcaacgtgatgacaggatcaaatatgcacatatcaatattaactttgatcataaatgggctaaacgccccacttaggcacagagtggcaaggtggataaagaagcaagacccaacggtatactgtcttcaagagacccatctcacatgcaaggacatccatagactgaaagtaaaggaatgcagaaaaatctaccaagcaaacagaaaacaaaagaaaacaggagtttctattctaatttcaggcaaaacagattttaaaccaacaaagatcaaaaaagaaaaagaacagtattacataatggtaaagggctcaattcaacaagaagacataactatcctaaatatatatgcacccaacacatgaacacccagatttataaaataagtatttagacacctatgaagaggattaaataattacacaataatagtgggaaactttaacacctcactgacagagaaatcatcgaggcacaaaactaacaagggtatttgggacttaagcttgacacttgaagagatggacctaacagacatctacagaacattccacccaacaaaaacagaatatactttcttcttacctgcacattgcacatactcagatcaaccacatgctcagccataaagtaactctcaaaaaattcaaagaaactgaaatcataccaaacatattctcagtccaaagtgcaataaaagtagatattggttccaagaagttctctcaaaacatttcctcctgggtgacttttgagtaaacaatgaaactaaggcagaaatcaagaaattatttaaatgaatgaaacctcaaagatacaacagaccagaatctctgggacacagctaaagcaatgttaagaggaaaatttacagcacaaaatacacatatcaaaaagttagaaagatctaaaattagcaacctaacatcacacctcgtggaactagagaaataagagtaaatcaaccccaaagatagtagaagaaaaataaccaaaatcagagctgaattgaatgaaatggagatgtgaaaaatgatacaaaagatcagtgaaaccaaaagtttgttctttgaaagaatgaataacattgatagactactaaatatactaattttaaaaaatccaaataaacacaatcagagatgacaaagaggacattgccactgatcccacagaaatacaaaaaaaaaaaaaccctcagagaattacaatcacctctctgcacacaaactagaaaatctaacaaaaattgatggaatcctggaaacatacaaactttttgtttttttttttttttgagacagagtctcgctgtgtcacccaggatggtgtgatctctgctcactgcagtctccacttctcgggttcaagtgattctgctgcctcagcctcccgagtagctgagactacaggcgtgcaccaccacacccagctaatttttgtatttttagtagagacggggtttcgccatgtttgccaggctggtctcaaactcctgacctcaggcgatccgcctgcctaggcctcccaaagtactggggttacaggcgtgagccactgcgcccagcagaaacatagaaaccttaaaagtgcctcagtgcctaatttcctaccattctccatcctagattaaatgacataaatgactgattatactgtaataataccaatatctataaaggggaattcttttattcatattaaaataaaccaactcttctaaaacctaacagaaaacttgtctagtttcctagttttattgtaatttgagtagaaaaaatgtttcttagaggatccattttagcacagaattgatttcatttatatcttcaaatgatcagagcaatattgtgtgctatgtgtctaatctttcactggctactatgggggaaatttcaggtgacactaatgaatctttcaagtttcaggaagctgaacagggatacagccaactggtgaagtatcctggaaataatgaatagtgaggacatactatcagaaaaaaaagacaaatttttgttactatcattaaatatagggcttttttaaaagcaccctttttattgtattcaaatatctaatttatcatgtgtacttttaaaaagaaggacatttttaacaaaatttgctttggaactatggaattgagacagaagggctgctatcaacatataatcattattggtgctaaacaattcaagatttgtaaagatttggcagaatttgggggaccttccaatagtaagtgtgtagtatttctgaacacagaaaaggaagtgttttggatagcattagattccaacacgtttctcaagcagttaagtgcactgaggattccatctgtggcttttgtccaccattaggttctcttcaagatctgtctgtggatcagagagggaaatgtgggccacaagttgggcaaaaatggaccagggagtttttattcttttgattattgtggttattattagtgggtcaaatttcaaattattttcattgctagggagaaaataattttgcttgcttgggtttattggcttacaggtggaaatttaaaatatgggcttaacaaatccttacagaaaactggacattctcccctctattcatattttatacagcagtgcaacagagatattggaatctcacagctattaagattctgtgaacataattcacagaatgcttccctgaggggatgtccactcaagtgacacttcgggtctctttctcttcagcatctgtaactcatttatgaggctggatcaatattgtggaccaagtatgctccaggtgtttcttttactgaagtggctaacgtattgaagcaagaccaccttcctagcaagagaacaaccatttattttttgtttttgtttttgtttatttctggtctgggatatataagttggcatgtgcctctgctagaggaggcagacactgagttttagcttctgaatatacgtgttttcaataactatataaaggtaattctgtaatcctctctggcttgagggttttgcaaaatttttctcatgacaaattgaaatttttaatatatttgagacccattgcgttagcgattgttgtggacattttattgccaaagaatgctcctgagtgaagagacacatatttgtttaatttctaatcccatgttcattgagctttacttgacaatactcaaaagatttctcaatgatccccaaacttttcctttttaaaaagcaaattctgtaatttttccttttattgctccttatatttttctgtattaactcccttgccgtttttgtgttttcccaatcttgatcttgtatttggaccagtaatacccatatctcctccaactttcttaggaaaatatctaggtttttttggaacaaggagcttatataattctgtgtgagggactcttaagagaaaggatataatattatcataacccaccagagccttggaagaggcctgtgcaaatgaagagttccgaagattgagtttaattagcttcatgcgaaatctgcccataactgttaatttatcccagacctgattgtcctttccattgatttctcattatatattcattagaggacaactaacagagcttatgctgctaagcataagcttaaaatttattcagcacaccattttcacttactacaaagaaaccagttttgcaaagaagcagcagtggacttggcagaaattctgagacttaattcttaacgatgtaaatctgtctatgaataaaactggagctagatgggattataaactaggcaggcaatgcaaccttcactctgagcaatgcaactttcactttaaaagagagggagcagaagaaagagaggcatggatggaggtgacaaacaggaaagcagtgtatttcttattgtgaaaaagaataaataaatttaaaggaatttcagaagctgttgacaatagtgagttaacagatatattaactttttggtatatttagttgatgttcaacatatctattcctactgctagagaaatagtgtgaactgatagacttcagcctttgaaattaaatagacctcagtataaaccctggctctgacacttaatagctgtgagactctaatatctctgttgcactgctgtataaagtatgaataggagaatgtccagcttgctgtaagggtttgttatgatgtatgtgagtgtgtatgtatgtgtacatatatgatactgaatgaatcagcagtcatagcattattagtatgaaacaatcaatatgtgtgtatatatacctgtatacacatatatgatgggtatatcatatatacatataaatgatataatggccattaaataaaaattatagattaaatatttataaatatccatatttaagacagagcaataaacctgtcatttaaatgatttccagtgttatctactttattattattattattactattatttttgagacagagtcttgctctgtcactcagactgcagtgtagtggtgtgatcttggcccactgcagcctccacctccctggctcaagcaatcctcctacctcagcctccagagtacctgggcctacaggtatgagctatcactcctggataacttttgtatttttttagacaagatttatccatgttttccaggctcatctgaaactcctgggctcaagtgatccgcctgcctcaccctcccaaagtgctgagattacaggtgtgaaccaccacacccagccagtcttctatttgtttaaaaaatttcattaagtattttgcttttattataatcatagtaataattttgtggataaatgaatgcatttttcatttttttcttttgcattgcagcttgaatcaagcagccatattcccttacctgcctctctctcaaagttgcattctagcaactgtaatttaaactaatgttcttattaaataatttgttttagggacaaaaattaatcaaagtgataatggcttttccattctcataagcattattctgttaaagttatgaaccatcttgagttctgagttataagaataaagtgagttggggtatctgagatttaaaaagattatttattggaattctagataatgctcatatttgacagcaccagtatttgaaaagaaagagaaatctgcataattattaaggagtaagttggaaaacccatatcagaaatctggtatcactaagagcctagttcattgatttttcacacttcagattggggtttatagtgagatgtgaaatcaatttctaagtcctgatcagcatcttaaaatggaatagaattaagcagaatagaacaaaacagaataaaaagtaggaacagtgggttaaatgagtagttctacagaatatcatctccccatccctgatcattcactaaagagttaatgtattaagcgagatcataaaactggacaattctaagtaataaactagctctctgacatattctaaagttcacttaattctactaaaataattttacatatataatattgttttctaattgagcaatactttacagaaaacaaagtgaaaatattttaattatacagttcaataagttttcacaaacatatgcatccatttaacaactacccgtattaagatcaaggtttctgtcatttcagaatgttcccctgtacctctatctagacagtacttgaacccatgtagatacacttactgtttatatttgtcaacatcctttagtgtttccccttaaagtacttcatgtgaatggaaacattaaaatctgatgtgttttgagcctgggttctttcactcaacatgtttttgaagcatttttcacattgattcgaatattacaggttcatcatttttatttcttttcactagtgaattgaatacacatactaaatatttataatactgataaacatttggattgtttctatgttttggcaactatgaaaaaagctgtggtaaatatttttacacacatcttagaaagaatatatgttctatttttggccccagagtcactgattcataggataaggtacatagtaactttattttttaaaaactcccaaactgttttccaaagtgctggtatccttttacattcatgcccagcaatgtatttatcaatcttctacaatttagctaaaaaagtgtgaaatagtaaatcttactaattttaatctgtgttttcttactgactattgacttttgagaacctttcatttgctaaatggcaatttctatatcttatttagagaaatggtgattggaaaccattgcccatatcagatgtttgtcattcttgtcataggagttatttatatgttataagttctttgtcttgtgaaataaaatattttccccacttttgacttactttttaatttccttaacagtatttttaataaacagagcctttaaatacttttaataaaatacagactattttctcttatgatcagtggcttctgcatcctaagaactttttgctaatttcaaggtcgtgagcatattctcctctgttttttcaagaaggtttatgattacagcttgtatatttagatttgtgattcaacacaaatatatttctatatgatgaaagagagcaatgtgggtttatttttcttatgggtatccaattgttttagcaccatttgttgaaaagattatcttttccctcattgaattggttggcattgttgtcaaaaattaattgaccataactgtaaaggtatacttctggactctcagttctattttattgacttatatgtttattcttaagctagtatcacgttgtctttattatgctagctttacagtaagtcgtgaaatcaggtcttccatacttagactggtcattcaagattggttgatcatatctcttttgtatttccatatacattttagaatcagcttgtaaattagtgtcccccaaaagaagttagacaatgtttttattagaattgtgttgactccataggttcatttgataagaataggcatcttaatattgaatcttccaatccattaatgtggtatgtcacttatttacattttgttgatttcagtgtagaggtcttgtgtacttttgttaattttatttctatggctttcatgctttgctgctgataaaaatactattgtttcaacttttggttttgctagtatatgataataatttttttttatattgagtatatatcctttgactgtgccaaattcactcattagttctggattccttaatattttctctccctataattatgtcatttgtaaataaagattgttttacagctatttttttttaatgcttgtgccttttaaaaattgccttaaaacactaccaagcatcctcagtaaagtgatgagaatggatatccttgctttggtaattgctatctatggtctgaatatgtccccaaaaattaatatgtagaaacttaatttccaatgtgataatattaagaagtaagacctttaggaggttagtaagtcatgagagtagaaccttcatggatggaatgacggcttttataatattgaagcagtgagtttattctgttctgctcttccactgcgtgaggacaagggaacagcatctgttgcttttgcccttctatcttttctgccttgtgaggacgcagcaagacgcaccatcttggaatcagagaatagctgttaccagacaccaaatattcccaacatattaatcttgtatttccagactccacaaccgtgagaaacaaatttctattctttataaattaccctttctcaggtattttgttatagcagaacgaatggacataaaaagaaagtgtatacaattttacaattaagcatagtgttaacgacagtatttttaacaagggtattttattagattgaggaatttcacttctgctaaatagtgtcaaatctattgagaagatattgattttctcctttattctgtaaaagggcgagttacatcaattatttcaaaatgttaacgtaagcaatgttttagaaaaacttaaaatttatatttctggcttatgttcttgctagtcactgattttatggttttcttctggttagaaaaaatattgcaaacataatattcgtttgttctggttattgctgaatatggcttcctagccattattatacacaaaactactactttgaaagttattttcttaacttataattatttttggaagaccattgattcctagtttcactggtaatgtcacttctcattgaaataattaaaattactcttaagctcatatttaaatgctatagaaatttaatttaatcagatattcttatactgaatttttaaaaactcagaataatttttctaaacaaaaataatgcaaaaacaagttttctaaatccaataattaatcttgaaagaattttgaacttacagaaagggataattgtcataactaataatgaaaatccttaattgataagtacagtctagacacaagtgatacaaataatttcctacagagctgaacatttttagttaactgttattttactgttcatattaaattgaagtatcatacatttgtatttttctattattttatattgtcttgtgtgcctcattgaatgaatataatagatactgatgttgtagttttgtttgcctttttttgttttgagattaagaaatttctagttatttttaaaagaaggacaaaacagtgagtaaagagtcagtttcacatattgctttaaaacggtacatgatggggtaaatttagcaaaatctaacaaacttatacattctgtctctctttctctttcattgcacatacttttttattttttatttttacttttttgtttttgcatatactattttatatttgccgatatgtattcttaggatgggttcttaggaacaaattgaatcaaagccacgtgaagaaactggggtgcttaacatatctgaaatcaccatttattttagatctgtaataattacatcagtttaatattgtatatgaaagtagttctaataaatagagattacgtacagatccattgatacatgacagatatttcagcatataccaatgaggacagaaatggctattcaaccaatggaaagtggtctcacagttcctggtccctgttactgatctttccactctgcctccatgtgatcaatttttttttaatttttattttttgagacagagtttcactcttgttgcccagactggagttcaatggcataacctcggctcactgcaacctccgtctcctgggttcaagcaattctcctgcctcagcctcccgagtagctgggattacaggcgtgcgccatcacgtctggctaatttggtatttttagtagagacggggtttcaccattttggccaggctggtatcaaactcctaacctcaagtgatccacccgcctcagcctcccaaagtgctgggattacaggcatgagccacggctcccggctgtgatcaaattttttagattccaaatataaatgagaacatgcactatttctgttttgtacatggtttatttcacttaagataatgacatccagttccattcatgttgcttcaaataccataaattcattctcttttcctttttttctccctaatttttagtttttgtgggtacataataggtatacatatttatggggtatatgggatattttaatacaggcatacagtatgtaataatcacatcagagtaaatggggtatccttaacatcaagcatttatcctttgtgttataaacaatccaattacatacttttatttcttttaagatgtacaattaaattattattgactatagtcaccctgttgtgctatcaaatgctaggtcttactcatttcttctaactattgttttgtacccattaaccattcccacttccttcccaccccctcactacccttcccaccctctggtaaccatcattcttctctttatctgcatatgttcaattgttttaatttttagctcccacaaataactgagaatatgaaaagttcatatttttgagcctggcttatttcacttaacataatggcctctggtcccatatatgttgtggtaaataacaggatctctttctttttacagctgaatagcactccactgtgtatatttaccacattttctttattcattcgtctgctgacagacatagtttgcttttaaatcttggatattgtgaatactgctgcaataaacacgggagtgcagatatctctttgatatatagatttagattttcattatttggggtgtatacatagcagtgggattgatgggtcgtatggtagctttatttttagttctttgaggaacctccaaactgttcttcatagtgattgtattaatgtacattaccacccagtgtgtatgagagttcccttttctccacatccttgccagcatttgttattgcctgtcttttggataaaaactttttaattggagtaagatgtagttttgatatgcatttttctgatgttcaaagatgttgagcactttttcaaatatctcatatgccatttgtatgccttcttttgagaaatgcctactcatagcttttgcccagtttttaatcagaatattagattttttcctatatagttatttgaactctgtatatatttcagttattaatccattatcagatggatagtttgcaaatattttctcccatcctgtgggttgtctcttcattttgtgaaatgttttctttgctgtgcagaagctttgtaacttgaaatgattccacttgtccatttttgctttgattgcctgtgctttggggtattacttaagaaatgtttgcccagaataatatcctggagagtttctctaatgttttcttttagcagtttcatagtttgaggacatcaatttaagtctttaatccattatgatttgatttttgtatatggtaaaagatatagggtctagttgtatttttctgcttaagaatatccagtttttgagcatcggttattgacaatgctgtcctttacctaagtatgttcatggcacttttgtcaaaaatgagtttacttatatgtatggatttgattctgagttatctattctgttctattggtttatgtgtctgtttttatgacagtaacatgctattttggttattatagttctgtagtataaattgaagacagataatgtggctttttcagttttgttctttttctttagtacagctttggctattctgggtcttctgtggttccatataagttttaggattttttttatttctgtattttgatagagattgcattgaatatgtagatgtatggacagtttaacaatattgattcttccaatccacggatatggaatattttcccatttttctggtgtcctcttcaatttcttacatcaatgttttgtaatttttattgcagagatctttcactcctttggttaagctaattcctaggaattttattttatttgtagctattgtaaatggtattactttctttattttcttttcaggttgctcactgttggcatatataaatgccattgattttttgtatgtcgatgttgtattctgcaactttactgaatttgtttatcagttctaatagttttttgtggagtttttaggtttttccaaacatgagatcatatcatctgcaaacaaggaaaatttgacttcttcctttctaattgtgatgccccttatttatttcccctctctgattgctctagccaggacttccagtaccttggaacttccagtactatatcccctctctgttgctccagctgggacttccagtactatgtgtttcactctgctgaataacagggtgaaagtttacatccttgttgtgttccagatctcagaggaaagactttctgtgtttcctcattcagtatgatacagtttcctgaagcctccccagccacgccttctgtacagcctgtggaactgtgaggaaactaagcctcttttctttataaattatccactgtcaggtagtttttcataacagtgtgagaacgaaccaacacacaatttaattatactctttaagttattttaaaatttacaattaaattattattgactgtagtcaccctgttttgccatcaagtagtagttcttattcattatttctggtttttgtacccattaaccatcccccacatccccccagctccccactgcccttcccagcctctagtaaccatccttccacagtgggtctgtcatatacggcttttattatgttgaggtatgctcgttctctacccggtttttcaatgacttttatcatgaaaggatgttgaatattatcatgtgagttttcggcataaattgaaatgatcatatgctttttatccttcattatgtttatatgatgtatggcattgattgatttgcatatgttgaatcatccttgcatcccagggataaatcccactccctcatgatgaatgacctttttaatgtgttgttgttgaattcagactgccagtatttcgttgaggatttttccatcaatgtttatcagacatattggctaatgttttcctgtttttgatgtttctctggttttgctacaagagtaattctggacttatgagtttggaagtagtccttctgcctctattttttggaatagtttttagtaggattggtattagcttttttttttcccccccaaggtaatttaactctttttattgtactttaagttctgagatacatgtgcagaacgtgcaagtttgttatacaggtatacacgtgccacggaggtttgctgcacccaccaacccgtcatttgcattagatatttctcctaatgctatccctcgccttagttcttaaagagtttaataaaatttatcagtgaagccatagcatcctgggagtttctttgctgggagactctttttatggctttgatctcattatttgttattggtctgttcagttttttgatttcttcatagttcaatttcagtagattgtatatgtctaagaatgtattcatttgtttgaggttttccaatttgttgacatagagttgctcataggagcctctaatgagcctttggttgtaatgtctccttattcatctctgattttatgtatttgggtcttccctctcttttacttaggctggctaaaagtttgttaattttgattattttttcaaaattccagcttttggctgcattaatctttttttattgttttcttcacttcgatttcattctgctctcatctttattatttcttatctattactaattttggatttggtttgcttttgcttttctatttctttaggatacattgttgggttgctcatttgatatttttcctttttttcgttttgggcacctatagctattagtttccctcttagtactgcttttgctgtatcccataggttttaatattttgtgttccattatcatttgcttcaaaaatttttcaattttcttcctaatcttttcattgactaactggtcattcaggaacatattgtttaatttccatgtgtttatacagtttccaaaattcctcttgttttttatttctagcttcattctattgtggtcagaaaagatacttggtgttttaaatttttttaatgttttaaaacttgctttgtggctttaaatatagtctatcctttagaatgatccatgtgctgaaggtaagaatttgtattctgcagccagtcaaagaaatgttccataaatatcaattatgtccatatgataatctatagtgcagattaagcccaatgtttctttgttgattttccctctggatgatatgttcaatgctgaaagttgagtgttgaagtttctggctattattgtattaggatctatctatttctttagctctaatatttgctttatatatctgggtgttccagtgtcaggtgcatttatatttttacaatagttacaacttctgactaaattgcccctttatcttatatagtgaccttatttgtctcttcttatagtttttgtcttgaaatctattttgtctgatataagtttagtgaaacttgctcttttttgtttccattagcgtggaatatatatatatatatataggtgggtacatagaaggtgtgtatatttatggagtacatgagatgttttgatagaggcatgcaatgtgaaataagcatgccatggaaaaaggggtatcatggagaaagggatggctacctccccttgagaatctatcctttgagttacaaacaatctggtatagtttgcttctgtgttcccactcaaatctcatgtcaaattgtaattcccaatgttgggggagggacctggtgggaggtaattggatcatggcagcagatttcccctttgctgttctcgtgatattgagtcagttctcacaagatctggttgtttaaaagtatgtagcacttcaacctttggtctttctttcctgctccaccatggtaagacgtgcttgcttctcctttgcccttctgccacgattgtaagtttcctgaggcctccccagccatgccttctgtacagcctgtggaactgtgaggaaactaagcctcttttctttataaattacccattgtcaggtaattcttcttaacagtgtgagaacaaaccaacacataattcaattacactctttattttaaaatttacaattaaattattattggctgtagtcaccctgttgtgctatcaaacagtagtttttattcattatttctgtttttgtacccattaaccgtcccccacctccccccagctccccactgcccttcccagcctctagtaacgatccttccactctctatgtacgtgagtgcaattgttttgatttttgatccccaaaataagtgagaacatgtaatgtttgtcttccgtgcctagcttatttcacttaacaaaataatctccacttccatccatgttgttgcaaatgtttcatcccatcattttcagtctatgtgtgtctttatagatgaaatgtgttccttgtaggcaacagatcactcggtcttgtttttttgtatccatttagccactctatgtcttttgattggaaagttcatttcattgacatttaatgttattattgataagtaaggacttacttctgccagtttattatttgttttatggatgtttcctggtcttctcttccttctttctttccttcctgtcttccttttagtaaagatgattttctctgatgatatgatttagcttctcttaattttttgtgtattcactgtatgtttattagtttgaggttaccatagacttgcaaatagcatcttataacctattatttaaaactgatggcaacttaacactgattgcatatacaagcaaaaagaaaataaataaaaactctataactttgtctccctgctttttaagtttttgtttttttctatttgtatctcattgtactgtctctgtcatgacaaattgttttagttatttttgatcatttcatttttttgtctttcttcttaagatatgagccatttacacatcacaattttggtgtgataatattcttttttttcctgcgtgcttactattaccagtgagttatggaccttcagatgatttcttattgcttattggcaattttttgttcatattgaaaaactccttttagcatttcttgtaagacagatccaatgttgatgaactctctcagcttttgtttgtctgggaagtatttatttctcttttatatttgaaggatatttttaccagatatacttttctagagtaaaagttgttctgcttccgcactttaaatacgacatgctactttctcctggactatactatacagtttctactgaatagttttcttgcagacatattggagtttctttgtatgtcacttgtttctttactattgctgcttttagaatctttccttgtccttaccctttagggtttgattgttaaatgccttgagatagtcttcttttggttatatcttcttggttttttatatctttgttgtacttggatattgacatctttctctagatttggaaagttctgtgttattatcccaatgagtaaactttctactcctatctctttctacctcctgtttaaggccaataactcttatatttgcccttttgaagctattttcttgatcttttaatcatgcttctttgttttatactcttttttattttgtctcctctatatatttttaaatatgtagactatatttttaaatagcctgtctttaagctcactaattatttcttctgcatgattaattctgctattaaaagaccaatgcatttttcagtatgtcagtggcatttttcagctccagaatttctgcttgactatttttagttattttaatttctttgttaaatttatctgatagaattctaaatttcttctctgtgttatcttgaatttctttgagtttctcaacacagatatattgaactctctgtcggaaagatcacatatatctgtttctctgggattggaccctggtgtcttatttaattcgtttgttggtgtcctgttttcctggatggttttgatatttgtggatgttcatcagtttccaggcattgaattgttagatgtttattgtagtcttcacaatctgagcttgtttgtatgcatccttgctgggaaggttttccaggtattcaatgggactttggtgttataatccaatgttttttcattgtagtcttatctgcattaccccaagcccaataacgctgtagtccttgcagacttgtagttgtaccaccttggtggtcttggataagatttgggagaattctctggattacccgttagagactcctgttctgttcccttaatttattccaaacaaatggagtctttctctgtgctgagctacctagtgctggcgaaggagtgacacaagcacgactgtgtctaccactactgggattgtgctcgatcagacctgaagccggcagagcactgggtcttgtcaaaagctgctataaccattacctggttactacctatgttcactcaaggctgtagcactctataatcagcagatcatgaagccagtcttatgtccttcccttcagggtggaaagttccctggggccctgggtgggtacagagatgccatctgggagccagagatcagagtagaaaatcccccaaatccatctggtgctcttttccatggtggttaatctggaactgaaaccagaagacatggttcttcccattcttccctcccctttcctcaggcaaaggagtgtctccttgtgtccaccatcaccacaggcctatgggggagtactgacagcatacccgtgatgttcatttaaagccaaatggcttccaatatgctagtggtgattctaccaggcctgggactcacctttcaggacaattgactcccctctttgccagggtatgtccagaaattccatccaagatccaaagcctggaattggggactcctagagaccacttggtgctcttcctcactttgtccaagctcgtacctaagttgcaagacaaagtcccctatattcttccctcttcttttctcaagcagaaaaaggtctttccttgaggccaccacagctgtgaatatgctgggtcacacctaaatgaagcacgactcagagtctcacccaaggctcaaggcatagattacctccttatagttgctgattattcagggctcaagttctcttaagtcagcaggtgctgaaccctgtcaagactgggtccttcccttcaaggcagtgcattacattctagggtggatctagaaatgtcatctgggagctagggcatggaatgaggcctcatgactctgcccagtgccctatcctactgtggctgagctggtatttaagttgcaaaacaaagtcatctttactctttcctctcctcttctcgagtgtaaagttgggatttcttttgttattgtaggctgtgttgtctggggttgtgggaggggtggagcaagcattcaatctgcctaggctgatatctcactgggttatgtgatccctaaatccactggctctgagcccagtacagtactaggacttgcctagaagttgcaggccttgtggcctagacagcctttctagtttatttagagccctagagtacattagcctgcaatgacaaggctgctgaaactcaagttccaactgctgggataggtaattctcctctggctggggctagtctatatgctccctccatgggtgctgctgagttctgccgtgtgtccccataatcactgtgctctccctcccccaattcatagattctttctctgtgccacatgggccactaccagaggactggggagcagtgatgttagcaattcaaactgtctcttctaccctcttcagtgtctcttttagtgatatgaagttgttaaaaccaggtactatgattgctcacctgatttatgaaggtggtttttgtatagatagttgtcaaatttggttttcctgcagggagaataattgatggagacttctattcacttatccttctcctgccccctccaattttattcttttttatggctgaattgtattccattgtgtatatataccacatttcctttatccattcatcagttgctgaacacttcggttgatttcatctttttgctactgtaaatagtgcttcaataaacatatgagttcagatttccctttcatatattgatttctttccctttggttagatacccagtagtgaaattgctggaccaaatgataattctatttttagtttttggagaaatctccagctgttttccatagtggctgtactagtttacattcccaccaacaatatataagagttcccttttctctgcattctcgccaacgtctatattttttctttttggtaatacccattctgactggggtaagatgatatctcactgtggttttgatttgcatttctctgatgattactgattttgagaattttttaatatatctgttgaccatttgtatatcttcttttgagaaatgtctattcatgttctttgaccacattttaatggaattacttggtatttcctattgaattgtttgagttctttgtatattctggaaaatagtcccctgtcagatgaatcatttgcaaacattttctcccattcaataggttgtctctaatctgctgattatttcttttagcattcagaagctttttagtttaattaaacacatttatctatttcggtttttgttgcatgtgcttttgagatcttgtcatacattatttgcctagacaacatccaggagagttttctctaggttttcttccagtattttaaaagttttgggccttacctttatgtctttgatctatttttacttgatttttatatatgatgagaaataagggtcacgttttattctgcatgtggtgatccaattttacgagtaccatttcttaaatagaattcccttttccaaatgtaagttcttatcagctttgtgaaagatcaattggctataaatacgtgctttatgtctggattctctattctcttccattagtttggtccattggtctatgtgtctatttttataccaataccatgttcttttgtttcctacagccttgtaatacattttgaaatcaggtaacatgatgcctccagatttgttcttttggtcaggattcctttgaatattttgctcttttttttctgtaaaaattttaggattttttttctaactctgtaaaaaatgtggtattggtatttggatgggattgcattgaatctttagattgctttgggcaatatcacaattttaatattaattattttgatccatgagtatgagatgtttttccatttgtttgtgtgatcctcaatttctatcatcagtatttttttatttctcctgcagagatctttcaccttcttgttgaaatatattcctaggtattttatatttttgtggttattgtaaatgcagttgccttcttgatttctttcttggctggatcattattcatgtatgaaagttctactaatttctgtatattgattttgtagccagaaactttactgagttcatttataaagcaaatagttttttggtagagtctttaggttttcctggatataagaccatattagcaaagagggacaatttgacttttacttttacaatttagaggctttttatttatttccattgcctgattggtctgtctaggacttccagtagtatgttgattagaagtggtgaaagtgggcatctgtgtcttgttccagttcttagaggagaagctttcagcttttccctattcaatatgatgttagctatgggcttgtcacatatggaaagcttttcactttgttgagatacttttcttctatacctaatttatcgtgaaggttgtcaaattttatcagttgctttttctccatatattgaaatgatcatacggtttttgtctttcattctgttgatgtgctgcatcaagtttattgatctgcatatattgaacaatccttgcattgaagggataaatcccactagattatggtgtatttgctaactgtcataacagctttgagtacggacataagccggaagtggagaacccatttcttaaatgttcctaagaggttcatagatgctgatccttcacagaacctgcagtgaatgcagtagtatgccatctatgcctatccttcaggattgaggtactcacacccatggctgtcaggtgtgactgtagctacaaacactcatctgagtcctttctccaaaatttccttcagccataggaaaacctctcacccaatggcaacccacatcccgtcattccccctccccagtggcaacccacatccagtggatggtcaatgcagggatatgaaggtgagtctcattccctcaatttaagatatccttgaaggcaatggcagcttgagcactctgtatgggatcagtcaaggcctctgttgcaagagtatcatacttcagccttttttttctctgctttttatcctgcttccttcactccttacagatattatgcttgagaacattcttggcatgcaaaaatccacctcaaagtctgtttcccagagaatcaagtctagatagtttgtgccatgagtgatctgaagaagatttgaaaataggacttggcagtggatcacctgctggtcagctggcaatgaagaccacttcactagtggtacttggaatactgatagcttctgacacaatgtagcagtgtgactgttcaatcttatcaacagtaaaatgagataaaatggtggaagggaatgtactagaacagggatccccaaaccccaggatttggaccagtactggtctgtggccagttaggcacaagtttgcacagcaggaggtgagcgatgggcaagagagcattactgccttatctcagcctcctgtcagattagtggcagcattagattcttgtaggaacgcgaaccctgttgtgaactgtgcatgcagaggatttaggttgttctcttcttatgataatctaactaattcctgatgtaatgcctgatgatctgaaatggaacactttcatcctgaaaccatccccaccattccccctaccccttctgtcatccagtcagtctgtggaaaaattgtcttccgtgaaatttgtccctggtgccaaaatgattggggacttctatactagaagatgtaatatatcagattttgagaatttctgcagaagtaataattatataagcactatgaaactagatggttgttaaccaatgcactggtgaaaatcaaaaacaagctgagtaaggatcaccagtttaaggtagcaactgagcacttctttaccaacatatgaatatagtctcattcttacagaaaaccctgagaatcagataagaacataattaagagtagcagaacgcaagaaaaggctaaattctcagccagcaaatctgctatactagtatccagattgggaaggagtaagagcctgagacttgagatgggaacaatctaggttaatttacttgacattcttgagtcctcagatttccctaaacttcttgggcttgcagaagtgaattatctcagcaaattctcattgccaccttgtgcccccactttctgccttgctttcaacataagcctttttcaggatatattccaactcctttttaatctccagaaaacaactaagtctcagtcacaacataatacaggaggaagagtgctggatgtgctaatagaggaaagaaactatgatataaaaaagtcttaggacctagaaaacattttccagaagaatctgggagactacccatgattgtagaatgatacactacataaggctgggagatccaccaggaggctatattccaatagaaaatccactggatactccattttctaagtgctgagacatgtgttggtgcaaagggatatcaagtgaccatgtatccataattggttaaattatactgcttctgtcagacccaccaagtcataagacaaagcaggtctaggagcattctataataaatggaagtggtgtatgaaggattgggcatgagcagagatgaatacacaagtaaacttcccaacaaggtggtctatcttctactgtttttatgagcatctcttcctcatttcatactgatggcagcatacgagaggccccttgggactagctatcagaagaagggtcagggagagtagtttatagatgagtgtataggggaatttattttctatattcaacaaagaaaatgtttgtgaccaaatgtgtggggctttttctcacataaaccagttcaccaactctccagacaccaactggaatcttctggtttaatttaattctgacactatctatgtgatgatagcatcagatctcacaggttaagggctcactcccacaatactgcctccatttcaagtgccaatcacaagttcgggttgttacttgtgcttctgactgaccagctgttaatcagagattcccatgactccctccttgggttcaatcatttgctacaatagcatacataattcagaaaaacagtttacttaccagattacaggcctattataaaaggatgcaactcagaaacagccagctgaaagagatgcatagagcaatttatgtgggaagggacatggaggttccatgacctctccaggtaacgtaccctcctagcatttctacacgttcagcaaccagaaagctctctaaacctcttccttgaggggttttatggaggcttaattatttaggcatgactagtaaaatcactggccattggtgatcagctcaacctccagcccctctatcctgcttaaaggttgggtggtggggctgaaaattccagccctcttgtaacatggttgattcccctggcaaccagctcctatattgaggttatccaggagcctagccaccagtcgtctcataggcacacaaaaagacacttacactttagagattccaaggggtttagaagcttctgtgccaggaaactggacaaaaatgaactatatatttcttatgataaattgcaacaaaaaactactgcagccctacagtcctgcttcatggtggtcttgaacatcaatgattatgagaaatcctccaaataggcagtccttcaaaaggttcaacgggtcttcttttattattaggaaagaaacaacctgagataagaatatagcatctcatgggcagtggcagatggcttgacaggttgatcagtgtcctgtccattcactaattggaagattagtgacgaagactgggcaagagacatgtggatggagctatggaagtgagcataaaaggtaaaggttttagtatcataaattaatgcttacttgagactatgcatcatgtaagatacacttaacaaccagtttttctaaatgattttgctagttatcaactgccattctataacatccagtgtctgtagctggcaaagtgaagacacagagtaaccagagtagaatagagaatatccctggaaccaacagcatgcactccaacatatcaggctggctttgccactgtgtctgccgaacatccaacctgccagcaacaaaggccaaaactgagacccagtacatcatcatacttcaagaaaaccaaccaactgcatggtggcaaggtgattacattggaccccttccagcttgcaaagggcagtaattcattgtgactaaattcaacatatatttcaggtatgagatttttcttcctacctaaatggcaccagccaggaccactattcaagggaatacacacagatacatgatcttacaaagcctcacattgtaccaagagatcaaccttatattaaaggagacgaggcagtcagcaaatggccatgacttcctccaaatattaccttctactgcatcaccaaaaagttgttggtttgatacagaaatagaaaagattttaaaggtgcagctcaagtactaatttgaatacaatagcctgtgatggtggagtgcctttgccactgtatacaacccaaatttattagcattgtatggtactgtgagacaatacgtagaatgcatgggtatggaaaccaaggtggggggagtaaaaataatgttttaccatcatttccaaggacccatttggaatatctgcacttcctctcccaataattttaagttctataggactggatatcctagatatcagaggagaatgtttctatcagggaacacagcaaaaagagttccattaaacttcaaagctgtggctgcttcccaggtgtttcaggccttttgtaccaagaaaggagcaggaaaggaacaggcagtatcctggcaggggaaatggaccctgatcatcatgagcaagtaaggctaaggttgtacaaaggaagaatacatttggttccaagatgatccactagatgtctcctcatattctgaagcctaaatctaatggcaaatgggcaagtaagtggacagtcatggccgatggagtatacagaatatcacccagcaaatttacagaatatatcagtccatttaaaatgttaatagattattgttgtcgagaatctgtcattagtcctgtaagtgcaaaagtgattacatcagcaaactgagtgtgtatccaccggttaggattcaacttgtattaacctggtgtatcgatctggggcccagcaggaaacaggtgccacactcaaatgaggtgactaaaaataattttatgaagaaacagtttataagtgtgtaagctggtttaagagattgcaacaagagatgatagagaatccctgggatagttacaactgaaaaccactgctactggtgggtcttaaaagacaaggggttgagtgattgtcagaacatgaacagacctgtagctaaagaccaggaatcctctgttatgaactttggctttagaaagaaaacacagccaataccaacctggagcctagcaggatgaacaatggagaaataaatttttgccctgtttattctttctctctttggtttaataatagccttactgaaatatagtttacacgccataaacttcaccctttgaaagtatacaatttagtggcttttagtatattcacagaattatgcatccatcatcactatttaattttagaacattttcgtcacccccaaaaggagtactataccccttctaccctccctccagagcctgacaaacactaatctacattctgcttctatttattttccttttctggacatttaatataaatatagccatacaatatgtggtctttctttgacttccttttttcactcagtgtaatttttcaaggttcataaatgttgtacaatatatatatagaattcattccattttattcaaagaaaattttattgtatagatataccacagtttgtttattcattcattagttaatgaacatatggattatttctacttttggctactatcaataaccctgctgtgaaaattcatgtgcaactttttgtatggaggtatttttacatttcttttaggtacatcacaatagcgtacatgacaattctagttactccacattcttgttgaacctgttattgtctatcttttttgttgtagccatcataagtgggtataaagtaatatttcattgcgattttgatttgaatttgcttaataactcatattttagtgttattttgtgtatatattggccatttgtataccctttttatttttattttttaatttacgtgggcaaatagtaggtgtatatgtttatggggtacattagttgttttgatacaggcatttgatgtgaaataagcacatcatggagaagggggtccatctcctcaagaatttatcctttgagttacaaacaatccaattacatgctttatgttattttaaaatgtaaaatagagttattattcactatagtctcattgttgtgctatcaaatagtagatctactcattttttctaactatcttttgtgcccattaaccatacccatgttcccccaatccctccaaaacccttcccagccactggtaaccatccttctactctacgtcctggagttcaaatgttttgatttttagatcccagaaataagtgagaacatgcaatagttgaagcaatatttctgtgcctggcttatttcacttaacctaatgatctacttgggggcataatgatcataacagtgagttttcttctagccctgggttgatctagaaatgtcatctgggagctagggcctggaatggggacttcaggactctcgttgttgttttactttactgtggctcagctggtatccaaattgcaagacaaagtcctaattactcttcccactcttctggggctgtgagctgtgctgtctggagctgggggaggggtgatgcagatgctcccttggccacctccactagtgtcccacaggattgcatgcatcccaagtccactggcttcaggcccagcacaacaccaggacttgcccaggaattgcagtcattgtgacctatactacctttcaagcttatttaggaccctaaagttctttagtttgcattcctggggctacctggagctcagattccgactgctgggatggacgattctcctctggctagggttagttggtctaaatacaacccgtttgggggccagctgaattcttacctgtgttgctttccactgtgacagggcagcactgaatttaaatgcaacgtcccacagttgctttgcttttcctcccaaagcacacagattctttttctccattttatgtggcctctgcaggggatggggaggggtggtgtatgcagtttaagactgtcttttctaccctcttcggtgccttttgcactgtgattgctcacctgagtttgtttcttatgaaagtgttttcttgtgtggatagttgaacttgttgttccgggggtggtggtggggcaattgctggaggcttctatttgactgtcttgctcagcgtctttcagtattttattatttttatgctattgtaagagaaattattttcttactttcagtttttgtttattaataatttataggttgctttcagtattttcatgttatattctatgaccacgctgaattcatttattagttcatatatatatatatatatatatatttaaaatcattttaactgcaagtagagatagttgcacttatttatttccaatctggttgtctattatttcattttttcccctatttgctcatggagctctcaggacaatgttaactagaagtggtaagaacagatattcatttattgtttctgaacttagggaggaaatatttaatctttaaccattgagcatcaaattagctgtggatttttgttgttattgaggctgtcagctttaggaatttctctctattcctagtgtgttgaattttaggttttttaatcatgaagtatactggattatgttaaatgtgcttctatgtctgttgagataatcacgtggttattgaatttattctattaatatggtacaacatactaatagagtcttgaatgttaaatcaaccttgcattcacagttaattcacacttgatcatagagaataatcctttttatgtgactagattcagtttcctagtattttgttgaggatttttgcatctatatttacaagtaatacttggtcgatagtttccttttcttggaatgttgtagttgagttttcgtatcagagtaatattaccctaataaaataaatttgaaagtgtttcctcctcttccatttttttgggaaaagtttgtgtgaaagattggtacttatttcattttaaatgtttggaaaaaaaatgccagtgatgtcatatgggcctctcatacttaggatttttgtgtgtgtgtgtgtgtggttagaacacataaaatctactctcagcaattttcaagtatacaatacattgttatttactatagtcatcatattgtacaatagatctattgaacttaatcctactatctacctgaaattttgtagtctttggcaaacattttaccattttacccccaccctctttgactcctggtaaccactattccattctctgcttctttgagtttgacttttttagatttcacaaataagtgaaatcatttggtatttttctttctgtgcctagtttatttcacttaatgtaatatcatccaggttcctccatgtcattgccaataacaagatttgtttcttttttgaggctgaataatatttcattctatgcctataccatattttcatcatccattcatttgttgatgaacacttatgttgattccatatgttggctagtgtgaataatgctgcaataaataagacagtgcagctatttctttagcatactaattttattttccttgtacatatacccatagtgaaaatggtggatcacatgctagttctgtttttaaattttgaggaacttttatattattttctatatggctctactaatttgcatttccaccaactgtttacaaggattcctttttctccacattctcaacaacagatgttatctttcatctttttttctcatttataatttactgagccacactagaatttaaattagcacatcaatttttaaaatactatttaaaataacaatatgccaggaagttggtacaaaattctttgtttattttattgaatatatatttttaaatttatggatatattgtagttgctcatatttatggggtacgtgtgatattttgatatgagcctacaatgtaatgatcaaatctatagccattctaacaagtgtgtggtgatatcacattgtggttttaatttacattgccctgatgattagtggtgttgaatactttttcatatacttcttggctatttgtatgtagtcttaccaaattggagatacctctctttttttaactttgttttctttacctttaaatagtttttcactcattggttttatgattaaactctcagataactaattctccttatttgagtgttattggggtaagataattccgtatgtgttttgtgttttaaatacattaggctaataatatggggctttttgtactcaagaagatccagaaatttgctatgaagataagaattgtaatgtgttcattgaaccggacttaagaaatctgtctggacttaagaaatccttatatgaaataaggattttcataatcacaactgagtatgattttccagaaaacttaacacacatagagatttaatacagcattattctatctgtatgatagttatagttatctatagatatatcactttcacaatctacaaatgattaatacaagaaaactaattgttcgcatataaaataaagttacaaaatgatttttataagtcaacttaggctaagttttgctaccataactttcaactgaagaatttcagagttataccacaacaaagtatatttctcactcactttacatacctattgtaggtcagatatgactttattcaagagcccagactgaccataaccccta

SEQ ID NO: 508 - DNA, 108957 bp, Homo sapiens
cctgctaaaaataaaaattgaacatataactcctgaactagtggatgaaaatgaagaatgaagaataaaattaaatacaaaaaaaatgaagagtaaaattaaataccaaaattagccaagtgttgtggtgaatgcctgtagtcccagctactcaggaggctgaggtgggaggatcacttgagccccagaggtggaggttgcagtgagctgagattgcgccactgcacttccgcctgggtggcagagccaggctttgtctcaaaaataaaaaaaaataataaattaaaaacctgaatactaaatggaagttaagaaggaaggaattaaaaaagaagaaaagtaaaataaaatagtaggaatagtgaatccttagttatgttagatgttcagtgatttaataaatctgtaaaaagacggagatgagatgatgcaatttaaaatgtttcggctgggcgcagtggctcacgcctgtaatcccagcactgtaggaagccgaggcgggtggatcacgaggtcaggagatcgagaccatcctggctaacacggtgaaaccccatctctactaaaaatacaaataaaatgtttcatgctatttacgagagaagcatttgcaacaaaatgccaaagagaaggtgaaaatagctggaaaaaaaatgcgcaaagcaaataaccaatagaaagaaagccaagttgggctagcaaaatcagacaaaataaccttcgaggtgcaaacaactttgaggcccaaatagaggttcttcccactaaaagaatgattccctgaatgataatggaatcttgacccagcctgcacctcaggttaagttaaaagtggaaatttaaagatctaagtgtgagattttaaaaagcatttccccagaaataccaggatctgtagatggaaatgttattaagaataaagatgtggagctgggcgtggtggctcacgcctgtaatcccagaactttgggaggctgagactggctgatttcttgagcccaggagtttgagactagcctggacaacatagtgagaccccatctttacaaaaaaattaaaaaaaattagtggacatggtggcatgcacctctagtcccagttactcaggaggctgaggtgggaggatcacctgtgcccaggctgaggctgcagtgagccatgatcacgccactgcactccagcctgcgtgacagagcaagaccctgtctcaaaagaaaagaaaaaaaaagaagaaagaaatgaaaaccgtagctcagagacagagaaactgagcaatgcataggttcagaagggtttgaaacagactgaattgtgtcttggcatatgagagaggtcgcagctataaaacaatgagagaagaaaccaaattccacataggcaggactgagacaattggctgttcttgtggatgatacgtgatcaaatctcaacctcatgcgatacttttttttttttttttgagatggagtctcgctctgtcacccaggctgcagtgcagtggtgtgatctcacctccccgcaaacttctcctcccgggttcaagtaattctcgtgcctcagctgggactacaggcatgtgccaccacgcctggctaatttttgcatttttttagtagagacggggtttcaccaagttggccaggctggtctcgaactcctgacctcaggtgatctgtccacctcggtgtcccaaagtgctgggattacaggtgtgaaccaccacacccagcctcatgtaatacttaaaaatgaactacaggtggattacaaacctgaatataaaagaaaacttttttttttgaaaaatagagggaaatgtcttataacctcagagttaggaggtttttcttagatacaatacaaaaagcataaccacgcccatagtcccagctactcaggaggctgaggcataagaatcacttgagctcgagaggtggaggttgcagtgagccgagatcctgccattgcactccagctgaggctacagagtgagagtataaaaaaaaaaaaaaaaaagcataacctttaaaaatgggttagcctatgtctacatttaaataataataataataataatgttccaacttcaggctctgaaaaaagtcaaaagatgagctgtcaactagaagaggctccttactgctcataccaccagggaaagtttaatatgcaaaatgcagtcatccttcagaattcatgggggattagttttaagacgccttcttccccgcagacaccaaaatccacagctgctgaagtctctgatataaaacgtgcagtacttgcatataatgcaagtatatgttcctgtatatttttatttatttatttggagacagaatctcactctgttgcccaggctggagtgcagtggcgtgatcttggctcactgtaacctccacctcccgggttcaagagattctcctgactcaacctcccaagtagctgggattacaggtatgcgccaccacccccagctaatttttgtatttttggtagagacgggttttaaccatgttgtccaggctggtttcgaactcctgacctcacataatctgcccaccttggcctcccaaagtgctgggattacagggatgagccaccgtgtccagcctctggtatactttaaattatctctaggttactcataactcctgatacgctgtaaatgctatgcaaatagttgttatactatattattttttatttgtattactttttattggattgctatattttattttttgaaatattttcaatacaagactggttggatctatagatgcagaaattctggttatagagcacaaactgtgtatagatagctcctaccaaaacagacggatggtgaaaaaaagaaaagaaaagaaaagaaaaagaaaatggaggagagagactatgaggcgactaaaagaagagggatatgatcattccattcgctgacaagaaaaattcaaagaagagggaattatgcaattgaccagctgatgtgtgttagaaatgctcagggtcacacatattcattgaaagccaatttaagccactatttaaatttaaaccgatttaaacaattgggcttttttttttttttctaaaaaaaaaaaaaagtcaattaggccaggcgaggtggctcacacctgtcatcccggcactttgggaggccgaggtgggtggatcacaaggtcaggagtttgagaccagcctggccaacatggtgaaaccctgtttctactaaaaatacaaaagttagctgggcatggtggtgtgtgcctgaggctgtgagactgaggcaggagaatcacttgaacccaggaggcggaggttgcagggagcggagatcatgccactgcactccagcttgggcgacagaccaagactctgtctcaaaaaaaaaaaagaagaagtatattggttccgtctggaaaggtggagcacttgaagcaaaggcaggaagactggaagcagggagagggttttcaggtcacaaacaggtgagagacaaaacagttgccttcttttgagtttctgattagcctttccaaaggaggcgatcagatacgaatctgcctcagggagcagaggggggactttgaatagaatgggaggcaggttggccctaagcagttcccagctggacttttccctttagcttagtgacttgggggtcccgagatttatgttcccttcacagtgtatgagtgagagcacttggaaactgagagtggaagtgtcgcaggccaggtctcactaacacaggcccccacaacacctgtttcagtattgactgagtggttaaatattaaaagccagtgctgttatacaaaggctggaatgtaacaaaagcccaccgagagtttttcccaggactttcccgggccttaaagcatgacaaaataatgaatgaattcttaacaggacccatttaggattaaacaagttttactgggggtctgcagaaactccccaggcctccacaaacaagtttattggggctttgaaggaactctgcaaacctcctggatttagcaggagacaacatgagggtaatcaccccggcacctggacccattagattaagtcaatttactgaggctcctgaggaagatcctcaggactcagaccttagttatagattaaaagaagttaatcacttatgtctttagataaatgcacacacatatctccacatagcttggaaggtatataagctctggaaaactataattttgagttagtctggtgataatttccaggccttctccctgtaacaggttgcagaaataaaaactctcttcctccccagttcatcggtgtttcattattgggctgtgagaaatagcaacccagttgggtccgggaacagaaggtttggtgttatcttcatcacaggcactggactgtcggtaaatttattccatgacaattcttcctaggtttcttttttatattacttgcttccatcatggcagacagctacactggcttcttgccatgaaaacgaacttctagtaacaaaacggaaacctttttttttaagtttcaggtttcaaggttttacttctatctgcaaagtgatttttaaccagacaatggcaatctataaacacaccgtgggcagcaaatcagaacaaactgcaaggtcgatagtcacgctgatgagcttgtttctgcagcctgctcctaagggaaggacaattttcttttctaacagtgcaatgttgtttcctccacagatatctacccaaagccaaaaccaccttactacccacagcccgagaatcccgacagcggtggaagtaagaatccgcaggcctgaaactctttctcaatctggtttgatgatgtttgcctttttatttactagcaggtttagcctggttgcatttgaaatatgtgtgtaatagctcccttactgggaatgtagtttctttcctcactggggggagcaagaaagtccaacggacagaaacaatcttattttccctttgctttgacatctagaaaccactaaggtgtacttgtaaccacccaactggttcactttgttggctgcctagacagagctgatttatcaagataggggaactgcaatggagaaagagtaattcacgcagagccggctctaagggaggctagagttttattattaatcattcagtctctggaacatctggggatcagggttgttaaggataagttggcaggtaggggcttgggaagtggggagtgctgaccggtcaggttggaaagggaaccatagggggttgaagtgaggttttcttgctgttttctgttcctgggtggatggcggacctggttgagccagattaccgggctgagtggtgtcagctgatccatccagtgcagaggctgcaaaatatctcaagcaccgatcttaggttttacaatagtgatgttacccccaggagaaacttggggaggttcagactcttgcagccagaggctgcacgagccctaaagtgtaatttctaatcttgtagctaattttttggtcctgcaaaggcagactggttcccaggcaagaagggggtctttttgggaaaggggcattcttaattttgtttcagagtgaaaccacgaactgaattcgttcccaaggctagtttggctcacacccaggaaagaacaaggacagcttaaaggttagaagcaagatggagttggttaggtctgacctctttcactgtcatcatttcctcagtcataatttttgcaaaggccgtttgatactcaaaggacactttgcattatcatcacagaaagctaatcaggctgagagacaagtcctttctctcacttgttttcagtgctccaaatacctttggcttaaccattcccaaacccccacgtgtgctgtgcactttatgtgttttagagttggtttctccattttttctaacatttggcagacagtttttttccacagatttattacactcatcattgaaaaatatgcaattcaaaaaagaaagagagtgaacgagagagagaagagtggggaggggggtgggcatggagagagaaagagaaagagaaaagaaaggggaaagaagaaaggaaaagatagattctggccattaaagttatcagcagttcaacaaccttaaaaacttaaatgtttgccaggcagagcagcgtgaagctggctaaatcaagaggggttctggaagcttcctggtagtttgctctggctttaaactttcacagcttaacagcgtgtccattcattgcagacacgcacatccagatggacagaaattatctcctcttacaaggaatcattaaaaacagagaccaagacccaagggaggtgacacccacttgaaaaactacacctcaggccgggcgtgggggctcacgcctggaatcccagcactttgggaggccgaggcgggcagatcacctgaagtcaggagctcgagaccagcctggccaacatggcgaaaccctgtctctaccaaaaatacaaaaattagctgggcatggtggcatgcgcctataatcccagctacttgggaggctaagacacgagaattacttgaatccaggagaggaaggttacagtgagccaagattgtgccactgcactccagccggggaacagaatgagattctgtctcgaaaaaccaaaccaaaccaaaccaaaccaaacaaaacaaaaccccaaaacaccacctcacccttaactgcattagttaagccagctagtctttcttttttccccctctttcatgatgaaaatcccaaataccacccacctttttctcctgctatttcctcctagtcttttaaaaaccattgtcctgcggatcatggctatgttgcaaggcactcatgggaattccacagggaacgtgtttcttgctgaaacatacttgggaaacgcccagttaaacagactgccgtgggcttccctcccagagaattcatcaggacttaaaatgtgtggctgggcatggtgggtcacgtctgtaatcccagtactttggtagaccgaggctggtggatcacctgaggtcaggagttcaaggccagcctggccaacatggtgaaaccccatctctactaaaaatacaaaaattagtcgtggcctgtagtcccagcaactcgagaggctgaggcataagaatcgcttgaacctgggaggcagaggttgtagcaagctgagatggcgccactgcactccaggctgggcaacagagcgagactccgtctcaaaaaaaaaaaaaaaaagaataagaaaaaaaaaacttaaaatgcgagatcctttaagatgggccatcttcagagtgtgaacactcagcccctcccacagcaaagtgattcatgaaccccaataggaggaggagtgggggaagagaggctcaggctggggaggtgaccccccatgactcaagcctcaatctcctgatgcttgtcccaacaaagaggaggcttcctttccgactttggtttttcatgttgtgcttaaatccagccacactgatgcctttaacatggcagtcctgaattattaatcaatactgtgtgaatccaaaatatctgagacaggtctcaatcagtttacaaagtttattttgccaaggttaaggacgtgcccgtgacacagcctcaggaggtcctgatgacaagtgctcaaagttgtcaggacacagcttggttttacacattttagggagacaggagatatcaatcaatatgtataagaagtacattggtttgatctggaaatgcgggacaactggaagcaggggcttccaggtcacaggaagatacgagacaactagttgcattcttctaagtccttgatcggccttttactgaaaactcaatttacatgtgagacagggcaaaggaatagtacttatgcctcagtctggcccagtgaatctgcatttttcatcaacaatagggcagaggaagcaatcagacatgcatttgtctcaggggagcagaggggatgactttctgtcccacacctgtgaagatgagctgttggtgtacattgccagggtgaaattccacagaactgttttagggtaaacaaaacagtttactttcctcagattgtgaggacagtatgtagcttttaaaaaacttaaaaaaatttttttgtagctatcttatttagaaagaaaatgggaggcagatctgactaactttttttttccagcttgacttttcccttggcttaatgattttggggtcccaagatttattttcctttcacaattgaacatcagaacatggagtatttaacacaggaaatgagcaaatttaacgtacacacccaaggaaaaggaaaaatgaagctggttggaagttaattatggatagtgtggtatatgagcagaaattccccttaaccagtgttcttgcccaggctagcccaaatgagcccaggctagcctagattcccaagtgtgtatcttgagaacgaggaagagccctagaaaacaatgtgtaacgtccctccaagatggggtgttctggaacaatccctcagacaacgaaggcaattgttgatgggcaacattgggaagaccccagagatggaatgtcctaggcctttccatgttctctttctcattctccctccattgacttgataggtggctgggggatttataagtatttaccacacaccagccagctttctccggatggctccaggcatgcttggagcccagtggtctctttcccttagaatttgatctggaggaacccaaaattctctctgtgtcctttgaaattcagcacatttttcttggcttccatgagctcctgtggcatttctcaggccaactgttgactctgcttcctatgtctgtgcttgtccctttgagagatgtcagcgttgctcaccgattcttttctctgaccccagcagctcctatccatgttgtctttttttttttttttttcagacagagtctcactgtattgctcaggctggagtgcaatggcacgatggcatgatcttggctcactgcaacctccgcctcctgggttcaagcaattctcctgccttagcctcccgagtaactgggattacaggcgtgcaacaccacacctggctaatttttgtacttttagcagagacagggtttcaccatgttggccaggctggtctcaaactcctgacctcaggtgatctgcccaccttggcctcccaaaatgctgggattacaggtgtgagccactgtgcctgtcctcatgttgtcttgaaagtaacaagacaggcacggattctttttgatgcaagctgttatgggatgaattatgtctccccgcaaattcataggatgaagtcctaacccccagtttcctcagaatgtgactgtctttggagatggggcctttaagaaggagattaatgtaaaatgaggtcactagggtgggtccggatccaataggactagtatcctaataagaagagatgaggacttagacacacacagaggaaagattatatgaagacacagggagaagacggcatctacaagcccaggagagaggccttaggaggaaccagcccagaccatatcttgatctcacactcccagcctccaggactgtgggagaatcaatgtctgttgtttataagccacccagtctatggtgttctgtgacagcaacctgaaatggactaagacacctcataagaaggggagatgaggacgcagacacacacagagggacaatcctgtgaggacacagggagaagatggcatctgcaagcccaggagagaggcctcaggaggaatcagcccagcccacacctggatctcagacttccagcctccaggactgtgggagaatcaatgtctgttgtttataagccacccagtctttggtattctgtgatagcagcctgaaatggactaagacatctcataagaagaggagatgaggacacagacacacacagagggacgaccctgtgaggacacagggagaagatggtgtctacaagccaaggagagaggcctcaggagtaagcccaggaatcaatgcagttggaggttctgtgtgtgaatggaggagggaagctcacagatgaaggcgttttgagggaggactgaccttacagtgaggtacccagagacttcctgaaccaagccacgaatatgcagctcgtgctccgggcagtgccttctggcctggaaaccaaagctcccttgtgtccagtccccactcctctgtttggcccccaagtttccataatcccccacagttgtatcattttagagacctcaaaagagagtctaggctgggcgtggtggctcatgcctgtaatcccagccctttcagaggccgacgtgggtggatcacctgaagtcaggatttcaagaccagcctggccaacatggtgaaaccctgtctctactaaaaatacaaaaattagctgggcatggtggtgtatacctgtaatcccagctacttgggaggctggggccagagaatcgcttgaacccaggaggcggaggttgcagggagccgagattgtgccactgcactccagcctgggcaacaacagcaaaactccttctcaaaaaaaaaaaaaaaaaaagagagtctaggcagggcatggtggtccatgcctgtagtcctagctatactcaggaggctgaggtaggaggatcacttgagcccaggaggtggaggctgcagtgagctatgattcaccactgcactccagcctgggcaacagagcaacaccctgtctcaagagagagagaaagggaaagagagagagactattttgagaagtgaaaaaccagtcattctcagcccagatttccagtgttctgagacgtctgtcctgaggaaggactttgagaacagcatccttgccttttttgtgaattaaagtaatttcactcttgagccaatgtggataagcacttgacaggtactggcagtgccaggtaccaggaatatagaatgggtacagaaaataaagtttctagtccagcgacaaaaaggtgctgaagatacagactcatgtcgtgcaaagagcttgcactgattatttcatttcggcttcttgaatagggtcaaaggacatttaagctgagacaggagggacgagctaattaatgcttttccagatgacaaatggattcttcaaatatttagggagagtgtaaagtgatggacagggaacaggaggggtcatgacagaaggaatgccacctgcaaaagtcctggggcagggctgggcacggtggctcatgcgtgtaatcccaacactttgggaggccaaggtgggcagatcacctgaggtcagaagttcgagaccagcctgggcaacatagtgaaatcccatctctactaaaaatacaaaaattggccaggcgtggtggcacacacctgtaatctcagctactcgggaggctgaggcaggagaattgtttgaacccaggaggcagaggttgccgtgagctgagatcacaccactgcactccagcctgggcgacaaaagcgaaactccgtcttaaaaaaaaaagtcctagggcagaaagctcatggtaaacttgaggaacatgcaaaagtcattgcaaaaagttttaagaaattcaaatgaagccaggctcagtgtggctaatgcctatgatgattccagctctttgggaaggcaagacaggacgattgcttaagaacaggaatttgagaccaacctgggcaacatagcaagaccttgtctctacacaaattttaaaaattagccaactatggtggtatgcacctgtagactgagctacatgggtggctgaggtgggaggattgtttgagcctaggaactcgaggctgcggggagctatgattgcaccactgcactgcagcctgggcaacagagcaagactctgtctcaaaacaacaacaacacaaattcaaatgaaacggtgtaactcaagcaagatggaaatacaacacactatcaaaaggtcagatgtttcatcctaacatttatagaagtgactgacttctgtaaatggtgctggcatctgtagtagccctaaacagggaaaggtcaacaacgcactttctgccctgttaatttcagagagccctggacttcttgcgaaagcaccagtggtgtaagtttttgttttttcattgtaagctctgaggtggtattatgaatattgtctacatgattaataagctccgtaaaagcaatgggcagtaacatcttttctgtactttggcattcttatttatagatggtatctacctgaaagatgtcattatttttctgaaatcatactgttgttttccaacagatatctacccaaggccaaagccacgccctcaaccccagcctggcaattccggcaacagtggaggtaatgagtatttatttatttatttttattttattttattttattttattttactattttatttgattctatgttattttactttattttaccattttatttgattctatgttattttactttattttatttgattctatgttattttactattttattttattatttattttggagacagggtctcgctctgttgccctggccagagtgaagtgatgtaattgcagccttgaactcctgggctcaagcaatcttcctccctcagcctttcaagtagttaggactacagatgtgtaccacctacattgcaccacctatatttcaccacctatattggctatatttcaaattttttgcagagacaggatcttgctgtgttgttcaggctattcttgaactcccggcctcaagcaatcctctgcctcagcctcccaaaatgctgggattacaggcaccagctattgtggcccagcctgataatcagtattaaagtccattttagaagtgtttggggccaggcacagtggctcatgcctgtaatcccagcactttgggaagccgaggtgggcggatcacttgaggtcaggagtttgacaccagcctgagcaatatgatgaaaccctgtctctactaaaaatacaaaaattcgccgggcgtggtggtacatgcctgtaatccagctactcaggaggatgaagcaggagaatcgcttgaacccgcaaagcggaggctgctgtgagttgagatcacgccacagcactccagcctgggagacagagcgagcccctgtctcaaaaggaaaaaaaaaaaaaaaaagaagtgcttcacgcctgtaatcccagcactttgggaggccgaggtctcctcaggcagatcacctgaggtcaggagtttgaaaccagcggccaacatggtgaacccctgtttctactaaaaatacaaaattagctgggcagagtgacgcgtgcctgtaatcccagctactggggaggctgaggcaggagaatcgcttgaacccaggaggcggaggttgccttgagccaagattgtgccaatgcacaatctatctaggtgatagagtgagactctgtctcaaaaaaaggcgggggggtggttggatacaagtattatttaatgacttaaaaattctcatctccatggtgaaagaccaattgcttttgaaatgcacagacattgttttgcgaggagttcagttctactatccaccagcacctggggattacatttagttgatagtaaataaatttaaatgtttttgatgacattgactgaaaaataccatgcacactaagacatttcaagttatgatggaggaaggcaattttttcttgtttttttttttgttggtctgtgttctactcacttattcttccctctgcaagagttatctgcggccactttgcctgtgttcctacagcacttcccatctccgccttggcaattgtgtctcacgaacgtgagacactcaggaaagagatgctggtctgtaaagttggaagagtctcagcgattccattggtggggcaaatgtgtgcagattgaggaagctaagatacactgggtgtcttcctctctccacctgctttaaccattgggagttcccctgattgtgattgtttcaggacgttgcttggatgttgtcatattcctagggttcaaggcactccgtgaaatccaaggaaacaagctttgggtatgtcccagtgccttttcccttgggtcttgcaactgaagaattgtgtttcttccctagaaaaacgaacacacttttgcccactcacccacctcctgcaagtctccaaaaccacagcgttgtatcctagactatgttcccccaggaggtggttcctccctctgcattcccgtactccatactgcttgatatgttcttacatgcaacaccgtgcaattgtgtttagttgattcctgtgaattagaatgagaactctacatgggcatggatttttgcctttcattcactgctgcattccctagtctggaaagctgtgcctggcacacaatgagtcctaggtgaaggtcagtgaagtcattaatgcttgagtcccaacaggcaaacagctggattcatgaatgaaagacttaccgctacatcccttcatcagggtgtatagcttcaactccatttcctggaaagctctacaatagttcttcctcctcaaaaggctctggtcttgtgattcatagcattcgtccaccaagacatgaacaagggatctttatgtcagaggttccctgttcaaagctgttttagaggccaggcgtggtggctcattcaggtaatcccagcactttgggaggccgaagtgggaagaccacttgaggtcaggagttcgagaccagcctggccaacatggtgaaaccccatctccattaaaatacaaaaattagccaggcatggtggcatgtacctgtaatcacaactacttgagaggctgaggcaggagaatcacttgaacctgggaggcggagttcagttggagttgcagtgagccgagatcatgccattgcactccagcctgggtgacagaacgagactccatctcaaaaacagtaaaaataaaaaagctgttttaggaaacatcccttttttattattttttctttgagtcagggacttgcttggttgcctaggctgaaatgcagtggcgggatcacagctcactgcagcctccacctcctgggctcaagcaatcctccgactttagcctcctgaatagctgggactacagacacacagcactccacctggctaattttttcttttttctttttctttttctttctttttctttttctttgtgtgtgtgtgtgtgtgtgtgtgtatgtgtgtgtgttgggacagggtttccctctgttgcccaggctggtcacaaactcctggccttaagtgaccctcctgccttgacctctcaaagtgctgggattacagatgtgagccactgagcccagccctaggaaacagcctcttaagccaagtgcaatgactcttgaactccccagagcctctgtgcatgctacctcgacttcagcttcacagatgtatgcaactgcgggatcaggttaggggcactcacttaccggcagtcccaaagctctggagagtctgtgctgagggaatggtccatgttaaagcaaagcagaacaaccactctgccttttgtattttatacttgttttttttttgaaacagggtctctctgtgtcactcaggctggaatgcagtggtgtgatcatagctaactgcagcctccagttcctgggctcaagtgatcctcctggcagatgggactacaggcgcacaccaccaagcccagataattttttgtatttttttgtagagacagggggtctcactatgttgcccagactggtctccaactcctggcctcaagcaatcctcccgcctccacctcccaaagtgctgggttgcacccggcttgcatttcacacgtttaataaactcaatcagcatgtttcctaccccctagagtgacaatggtgcacattagcatggatttcttatagatcgagaccaaagacctaattacttatctatagaccaatcttggagaggaaaggcagactccaagggttaattcggggtccaggaaccacagaaggaaggtctccttggatctcgtttgagcctgaagtagctcagtctatgacagacaccatcagagggcagaggcacaggtgaacgcagcagtcggaactttgtcagagcagcaaaggacatcttaggaaatgaggcttgcaaagcagccttgggttattgagaaagctctctcagcgtggattctcagggctctgggatcttctctgccttgcaggtgcctctttgttttttgggaggaagcaggtgggtctcatgtgtcagggcagtaaggagcaggaatgaatggatgaaacaaatctgttggggtgggtagcggctgtgctctggggagccaagagagagacagggggatggtgctggtttcagacaagatagttgagcaggaacttgaaagagaaaaggagagtggatcgtggggacctgagaagctggaattctccctggggaatcggccactgccaacgtgagggctggggttaggagcatgcctatggtgatggagaagcctgggggaggtgcctggttgatggggcaagaggagccatctggagagaaggaaaagcctggagtctccttccgggcttgcttaaggactagggaggggcaggacatgagatgatgttggaggattctgagcaggggatgggcctaggtgggaggtggggcagaaggagagctggacgaggacatggtgagaggtgatgttggctcatccaggaaggacggccaggaggaagcagagggaaaggggcatgcaaaggtccagaggcaggagcaacggggaacatccagggaaggagggaagggcaggggatttggagatggggcaccctgagagagggatccaggcagcaggcagacacgacagcctgagcttcaccccagctcacggttggccctgggagggctttgagcagaagaggggcaaacatcagcaatatgaggccacactgcagacgttctgggccctgcacacgcctccttgcaggcaaggcggccagcccacaaggtaatttaattcctggtgcctgtgggcgtcctgcaaagagccagttggcgtcggaacgctcttctccaaaacctgtgccagtgcccccagcgcagacctggtgtgaaggggacctttggagaggtctcatgagcaatgccgcgtgctctgccccacaggttacttcaatgatgtggaccgtgatgacggacgctacccgcccaggcccaggccacggccgcctgcaggtaggtgccgagcctccccagatgcgacacattgaatttgcacagagagggtgggatgagaggcctgaagttggggatgagagagctgaggttggggcagagttggtgacgagcagacgataagctggtgcaggggatgacagagaaggccccatggccgcatcagtggggtttgcggtctgggcatctgtccgcctctccaggctgggggactggatggaaacaaaatgaacaggcagaactggagggtccactgaaacacttgcggtcatttctgtttagacttgtatatgtgtaagtgtgggtgtacatgtccagacacacctttatatatctgcatgcttatcaatcttcatttgtgtgtatatagatgtttatgtatctttatatttgtgtgtatatatgcttttaaatatatataaatgcatctacatatgtaggtatatggtttttttcatgtgtgtatatacatgcttttgtatatatacagtacgtggatacctttctctgtttttatatatgtatatcctgactttatatatatccttatatatatctttacataggtacatgttttatatgtgtatatatatctttatatttatatgcagatatatgctttttatatatatttatgtatatgtatatcgtttaatatatctttttaaaaatatatcttcatgtatatctttaaatacatatacattttatatacattttaatattttatgtgtatgttatataaatatatatctttacatatataattaaatatatgcctttatttatatacatctttatatatgtacatatatacctttacatgtatgtgcctttatttatatatgtatatatttatatatacacttttatatatacatatgtgtatatctttatatgtgtgtataaatgcctttatatacgtacacatatacctttatgtgtatatacttttatatgtgttatgtatgtacacacaactttatatatacatgtgtatatatctttatataggtatataaatgtctttaaatatgtatatacatatcttttgtatttatttatttttttttgagacggagtctcgctctgtcgcccaggctggagagcagtggcacaattttggctcactgcaacctctgcctcccgggttcaagtgatgttctgcctcagcctcctgagtagctgggattacaggcgcctgccagcacgcctggctaacttttgtatttttagtagagacggggtttcaccattttggccaggctggtcctgaactcctgacctcgtgatccacctgcctcagcctctcaaagcgttgggattacaggcgtgagccactgtacctggtctatatgtatatcttctaatgtatctttatatatatctttaatatatctttatatacatgtacattttatatacatttttatattttatgtatgttatataaatatatacatttatacatatataattatatacctttatttatatatctttatatgtacatatatacctatatatgcttttatatatgtatgtgtacatttatatatacacttttatatatgcatatgtatatgtctttatgtgtataaatatcttcataaatatatttatatatctatacataacctttatatatgtataaatatcttatataaatatatattttatgtgtatatatgcattatttgtataaacacatatttgtaaatgtctttccatatatatgcatatatagcttacatatgtttctatactgttatatataggtgtatacctttacatatgtatgcatactgttttatatatgtgtatataggtcccttcatgtatatatgtatatacatttaggtatatgtgtgtgtgtgtgtgtgtgtatatatatatacacctttatatatgtacatttatctttatacacacagacatatataaacacttctaatataaagttttctctgtaattggaggtgaatgtctatcaataatctttcatatagaaatacaagtacagactataggagacagagatgcatacaacattgggctgaagagtgtgatgtttgaggctttattttcaagcatgtgaggtttctggcctgtttagttctgcaattttattttagaagacataaaggacttgtcccagatattttgcaaagctggacctgcatctttcggacaaccagattgcatccagtcatcttttctgccgtgtttacttgcaataaataaagagcgctgtcttaggatttattacaataacaatcaggaataaactaaaaattactagttatttttgaaaggagaagctgagaacatttacgattgagaccatctgctggaaggtcctcctaatccggcgtcggcgtggctgatctcatatcagtttctcggcaggaagcgggtgcgcctgcgtgaatttggagtccccagggtaaatgttagtcccgtgacggcaaagtgtttttgatagctagagctcagtgttggcatgagttttcccacggggaagaggaagctttggtggggccacccttgactctcccctgctggtcactctttggagctctcttggcagtgacacgttcacacgacttgttgccattcccaatgagctggacagaccaacacctgcaggaaaccccacgctcagacacctgaacatccctcaactctaccttctctgtctaacaggaggtggcggcggtggctactccagttatggcaactccgacaacacgcacggtacccctacatctgggcatgcgatggtgggtggagggtgggaggggtcatctttctagggctcccgcttgcactctgccctgggccttctacctggagtctttggtgagtagggtgctgtgtgctggtgcctggtcttctgagaacctgtctgtgctgggctgttctgcttctgttccccaggagggtgggtgcagccacacatacacacacgcatacacacatgcacacacacacacacacacacacccctttaggtaaaagtaaacagagcaaagaactatacaactaattagagaaagagagcatccaacaaactggagagcatccaacaaattctttaggggcgcagctcgcttacttcaagcagaatagaaaacactttcaatggctgggcgcggtggctcatgcctgtaatcccagcactttgggaggctgaggtgggaggattgcttgagcccaggagtttgagaccagcctggacaacatggaaaaaccctgtctctacaaaaaatacatatatgcaaaaattagccaggcgtggtggcatgtgcctgtagttccagctactcaggaggcagaggtaggaggatcacttgagcccaggaggtcgaggcttcagtgagcagacagagataagatcgtgccactgcactccagcttgggtgacagactgagatcctgtctcaaagaaaaagaaaagaaaagaaaagaaaaaaagcaagagaactcttttggtcggtgcttatgcccagagtgaaagccgtgttctacagaagccataaacaggctcttggcttggttgagtttttctcatggagaccaggggaccttgaaaccctcagatcctctccggtttggaaaacgactgaagcaaaatgtcatcactgagaaagaaaacaataacaaaacactctgtaggttgattttaaaccatcatctccgttttaacattttccctttgttaagagttttgtacaccttcaatgaattgagtaaccatcttttcttttttttttttttttttttgagacagagtttcacttgttgcccaggctggagtgcagtggtgtgatctctgctcactgcaaccttggcctcccgggttcaagtgattctcctgcctcagcctcccaagtagctgggattacaagcatgtgccactacacagggctaatttttgtttttttagtagagacagggtttcaccatgttggtcagattggtcttgaactcttgacctcaggtgatccatctgcctcagcctcccaaagtgctgggattacaggcatgagccactacacctggctaatttttgtatttttagtacagatggggtttcaccttgttggtcaggctggtcttgaactcctgacctcaggtgatccgccctcttcagcctcccatagtgctgggattacagacgtgagccaccatgcccggccttgagtaaccatctttttggttaaaactaatatgtgccaagagctctggtaatgtgggaagtacttttttttctttttctttctttttttttttttaagatatggtctcattaggctttgtgagagccaaggctgttggccccctaagttttctctgaatcactgacatgaggcagcttaattaacaggagaaaaagcgtataaatttattgagtggatatacacgcaaaccttcagaaccaagactcaaccaccaatgggatgcaaaagcttatagaccatcttttttaactttgatgttaggttcaggggtccttgtgtagggttgttacataggtaaattgtttgtcaccggggtttggtgtacacattatgtcatcacccaggcaataagcatagtacctgataggtagtttttccatcctcactctactcccaccctctgccctcaagtaggccctggtgtctggtgttcccttctttgtgtccatgttgtcaatcgagaaaaatgacgagacgagcgtaaaagatttatttgccaaagttaaggttaagggcgcgccccaggagacaggtctgtggccttctccgaagatgattttgaaggctgcaaatttaaaggggaaagggtgggggtagggaaaaagagttattcatgcttttgtctggctcagtgaatctgtgtttttttacataagatggcatagacaaatggggcagagggaaaatgcagggaatctgcatgttgcataagataatctggacaaaatggggcaggggagcaatcacatatgatttgtgtctgctgggcgggggtgactgcaaagctgtcgatttgcatattgtcatggtgaaatcttcacagctcactaggattttccttgtgggcaaaatatgggggagacgtgtagcttttcatcttgtagccattttatttaggaaccaaaagggggaggcaggtttgtgtgacccagttcccagcttgacttttccctttgactaaatgagttcaggatcacaaaatttaatttcctttcacaatgcgtactccgtgtttagctcccacttgtaaatgagaacacatggtatttggttttctgttcctgcattagtttgctcaggagaatggccaccagctcgatccatgttgctgcaaaggacatgatcttgttcttttttatggctgtgtatatgggccacattgtatatgggccacatttcccttatccagtctaccattgatgggaacctaggctgattccatgtctttactatttgagtttgctatttgttgttctttgcaggaagaatgtgggctcagagcatggccccaaataggtgacgttggtaaagcaggtttaacgggtggcaagccaggtgatgagagggagacaggaagaggcctgcttagcaagggggtccttgttatgcagatgaaggttcccaggtagcagcgctcagagacgaccatggtaaatgtttcttttcagacctgtaaaggtgtcagagtctccgtttctctctcctacatccaggaaaagcttagaaagggaaggcctggctgcaacagcaaagatcctctacagatgccaatttccccacctcagtctgctggccctggagcggcaatttcaaaataaggcaaagcaatatattttggagtaaaatattttgatgtccgtcatcttcgttacctcggaagcgagtgttgtcatcagatccatttaacaaaatgaaagcaatgcatgacgctcgactgtccacttcaaaggagcaatagctgtggccctataggtagcccatcctcagaactcactccctatgacacagacaagcttcaggatgggagggggctcatgacaaagtgctcattacctggggtcaagaactgtctacttttggccgggcatggtggcccacgcctgtaatcccagcactttaggaggccaaggtgggtggatcccttgagttcaggagttcaagaccagcctgggcaaaatagtgaaaccctgtctctacaagaaaatacaaaaattagctgggcatggaagtgtgcgcctgtggtcccagctactcgggaggtgtaagtgaccctggaagtttgaggctgcagtgaaccgtgatagcaccactaccttccagcctgggccatggagtgagaccctgtctcaaaaaaaaaaaaaaaaaaaaaaaggacactaaaaaagaattgaccaccttcaactcaacgtactatgagatgagttccttccaccatctttctggaactagctaaggggttccccttacctactacctaggtagacctgatttattaagacgggaatcgcaatagagaaagagtttaattcacacagagctgactgaacgggagcatgtgaagcagctatgctgtctggggtacatacctggggttcattgttgcacgctgagaaagaattcaggacacagacacatgtggttgggttaaggagttgaaagtttaatagaagaaaggagagaggagagcagctccttgcaagagagagagggagagagagaaagagagagagagaaagagaagcatctgaaaaagttgggaggttgtggaccgcagcagcttttgtaggcaggctggaggaggtggtgtctgatttacatagggcttacagactggttcgatcaggtatgacttctacatagtgcgtggggaaggctggtggccccaccctaattttgttatgtaaatgggctttccagttggtcagtgccatcttgtctgctacttactgtacatggggctgacaaagaggagggaagatgaagctgccatcttgaacgtgtctaggccctagttcctgccggcattcacccatgtaagctcctagctggcttgtctatgtctgcagctcaactttattttttattttttatttttttttgagacggagtctcgctctgtcgcccaggctggagtgcagtggcgtcatctcggctcactgcaagctccgcctcccgggttcacgccattctcctgcctcagcctcccgagtagctgggactacaggcgcccgccaccacgcctggcaattttttctatttttagtagagacggggtttcaccgtgttagccaggatgatctcgatctcctgacctcgtgatccgcccgcctcggcctcccaaagtgctgggattacaggcgtgagccaccgcgcccggccacagctcaactttacaggctgctctttgttagaaaatgatttggggctgcttttcattaaaaagaaaagccttaccaaggactcccatacccttgctatgtgcctaagtaattaactaattccttcttaactcctatatcaactggaggttttgcttttttttctttaaacagggtttcattttgttacccaggctggactgcagtggtgaaatcatagctcactgcagcctcaacctcttgggctcaagcgatcctcccgcctcagcctcctgtgtagctaggaccacaggtgtatgccaccacacctgcctaatttttaaaaaatttttgtagagatggggtctcactatattgctcaggctggtcttcaactcctggcctcaagtgtttctccgacctcagcctcccaaagagctgggattacgggcatgagccactgcacctagccaagactggagttttatgactcaaatcagcttcccccaaaatttggacactgggctttttaacgtgtaatttggctggtaggagacccgggcgtggggagtgctgagtggttggttggaggtggaatgacagaggacggacatgggttctttttgttgtcttctgttcttgtgtgggacggcagagctcgctgagccgcattaccagtctgggtggcgccggctggtgcatctcaatgaagggtttaaaaaatgtctcaacttcaaccttaggttttacaatagtgatgccatccctaggagcaactgaagaggtttggaatcttgtggcctccggctgcatggctcctaacctattaatataatttctaatcttgtgactaatttgttagtctttcaaaggcagtctgatccccggggaagaagggagtttgtttcagaaaagggctgttatctttgtttgaatgttaagctggaacttcctcctatggttatctgagtctgtgttcaggaatgaactagggctgttcgagggctacaggcacgatgcagtcggttaggtcagatctctttcactgtcgtaattttctcactgttataatttttgcaaaggcggtttcaatttaactgaaaatgtcaggcaaagaccaaatttaatatttttacagaaagccactgggagtagttttttattgttttattatttatttatttagagacagagtctcactctgttgcccaggctggagtgcagtggtgcaatcatagctcactgcagcctcaaactcctgggctcaagcgatcctcccacctcagcctcccgaggagctggggctacaggcacacaccatcatacccagctaaatttttaagaaattttttgtagagatggggtctcaccgttgtaactgcccaatgggtttaccttgccccctgcctaaacagggccgatttatcaagacagaggaattgtaatggagaaagagtaattcatgcagagccagctgtgcccgagaccagagttttattattactcaaatcagtctccccaggcattcagggtccagagtttttaaagataatttggcgggtaggggcttgggaagtggggagggctgattggtcaggttgcagagggaaccataggggggtgaagtgaggttttcttgctgttttctgttcctgggtggatggcggaactggttgagccagattaccgggctggctggtgtcagctgatccatccagtgcagaggctgcaaaatgtctcaaacaccgcgcttacgttttacaatagtgatgttacccccaggagcaatttgcagaggttcagactcttgagccagaggctgcacgacccctaaaccataatttttcttttcttttcttctttttttgtttttttcgagacagagtatcactctgttgcccaggcttgagtgcagtggtgtgatctcggctcactgcatcctctgcctccctggttcaagcaattctcctgcctcagcctccccagtaactgggactacgggcacatgtcaccatgcccggctaattttcatatttttaccagagacggggtttcaccatattgttccggccggtctcgaactcctgacctgaggcgatccaccctcatcggcctcccaaagtgctgggattataggcttgagccactgcgcccagccctaaactataatttttaatcttgtagctaatttgttagtcctacaaagtccaactggtccccaggcaagaaggaggtgttttcaggaaaaggctgtgatcagttttgtttcagagtgaaaccatgaactgaattccttcccaaagttagttgggcctatgcccaggaatgaacaaggacagcttaagggttagaagcaagatagagtcggttaggtctggcctctttcactgtcatcatttcctcagttacaatttttgcaaaggtggtttcgccacgttgcccaggctggtcttgaactgggctcaagcgatcctcctaccttggcctccataagtgctgggattacaggcctgcaccaccacatccggcccaccttggagcgtgttatataaagcgagccgtccccacacccctacagcctacgaatgagccttttcaccccatgcacgattctctgaaactgctctctgtaaggagctattcgggacacgttcttttgttctctggcatactcatcaggtagaaagaagtgattcagcaagcggctcccctgagagccctgatcgtttcctgttttcctgtgaagttagtctcgggaggtctgcgctgtgccatttttgggggaccattatctggctcccgaatggatcaaagcttactggtcagggggctgctgtatccctggggcaaaactgccagaaaatagcaggtagccctgtggtccttggcagggccagggcccggtggaagcagcagctgggccaagaacatcaggcgtgcatgaggcacagcccagttttgggagcatgacgcttgttttcgaggatgcctgtgctccccttcctgcctggacccctgctctccagccccggcagagcgaggctgtgagtcagcgctcggattagcatcagcatggaggtgccggctgggatgcaagccgccgccatgggatgagtcacgcggcttctccccgaatccccaaaggaggcagagcgtgttaggcttgttctggcttcatgcagagcactgaggggtgagggctgaccgtggctggccgcggagggaagcccaaagtctggcctccctgcggagactggggagaaaatgttgcgctcgtcgtttttaaatactgggggacaagtttcccttgtctgctaaggctgccattgtaaattacaagagtcaggagggctgaagcaaaagggatttcttctcccacagtcctggaggctggaagtctgagatcaaggtgtgagcagggctggttcctcctgaagcctctctccttggctcgtcgacatcatcatctccctgtgtcctcacagggtcgtccctctgtgtgtgtctgtgttccaatctcctctccttatgaggtgtcttagtccatttcaggctgctatcacagaatactatagactgggtggcttagaaacagcagacattgattctctcaccgtcctagaggctggaggtccaagatcaaggtgtgagcagggctggttcctcctgaggcctccctccttggcttgtagacaccatcttctccctgtgtcctcacagggtcgtccctctgtgtgtgtctgtgtcctcatctcctcttcttataaggtctgtagtcctattggattagggcccaccctagtgatctcgttttattttaatcacctctctaaggacgttgtgttcaaatacagtcacagtctgatgccctgggggttaggactgcgacctgtgaatttggagggggatatagttcagcccatagaacccactatccacataagtcattccacttcaaaatcagcacaaagcattagttttaaaaatctcaaatctgtatttttaaaaattgctcttaacacattagaaaaatatagaaaaactttttttgctgtttttctgagacaaaatctcactctgtagcccagcctggagtgcagggacgtgatcatagatcattgcagcctccacctcctgggctcaagcaatcttttgcctcagtcgtctcccaagtagtagctgagactacaggtgcacatcaccacacccagctattttttttttttaagtagaaacggggtctcactatgtttctcaggctgggctccaaatgagctcaagtggtcttaccgccttagcctcccaaagtggtaggattacaggtgggagccaccacacccaacctggaggaactctttttttttaaaattttaaataaattactatttgtggcctgcgttttcatcctattctctttttttttaaccaacatttgctggcatttttttttatgccgaagaaaacacctttgcccatctatgtcaggcctccagaccctcagggatgtacatctaatgcaccttcagccaccggtgtaaacagtaaacaggggccagatggcgcctgtgcaccttccctggccttgggagagcattggaatctctgcagcttttaagagcatcttgcttcaggtttgctgacctgcttgcttctgtaagatcatgcagacttcctgagcaatatctagcatttcatggtctcttttctatcctgcaggaagagggggctatagactcaactctcgttatggaaatacttatggtaaaggaattatgtcttacagaatatgtgaggcaaaactgtccatttgcaaataactaacacactgtctgcactgatgggaagctgatgctttcatccagtgcacaaccaactggccgttcgagtctctcatttgcattttccttggtcatccatgctggggggagatgttgtgcatgccctgaggacttcatttcttcaaaggaactatggcccacttacaggtgttactgggtgcatgtgtgtgcacgtgtgtgtgtatacatatgtgttcacacacaggtatgcttgtgtgtattgtgtgtgcatgcatgtgtacatgtgcatgtggattttgtaatcatgtgcataagtgcatgtggatttcatgtgcatgtgtgcaagtgtctgtgcacacatgtggattgagcacatgcatgtttgtgtatgtgcacagatgtgttggcatgtacttgtggattttgcatgtgtgcatgcttgtgcttgggttgcatgtgcattgcatgtttcccatgtgtgtccattcacatgcatacatttaggggtgtgcaagcacatgtgtgcatgtggatagatgcaggagtgtgcatctgggtgtgctcgtgtggtatgtgcatactgcacgaatatatcatgtgcatctgtgcatgtggattgtgtgtatacatgcgtgtgtacaggcatgcacacacacacatgaatgtgtttgtgtgtgcatatttgtgtgtacatgcatgtgtttatgcatacaggtgtaaacatgtgcacacatcggtgtgtgcatgtgcacacatgtgtacatgtgtatgtttaggcgaattgtgctttatatgtgcttttgttgcctgtgtgtgtggtatgtgcatgtgtgtgtatgtggggatgtgtgggatgtgcatgtgtgtggatgtgcacattgcattgtgcttctgtgttgcatttgtatttacatgttgcacatgtgtgtaaatgcatgtgtgtgtgcacgtgtgtatgcgtgcttgtctgcctgtgtgttgcacgtttgttgcatgctgcatgtgtgtatgcatgtgcacacacatttgtgcatgtcagtgtgtgttgcatgtgcttgtgtatgaatggcgtgcgtgtgtgcatgtgtgtccatggggttgtcagcctgtgtgtgttttgcatgcgcatgtatgtagactctccaatcctgaaattaaagctgcatctccctctccctggtattatccccattctgctaatgaccattagacatggcatacacattcacattcctcctccttatgctgcttggctgtccccctccccccacaagaatgtaaattccctgaaaacagggatctgtgtgctgtgttcacagtcgcatcctcaacagtgcccggcaatataaggccctccataagctctgctgaataaacacgaacatccttttccgcttacaggtggagatcaccattcaacgtatggcaatccagaaggtaactgattgactcacccggtcccaacctttaataagagcacactctcctagatcagtgctgggaggagctgtgtgggcttctgtttcccaacctcatgactttcacggagcactcatactttgtatgtatataaagtagctcctgaataaaaatatctgaccttcagcacaggaccaatcagagttcagagaaaggagaggcaagcattggttttcactgcagaagatgccccttagctctcaaagcaaggctgtgaatgagtgctgagactattacatttctcccagtaccaccattactcccctttctttgaccagcactaacttgaaacccaagaaggacaggagaaaggaaggtatgaacactctgcccaaagaagccatcagagtgcactgtcaatcccgtctcaggtcaaaggagggagaacttgaagcccagaaggctgactttgtgtcctgtattgttgggagaacaggttccccattccctaagggtcatattcttagagatttgggctgacacctgcttgagtttaagttgagagtaaacgcactcaaccccaaggctcttgtgagttttcaattatgggggaggagaaagtgattgaaggtgacctctacctttcaatgatcatgcagagtactagtatcaatatttttggggtatgttggcatccttagaaaaatttatggtttcacctttttccctctgtggtgtaaagtgaggtccagagatggaaagggcaaggcaaataaacaagtaattgcagtcaaatctgatgaataatttcctggaacatatgggatcctgtagcaaggcagaagggatactcctagactaggttaggtgagggaggtagggtttcctggagagaacaatatccaagccaatcccccaaaatatgggtgggaggtgcccaggagaagagtgaggtgtcagggaagatggtgcactaggtagagctggatacacacgtggggacaccggaaattgtgtagccaggatgtggaatgcaacgggaaccagggaaggatgcaatggtgaccaggaaagacctccaggttagcagaggtggagtctgcacttcatagaaccttcatgggaaggagcctgcccctgttgatatgtaggtgaagaatggacctgagggggctcactaagacccagggagacaccctttcagaccagttcagtactccctggaaatgatgacaggctgaattaaagcctgggcaaaggaggcaaagagaagcagtcagcttggatgaccacttggtaatgacaattgattgtacttgattgatttgtaagagatgagagagaggaaaaggtatgtatcagtcagctatgctgtgtcacaaaaaaccccaaaacttagtagctggaaataacaaccatttattatgttcgtgattatgtgagtcagcaatttgggctgacaccattctagtggtcctcctggtctcttctgaactccctctcttgtgtgcagtcaactgtaggtgtggccagcgctttgaccatgtttcctgggtcttcttatgtatctgggactttaggtggaatggctcatctcagcttcatgtgggctctcacatccctccaggaagccaggccaggcttcatcacatggtgaccagacagggtaccaagagcatgaagagaagcgtgcctgggcttagagccaccatgccttcacttgtgtgacattctgttggctaaagcctggattttcagaatgaagatgcagctccacctctggatggggaacactgtgaaatcatactgtggagcgtgttcatgtagggaggggaagaatagagggctgtctctcccaggaggcagggtgtggcgggcggcagcatcagccgtagagcaggttcttgcgttcagtgacaacactcttccccccagcatggcagcctcattcgtggagcagtcttgtgtccctcacctatgccatgccatgtattggcccaggtgttcaaccctgtctgaagaaagccatgcatggaaagggtggctatttcaaatggaaacggtgatttcttccttttttccctttggaagtgttgatttttgtcacatcaagctccttcttgttctttgtgcaggagtgccaaagctctggagcaatttgccatcgaggcattgaggatgcttgtgtctagtgtgtgcttgggtctagagttccagcatgcctttgaaagcaagcctatctggcagtttttagtggaacaatatttttgcatgagtgggcattctacatctaaaaaggcacaaaatagttttgacatgtgcctgtcatcccaactactcaggaggcggaggcaggaggatcacttgagcccaggagttcaggacgagcttaggcggcatagtgagaccccatctctaaaaaaataaatcaggccaggcgcggtggctcccctctgtaatcccaacactttgggaggctgaggcgagtggatcacctgaggtcaagagttcgagaccagcctggccaacatggtgaaaccccatctctactaaaaatgcaaaaattagttgggcatggtggcatacacctgtagtcccagctattcgggaggctgaggcaggagaatcgcttgaacccgggagaaggaggttgcagtgaactgagatcacgccactgtattccagactgggcgacagagcaacattccgtctcaaaaaataataagaaataaataaataaataaataaataaaattaattaaaaggcatacatgaattgacttcaacaaacaaacaaaaatgccaagtgcctcgtctgtgcaaatcctggccttggatgtcttcagtggtaaaatgtggttgacaagcttggctctttgtgaaaacagaattacttcctaaggtttttttttctttttttttaaattaagtttctcttttttttctgtgaatacaagggtgggaagggacgtgatggagaagttactagatagatgcaaaagttattgcagtttttgtcattactttcaatggcaaaaaccgcaataacttttggaccaacctaatatttaagcagttttcctgcagccatgtttttttctcggatgagcttgctttttctccactcctgcaggcaatatggtagcaaaaatcgtgtctcccatcgtatccgtggtggtggtgacactgctgggagcagcagccagttatttcaaactaaacaataggagaaattgtttcaggacccatggtaagtttggctctaaacattgttttgcttgttactaagcctgatttaaaaaaaaaaattactttcagatgtctgtcactagcaaggttatttctggttaagttcaatatacataacttgcctaataatgtgattttttaaaatttatttttattctttttgagacagagttacactgtgttgcccaggctggactgcagtggcaggacctcggctcactgcaacctctacctcctgggttcaagagattctcttgcctcagcctcccgaacagctgggactacaggcatgcaccaccacgcctggctaatttttgtatttttagtagagatggggtttcaccatgttggccaggctggtcttgaactcctgacctcaagtgagctgcccgccttggcctcccaaagttctgagattacaggcgtgagccaccgtgcctggccaacaattgggttttcatggtcaggtgtgagctgtaccttcctctaaaccttgttacaatgaggctggcacattatctgtctaatgtaaaagaggaggagaaaaaaaggaaagaaaaagaaacaaacaaacaaaaattaccaacctacattgcaagactataagcatgacggttggtttaactacctgttctgttttgtattcagtgaaattttcgtcacaggcgagtcaggaaaaatacctgggttgaatgtgaatgttttgcccagaaccccacccgcaaagaaaactaccgaaacactgaattataagcctctctgaaattccgaaggtgcgctcagaccataggggagaggaaagatctgctgtggcttcctggttcaatgccggctccacactcctgggtttgaagaatcacttgggatttgagagcagaggatgccctaaagaaatctctgaaacaacagtcagggattgttttatagcctaaagagtgactcagatctttaactgggtgtctctggaggcttggtttaaacctcaggccacccacgtcagaatctgtctggagtttgcccagggccctctaactcataccttctttgtgtccccgaaggaaaccagaaaggggtgcccattcctacggtgtttgctttaggatttgcatttggcctcaaaaatcctaaaaccttcccatgcgctccctctgctggtgaatgggcagtatcaaccgttagctaatgaacctccgtttggggtgagcctccgtctacattacgccccgtcctgaaattttaggaggaaactgagtttctgaaaaactgccttattttcctggcaacctgagagcagattcttgggttcagtgacaacactctttcacccaacatggcagccatcattaacgaacaccacgtgttaacttcagtagcttttgtggcagtgatttgtaagcctttgttaaccaagggctgaaactgagtaagcagagagaggcacccatctccacaagcacaaaatgtaagggcggggtacaggggtcccccacaaactcaataatcaaggcaaatatattttagtgcaatattttagaaggaaaatcattggaatgggggccagttgagtttctgaaataggtgtagttttaaaaacgtggatgatgcctgccccatttatctgaggtggaaggaagcacgtttttgctaaagaggtataatgtcttgaagctctttcatgccttttggctgcctggtaagtatttttgtctactttctccattgtacttcgatgataccctcaccaggtattcccaagcaccaagtttatcttcccctcccttaaagttcctgagatcagaaaggaggatgtagacagagtgagctgatgttagggagatctcttcaagggtgagcagtgacatttatgtggatcctgggcctatatcacctcgctggctgtaaagcctttatactatctaggaaatatgtgcatgacagcaaatacgtatgggtttggtatcaaatggggctcagagctctgcgaacttgactctaaagttccaggctgctgctaatggtacccagctgtccacctctccttagttaggtcattaattttctctgtctcctaaaggatgacgtacatggtatactaaccatatccatggtgatgtggtgcagtgcacaacctgtggaactgtgtacctgctgaggccatacactgaagcttgcacactttgtagagaaagagttgtagtaacagagctacacagatagaagcagatgtctgtcacttgatgtggacttttaagaatcatactttgcttttattttataaagtggagcaaatgacaacatcacttcagaagttataaagaccaacaaggccatattcgaaaaaagaagttcctacaaatattagttttaaccaaaaaggaagttactcaattcatttaagatcatcaaaatccttaacaaatggcaaaatgtcaaaaacaatgttttcaaaacgaatatttgtttccagatatgattttaacagtttttaaatattttctatttttaatttttcctgctttattgaggtatagttgacaaataaacattgtatatatttaagatgtacaacttcatttctgcatcatttatttgttctaatctatctccttctgccgaatgtaaagcaggtgtcatgtagacagcacatagtctgatcttggttttcttttttttaaaatagatttttcattcttctagctttattaaagtatgatagacaaacattgtatatatttaagatgtgcaacttcatttctgcttcatttttttctgttctaatcttccttctcctaaatctagagcaagagtctcttgtaacagcatagaattggatcttggttttctttttctctgtttaataagacttttttttttgcccccacaatgacatttgtttctaatcttcctttcagaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattgaatgtgatgtggttataaagataagttaggcagctagaccctgcgttctaaaaaaggattgcttgcaatgttggtttggctattcatttgcacaaagagactgtggctctctgttgtgagatcttcagctacctcatggtgcaataacacacacacgcttaaccatgttgatggcacaaagcggtgagcagtagggaggtagaatatcttggtggggaggggatgttatcagcttctgggagatgaagaatattgttgaggttccaaagatgctggacctgtgctaaattcttcagtgatatgaaaaaatcattgagcattcattattgcgaatgaagtggggatgcattatttctgacacccacaagcagggtttgatcatcctttcagctttgagatatctgcacataaaattattattacctgaagaaaataaggctgcattttgaaatgttaagtgcaaaatgactgatgttaaaaccatctgggggaaatcttgggatgctttttcctaggaaatcatatggttgtgatatgttttggcgcataggagacagaaatagtgattatcaggcgttgagcctttttgtagtatttttagtctttgatactctgtaagtgctagttcctaaggcaccaacattgcattccttggtttatactttttctattcatcagggtaggaagtcttaaatccttaggcatccaagaagtatactagctttttgcttctcttttagaaatacttgtggggagagaaaaaaggatggtttgggcatattggtatagtttgagtaaactaaggttaatgttcatataacatttagactttgccataaatatcagaaccaaagatcaagacattcatgtacagtctggaatgtatatatggggcccataaaaattcccagtatgcatgttttatgctcaccattatgaattggggtcttcaaagagagaaggttgaaagtggaaagcacttgaaagggctccccggtttgtaaaatatctttaatcattcacattaggtacctcggagttgcgggtctcaaatgtggattcatgcatcatttgtgcagtttgaagatagtccatatttcctatttcagtattaggtcctgcaacacttttcaattcttgtagaaggtttttttcaggagtggtgatgtctgatgctcaattactattttccctataagagtttcagcatgagcttaattaaattcttgtgaaaaaacctgtgtttttagttacacacacacacacacacacacctacttaaatggaatctaaacatttttagcctttaatccattccattttctaaaactgtcataaactatttttaatcattttaaataaatgtaaaagaaaaataactggatttgattattgaatagtttttttctatatttcacaaataaattgtatgaaatgactgtagaagtggccccaaaattatgaaccttcgtagctgtgaatatgatgccataaatctcttttaaagctcaagatagactatgaacatatgaaatacatagttacctaatcatgagactaaattcacctgggtgacaaggctaacgttcaagctacttaagatgaaaatatttgaatcatgattgcttgggggaacctctctttgaggggtcatgaggaccacctgctgggcattctgttttcatgctgagaaggtgagaattgaacagatgagaaaagccttgataaaacgtcatctccatgtaatttagagaaggataaccttgactgtacagctgacccttgaacaacacagggctgaactgcacatgtccacctgtatgtgagtttgcttctggctctgccattactgagacagcaggaccaaccctccatctactcaatgggaagatgataaggatgaagacctttatggtgatccgcttccacttaataaatagtaaattcattaattttatcttccttatgattttcttcataacattttctttcctctagcttactttattgtaataatatggtatgtaatacatatacaaaatacgtgttcaactgttaccagtaaggctttcagtcaaccagtatgctatgagtagttaagtttttggagagtcaattcatacagcccttgatttttttttttttttcaattaagttcatttagatggtcagaaatgtcagttaagcgtcatttgaaggtaataactaaccttgaaaaactagtggcttgggtatagttttccaaaaagttaggctgggcgtagtggctcacacctgtaatcccagcactttgggaggcctaggtgaggggattgcttgagcctaggagttcaagaccaggctgggcaacatagtgagacccccatctctagtaacgatttaaaaattagctgggcgtcgtagtgcacacctgtagtcccagctacgtgggaggatcacttgaacacagaaattcaagaccatagtgagctgcgatagcaccactgcactccagcttgggcaacagagtgagactctcaaagaaagaaggaaggaaggaagggagggagggagagagggaggaaggaaggaagaaaggaaggaaggaaggagagacagagaaggagggagggaggaagggaaggaaggaaggaaggaaggaaggaaggaaggaaataaatttgattcttttcgcccataaatttgtgatgaagcaccagttttggaaagcttccctgctttggtagaaatagcagatggcaagattctgatatcttctactatgaagttcaaagcagtcagaagtgggcagcttggtttttctgaaatttatcattctgacatcggactgagacctagaggagattttttaatgccatctgacagatctaaaatacatcttctaagagtactatgcaaaagtggcagctgtcctgtttgcttggcttcattgatccaaaccacagggttgacaattttccttcacatggatacagtgagggattctgcagttatatgaggcatttgagtcaaggtgatacttgcttcttgattccacagatgccactttttgcctttgaggacttgctaaagagttcagacttttcctactgtatgttttctgtgcagaagtcatgttgtgtggtgaggaccatggattttatttcatttcttaacctttctatgcaaatgagaccttgaggctgcagagaacaaaattattgggatgcacaaatccaaatggaaataggctcagtttagctaaggaggacacttgtgttatcttgtgattctaatgacgttcaagctttaatcacaacattttcgtgcaaaaggaaaaatacatatattatatacgtgtgtgtgtatctcctgtaaaataaaaacaatatattgtattaaggaggccttgcagctgttgtccttatagcttcagaaattttatttttttcaatatattattcttaggtctgtagtatgaaagttcttttaaaataaactgtacaacaatttcacaaaatattcaaaataaaaaagagggagtgtttggatattaattgtcactaaatttaataattaaaatactaaaaattttacaaaggggtgaccacactaaaattcatatatccccaaagatctcttaaaaattagatttttcaggctgggtgcagtggctcatgtctgtaatcccagcactttgggaggccaagatggggggatcacttgaggccagaggttggagaccagcctgggcaacagagcaagaccccatctgtacaaaaattttgtaaaaattagctggatgcagtggtgtgtgcctgtagttatagctacttaggaggttgaggcaggaagatcacttgagcccaggagttcaaggctgtagtgagttatgattgtgccactgcattccagcctgaggaacagagtgagagcttgtctctaaaaaagaaaaaaaatagatattttgaacattgcaaaagcctacaatctttttaatattgattactttagttaaattcttctccatttaatgtgattttagaagtaatccttttacatctggaaaatggagaataatttattatttcacccagagaatgataaatcaatcaatcaaaatatagcaatctagaaagctaataaataatgttctaattagggagacctactgccagtaggagtaatagataataacaatactatttgctgaatcattttattttagtagaaaaataagctttcaaagtaatttatttacttatttatttatttttgagatggaggctcactctgtcgcccaggctggagtgcagtggcacgacctcggctcactgcaacctccgcctcccgggttcaggcgattctccctgcctcagcctcctgagcagctgggattacaggcacccaccatcatgcccagctaatttttgtatttttagtagagacggggttttgccatgttggccaggctggtcttgaactcctgacctcaggtgatctgcccgcctcagcctcccaaagtgctgggattacaggcgtgagccactgcgcccagccttttaaaataatttacatactttacacatgtacacataaaaatggatgttggttggatgtggtggctcatacctgtaatcccagcactttgggaggtcgaggtgggtggatcacttgagcacttgagccttggagtttgagaccaagcttggcgacatatcgagactctgtctctacaaaaaaattaaaaaattagctgggcgtggtagtacatgcctatggtcctagctacttcggaggctgagacaggagaattgcttgagcctgggaggttgaagcagcagtgagctctgattgcacaattgcactgaagcccaggtgacagagcaagaccctgtcaaaaaaaaaggatgtcagtgataatgagttgtttataaagatagaattagagttccagggatgactggagaggtatagtgtattataacccctaccatgtgcccgtcagggactggtacttaaaagtcaaaacagtaactgcagaatttgagaggtgtacaaagatagtctctcaaatagtgctcagttattagttcagcgatggtcagtttgtgcatagctatgaaactagcttatcacggtaaaaagtgtgtacgcttcactatcttgtagcatttagtttcccagcagggccatgcgacacccagtggacatttctaaattgtacattcaaaaaaatgttaccactggctgcaacatttttttcattaaacataaaagttggtcttgggggtgtcattcaatgccttttctgcttccttcagaattctaaaggcttccaccacaactttgatctgagcccagttatgaacttcatacaaagctgcagggaggagcctgtgtctgttgaagaaaggctcacaagatcccatggtaaggggagaggagaaggggtaatgaggaagaaaggcagctttccaggggccgagtccggaagaccagacttgtcagagaatggaactagcttgtccagtctcagcccatgagagagtttcacgccacgtgctattctggttctgaacattgagcacttgggtgacttggaatggcctccatctaagctgcatcttcccccatagttccaaatataaatgcaatgcattccctgggttcctgccagccattgtcacgtttttgcttcacagctgtctcctccctgctccccgtcctattcatctgccccttgctagacaggtattcatgaaacatgactgcttgtttatgaatagctgggatgtagacatgacatacggaaagagaagctgccaatttttccccaaccaaaagtgaaaacagtgcttggacctaacaagcatagaatgtttgatcccatagcagagctggtgggaaggctgggggcaaaatctgacactgtccaccattggctgtagaccaaagggaggctgcagaccaaagggaggccgcagggaggtgagatcatttcaatcgcaggtccccacccactacgagcacttcctcacccacatcctctgttctaatcttttctgtctatctcttatcaacttccaacatatgataacgtatcaccttttattgtttctctcccggctccatccccactagaatgcaactgctacaaaggcatggatttgtccccagtttccagaaacatgactggcatgtagtagatgctcattaaagacttatttatttatttattgagacaatgtcttgctctgccgcccaggctggagcgctgcagtgtgatcctggttcactgcagcctcaaactcctgggctccaacgatcttgtcacctcagcttcctgtgtagctggcacaacaggcatgtcctaccatgcctggctaatttatttattgtttttgtagagacggggtctcactgtgcttcccaggctggtctcgaactcctgggctctagtgattttcccaccttggcctcccaaattgctgggattacagacttgagccaccacgcctggccctaaagacttattaaacacacgggaaaatgaatgaatgaagccctcgttcaggccacaactttaataatattaaagaggagatattttcttttggtattctagctaaagacttttgggatgagatggatagggatattaacaaatgtgtgtgtttttaaaaaatatacatattatgaaataaaacatctggaagacctccataactcaatgaaccaatattctacaaatgacccatgtgtgaagtggcagaatcatgaatggataaaaggtttgtctgaagcttaagataaacctgtgggttttaaatgtgtagactttaaaaattcagtgataggatttcagattccacactaccttatctttgagaagctattgatgatcaagttttgtcatcaaaggagaacattcacagttatttgaaaagattactaaaatactttttctaactatgtatctttgtgaggctagattttcttcatctactttaacctgaacaacataaggaatgctgatctgagaaactggttgtctcctcataagtcagatattaacaagatttgtaaacatgtaaaacagtacactcttcccctatgaaaatttttctgtttgaaaaaatatatcccatttttcataaaattatgttatttatgtaaaatgtagtggatttatctttaaaattattaaatagtcaaaaacttcattttaattttagaaaatatagaaatattaattttaatttattacagcgttaaatttaatgcaatataatttaattacagaacatgtagacatttacaatgcacaaaaacaaaagttcctctaggcccttaatcattgttaagagggcaaaagaggcagggcgcgacggctcatgcctgtaatcccagcactttgtgaggccgaggcgggcggatcacctgaagtcaggagttcgagaccagcctggccaacatggtgaaaacccgtctctactaaaaatacaaaaattagccgtgtgtggtggcacgtgcctgtagtcccagctactcgggaggctgagataggaaaattgcttgaacccgggaggtggaggctgcagtgagctgagatcacgccactacactccagcctgggcaagacagagagagactctgtctcaaaacaaaacaaaaaaagaaggcaaaggaatcctgtgaccaacatgtttcacaatttctgcttgatgttataaatgatggcactttcccccggaaatctctgcagttttatcagtctccctccctgtctgaccacctcaatccttttctatctctgctgactcaaaatggttgaagcaataaagacagcatctgtaacaagatgtacttagattcaggacctctgggctgggtcagtttgagggcttaacaatgtcctccagtagccaggttctctgtgtcttgcagtcctgtgtttcataagtcatcggcccatttcactcatggcagaagatggctgctgtacctccagccatcacagcctcatctactaatatctggaggcccaattaggatcatttcctcccagattttctcttttaagagcaaagacattctttcagggatcaagcccaattcctcatccctgatttacacacagcccctaactaaaagtaatcaggtgtaggccaggcatggcagctcacacttgtaattccaacactttgagaggctgagtcaggaggatcacctaaggtcaggagttcaagaccaacctggccaacatggtgaaacctcgtctctactaaaaatacaaaattagccaggcatggtggtgggcgcctgtaatcccagctacttgggaggctgaggcaggagaatcgcttgaacctgggaggtggaggttgcagtgagccaagatcgtgccatttcactccagcctgggcaacagagtgagactccctctcaaaaaaaaaaaaaaaaaaaaaaagcctgagaaagcatgaaggaaccctgggaaaaaatacaggctccaccaacaataaggaaaaatgatggttgactgggtagccagtagcatgtgctgcaaatcatttgcttattttgtgtcaagttgtttgccaatgtagctctttatatattatatattattatgttactctttaccaaaatataaaatattgagatgtaattgtagttgtgacccacacacatacatgtaaatgcatgtattgcaaatgtgttctctcattctgtatttgtcttcaattcttagaacctttgtcacaatcatgtcgtgcaatcaagtagcttggcacaaacatctgttctgtgccttctgagtttgattttttgttgttgttgtttgagacagagtcttgctctgtcacccaggctggagtgccgatcatggctcactgcagccttgaactcgcaggctcaagcaatcctcccaccttagcctcctgagtagctgggactacaggcgtgtgccaacactctcagctaatttttttatttttattttttgtaaagatgaggggaatctcactatattggccaggccggtcttgaattcctgagctgaggcgatcctcccactttagcctcctgagtagctgggacaacaggcgtgtgccaacactctcggctaattttttaaaaattttttgtaaagtcagagggatctcactatattggccaggctgttcttgaactcctgagctcacgtgatcctcctgcctttacctcccaaagtgctgggatggcaggcatgagccaccatgcccagctgcctgccgggtttcaatccttcctttcccagcacacatgtaattttaaaaaggtcttgtaactaactctccaataaagttgtcccaggcatataaatgtcttgacgttttcttcaaatgcctccctaggaaaattggcacacacctattcccggcaacagggaggagagaaaggtttactctgaatgcacccatgacaaagcttacctgctgccaagctctccatggcttcctggagaccaacacacacaggaacagaagcccggcaacccccgggggaagatgcctcctccgggtttaaaaacagagctacccttttgcccggggatcatgagggttgccttgtgacttagtgccttatactctgctttcggagcaccaattctcagtggaacgggagaaacaggcgggtgaggaggggtggggtgatttatggggcagagaatggtgcaacacctacccttgtttgtgttgggagaccgaggcctcctccatgccctaaacatgctgtttaaacatccctgcaatttcgccaacgtctctttctctctggctgcctcaacccttttctatctctgccaaatccatgctccactgtctccggccctcctggctccagctacccctccccaacaccctcaaatctcagaaatgcaagcagtgcctctcaagcctgcgcattaggaactcctggaggcctggttcacatagcggggttggaggaagccccgagacgcagggttctgatttcagagttcggatgcctaagaatgtgcatgacacagtttcccaggtgacgctgatgctgccggactaggactgagcctgcacatctcaccctgaattcaaaatcaaaagatggggtgagggttctcggcaaaacgcagcctgagattctattttggagacccctgttccagagagaagagcagtgctcctgacacttggtgggtggggcccagggacgctgctcaacaccctgcagtgcacaggacgccccccacagtcattcaacttaaatgttattagtgataaagttgagaaagactctatctattgtctatctatgtatccatctatccacccattcatctatcatcatttatctattacctatgtatcatttatctattatgtctatacatctagccatccatcatccatcatcattatttattatctatcatttatctaatatctgtcttcctgtctatcttcatcatcatcatcatcatcatcatcaatctcttatctatttatcatctatctccatatatgtatgtatctatgtatctctatatctatgtatcatctatttatcacctatctatctctctatcctatctatcatctatctgtccattcatcctatctcatctatcatctacctatgtatcatctatcatgcatctactgatctatttatctatccattatctatctatttatttatcatctatctaaacagtggcttacagcctaagaatgattctgcccctgctcctaccaggggacactgtgcaatgtttgaggtcagttttaattgtcactactggaaagtgtgccaatggcacccggcagatggagcccagggatactgctcaacaccctacagtgcacaggatgggcccacctcagagaatccagccctgaatgccacaaacgccttggtgaaaaactccagtagtaacttccatctaaccttgggaaagggatcaggttgacagtcacatcattctgaacagtccaggaggcaggagctgtctgagtcttttgtaaatgcccctcttgttagaacactcataagaccctttcccgtaggaggatcctcccttacccagagcaagagcacagcactccacggtttccctgctggagcaatgagaagccaacacaggccccatggaacgagttggcagcacaaggctgtgcagacatctggcgactattggagccaacaaggagaaagcatagaagctgggagagtctccccttccttgcacaagaactgagacttccttggaggggccagcttcatcctggcatttctcttctttggggctggcatccagaggatagaaaactgaggtcgtactggcaaagggggctccgccggggcacttcttggctcctaaggatttccccaatgcctcaggggctggacggatttgaaagtggaccccctatggaaaatgatacagagatttctcaaagaactaaaattttatctaccagttgatctaacaattccactacaaggtattcacccaaaggaaaacaagtcattatatcaaaaacacacctgcactcatatgtttattacagcaccattcacaatagcaaagatacggagtcaacccaggtgctcatcgacaggtgattggatacagaaaatgtgatttatgtgtacaatggaatcatattcagccatgcaaaagaatgaaattctatcttttgcagcaacatggatgaaactggaggccattatcttaagtcaaataactgagaaaaagaacgtcaattaccacgtgttctcactcataagtgggagctaaataatatgtccacatggacatagagagtggattaatagacactggagatacaaaagggtgagagagtgggaggatggtggagaatgagaaattacttaataggtaccatgtacactattcaggtgatgcttaccctggaaacccagacttcaccacaactcagtatatctatgtaacaaaattgcactttaccccataaatttacacaaataaaataaaataaatcagtaaaattggatatgtcaacctgtttaaaacaaacgaatgcagaaaaaaaacatgttgtaataacatataaaaataaataaagatggcttcttgatgtttaatatgccctgcagatatcttacaaagccccagtagtcacgagttaaattcttgcctgtagcctgctggaggtcagagatagcctccactgtttatgtacagctctggccccatctatgaagtagagctaaaaacaccaccgatacctgtccccaaggctgagctgatgcaggaacagccctcagcacagtgcctggtatccacagaccatcgatcatcctaggtattcatctagatcaggaaggcctgactgtagcttgcgttgattgccattgacagtttcggcaagaatctgggttcctttgctgtctctttcggatggacacgtgaaggctcttctccaagtaagttcactcattcgactcatgcactcatacatgcatgcactcacaccatcatcactcattcaactcatacatgcatgccctcacacagtcatcactcattcaactcatacatgcatgccctcacacagtcatcactcattcaactcatacatgcatgccctcacacagtcatcactcattcaactcatacatgcatgcactcacacagtcatcactcattcaactcatacatgcatgcactcacagtcatcactcattcaactcatgaactcatacatgcttgcattcacacattcattgattcattcacttaattcactcatgcatgcatgcatgcattcacactttcacttattcattcatgcatccattaacttgtccatgcattcaattcattcattcactcatacataatacattaattcctgaagtgtatgcagtcttcactcattcactcgtgtgtgtgcattaacacacatgctagtttgttcagctcattcctgtactcatacatatttattcactcagtcattcggccacgtattcacttgtcatgtattctcttcattcactcacacacacatccattcctgtataaatgcatgccttcacgtgctcaatcaatcctgcatgcatgaattcactcactcatgcaggcatgaactcacttgttcactcactcattcatgcactcactcatgcttgtacgaattcgcttatttactcattcatacactcatgcaggcatgaactcacttgttcactcattcgtgcactcatgcatgcatgaattcacttgtttactcactcatacatgcacttatacatgcatgaattcacttcttaagtcattcatgcactcaatcacgtatgaattcgcttgttcactcattcatgcactcactcatgcaggcatgaattcgcttgtttattcactcatgcagtcactcatgcatgcataagttcacttgttcacttattcatgcactcactcatgtatgcatgaattcacctttcacccattcatgcactatgcatgcatgaattcacttgttcactcaatcattcatgcattcaactcattcattcactcattcatagattcatgccttcacgcatgcatgcatgcattcacctatattttccacacagtcacacctccattcacgcatctatctctaaattcattcatacatgcattggctcgttcatgccttcaactcatgcattcatgtgtgaatgcattcattccctccttggcgcaaacattgattcaatggttcattcatttcctggcctgctcattcatgagtagttgtttgttcattcacgcctcacatgcattcacgcatacatgcactcacgcatacatgcactcaccgcgtgcgtacagccactcgctcgctatgcattcaacagctgaagcctgaaaccctcatttattctttctttcgtgcactcattcattcattcagtttatgcgtgtaagtacgcgcacgtgcatttttcatgcattcgacaagatcgcgtataagccctgccttctccctctgggaggcttccagagcggcctccactcttgctgcgcgctggccttgggcccagggccttaagtcatcgcaaacgtttactttggggctggctgattaaaggttaaatgtccaaacctagaaaccgccgactgccgaaggggccgcggcgggcgaggggcggggcgcgggcgtggatcgcagcccccggcggttcccgggtctctcttcccggcagccggggctgggcaccaggcggcgcgcgggcttgcgggcaggggctgcagggaggaggagaggacccgcgcccgcgggggctggcggaggcggggccgggcttccggacagaggccaatcgctgccctcggggcctccagcgccggctctgggccgaggcagccagagcgcggaagaggtgcggggggctgtagggggctgcaggggaccgtgggcagtggaggaggcctgggcgcggcggggggccggggggcgcagaggctgcccgaacgcctaggaggtctcgagggtgggtggcgtacagcggggcgggggcgcaacccagaggccgaggctgggggctgggggaggggcgccggactggagtgcaaaggaggggcgaggggcgcagggggctggaggtcagaggttgcccaagcgcgaaggaggggaggggtgcggggcgcgggagtaggccaggagcgcttaggggtgagtgcgccgagccagggcaccgagtgctggggaatacaggccgtccaggcgcggcggggcgcggggagacggaggctgccggagtacggaggacagacggggcgcgggcgtagggctgggaggcttggggaggggggcgcgggcccaaggcagaggctgcgggagcgcggggcaagggagaggtgcagagcgtggagggggctcgggggcgcttggggaggatgggcggcaggccgggtcggggaggaggggcggcgagaggcgcaggggtaggccggggggctgcactggagtgacgagggagggggcacctggccggggggcgcgggcagaggcagcccaagctcggaggaggtgcagatactggcgtccgggagcgcaggggtggtccagggagtggagaggggtgaccggggggcgccagctggggtggaggaagaggatgcccagaactccaagcaggtgcgcggggcggcggggcagctgctgacaccgctgaggtcgggtggtgtcccgggggcgttgtcgttgctgggcgcatgggtgttaagacgcagcggggtcgcaggtgactgtggggaggacagggggtcaaggggcccctggccagagggcacgaggctgacctggagcgccaaggaggaagtgcggggcgtggaggtcgcaggggcatcgggggaggcaggggccccgtggggcgcaggtgacatggagtgggtaggaggccgggggtgacactggcggggcctgcagccgagggtgtcgagactgccacgctgtcgcccccaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcgggtgagtagctcaagctgcttcagttcagcctgcctgttcctactggcttgggtgacagattggtctgcactggggagaaccccactttgaccgcaggattgccccaaaccccgagtctcccccttactgcctcgcccaggtctctctggggctggagggaatggagataccagcctcagctgctgggagggggtgatttacagcaagtgaagggggccttgggatttcaccagtttccttttgtaaaatatagtcctgaaactttcaatgggcttgtttcttgggaatagcattgaactgcctgagactgtcactgcctggaaggccgatgggaagaagtctgttctcctgaaatggccctaaagctctgggaagaggctgccttgagttcttagaactcagaccacggttttaatttctgtttccagtacagatacagggatggcccggcttggtggctcaggcctgtaatcccagcactttgggaagctgaggcgggaggattgcttgaggccaggagtttgagaccatcctgggcaacatagggagaccacatctctaggaaaaaaatttaaaaatcagctgggcattgcggcacctgcctgtagtcccagctactagggaagctgaggtgggagggtcctgagcccaggagttccaggctgcagtgagctatgagtgcaccactgcactccagcttgggtgacagagtgagaccctgtctctaaaaaacaacaacaaaataagaatccaggttaatcctcctgcaggcagagggctggctggcaagaatggcaggaaaggcctgcccccgccaaggaccggtgagccccatctccctgcccttgggttttgtggacatcagatagactggttgacttaagaggcctagatatgtgaacagagtgtaacctcttcccataagaaagatgctggttctattttctatcattaaatcattaagacacctccttcttgtaccagaccacactggatcattctatgagtgcattttatgtatttatttttaaatgtatattttttaaattttgtagagacagggtcttgctatgttgcccaggctggtcttgaacttctaggctcaagcagtcctcctcctttggcctctcaaagtgctgggattacaggcacgagccaccacgcctggccatgagtgcaatttaaaacacacaaacagaacagatgacttttttattcagaggagagatttggtaaatcacagagctgcttctctcctgtttgttcccactctggacttagagatgaaaattgtcggggcagggatcttaagggctgttttcatgaggtgtactggaagagtctgttccaaggaatggcagaaaagattctctgttctagggacgcgtttggagctctctaaagtgaaagccacacatttccccaagcctgctagggtctgtataatagcagcattcaagacggacattcgcatacatcttggtcagcctcgtgccagaagagaagactcaactctttgcagaaaacaaaaaccacctttgagtagaaaagggctgagaaggaagctgctaaggttattttggggggtgatcagaagattccttgagtgcaggggggcaggcaaggggtagaaagaaactgttgtcacagattcataaaattctcagccactgtaatctccagactggacttgattttgtgacaatgtctcctttttgtgggctgtggtgcagtgacaggttttcttgctgtttttccactccatgccgttgctgaaagtgtccgccgcagtggcacttggagtggaaactccctctttgaatgcagtagcattggataattgtggatgttctctggcgtctggcgccgcaccaggacttgatcaccagttgtttcttcaaggcaaggcgatgtggaagctaagccctgtcaatcaatgtttcatcttctgttctatttcaatctgctggtctgtctttgcactttagatgggttttacagtgtcctggatgggaagcggctaaccttcaggaggtgcacatttttgttccaaagcaaaagtctgagtctcggatcccttgttgctggagagagctcgtgtgccaactggtgttgtcttgtcattgtgtgactgtggtcaatattccctccactctaaaccaaagagagaaacagggtatccagtagttccataaaactctcactctaaatgcagccctgtctgcattctcttttgtgtttgagatcaaggtgggtgtgggcagggctggttcctcctgaggcctctctcctgggcttggtcctcacagggtcttccctttgtgtgtgtctgtgtcctaatcgcctctttttttttgagatggaattttgctcttgtcgcccaggctggagtgcgatggtgcaatatcggctcactgcagcttccgcctcttgggttcaagcgattctcctgcctcagcctcctgagtagctgggattacaggtgcccgcccccatgcccggctcacttttgtatttttagtacagatggggtttctccatgttggtcaggctggttttgaactcctgacctcaggtgatccacctgccttggcctcccaaagtgttgggattacaggcgtgagccaccacgcttggcctaatctcctttcttataaggacaccaatcctattggatcagagcccaccctagtgacttaattttatcttaatctcttctttaaagaccccatctccaaatacagtcacattctgaggtcctgcaggttatgatattcatatatgaattttggaggtgcacaagtcagcccataataggataactcatttatttgaatactactgtgtttttctgctggggctgccataacaaagtcccacagactgggcggcttaaacaacacacatttactctcccacagtcttggaggctggaaatctgagatcagggtgtgggcagggctgtttcctcctgacgcctctctccttggcttgtagatgttgtctttctctgtatctccacaaggtcatccttctgtgtgtgtgtgtgtctgtgtcctcatctcctcttgtagtgaggccagcagtgctactgtattagggcccaccctagtgacctcattttaccataatcacctctttaaagaccccatcttcaaatgcagacacattcagaggttctgtggggtagggtttcatcctaggcgtttcaggatgggttatcatccgtctataacacccattaatcctcatgttttccctgaggtccccatgaagagctataaagccagcgcatgtggttatcaatcaatgatcactctgccatttctcttagttgtcactgagatcctcatgaagagattaaaaaaaccagcgcacatcgttatcaatcattgatcactttgccagttcgcatagttgtcactcacgtcctgatgaagagataaaaagcccatgcgcatggttatcaatcattgatcactctgtcatttctttcagttgtcactgagatcctcatgaaggggtaaaaaaccagagcctgtggttatcagtcactgattgctttgccatttctcttagttgtcactgatgccctcatgaagaactataaaaccagcacaggtggcgatcaatcactgatcactttgccattcctgtgtgttgtcctctgcaccttgctttgggccaattcacttgcatcatccttttctctagacagccagagggccctccctggcaatggagatgagaccttcttacaggttttggaaccctcaaatagctcctcataagcctcaggataatagaaaaggctgcatatcacctttgtaatccgggccctctgaccccatctcttcctgtgggtccttgttctccagctgctgttgctacgctgtgaggaatgcaggatgcagcatgcaacctatcatctccacctctggccttggctggtggattttttctgcctcttccttctttgccttattatttttggttcagtttcttattggaggcaggagacagtagctattttgagggcttttgttggtgttggagtcagaggtgacctcggacatttaattactcgttgaagccccggtttacttgtttttgaagcacatgtctgtgttggaaagggaattaatgagagcgcagaggtatgccctatctacacactcctggagggatgggagccatattcattcttgtttgttgctccactgatttcttgatggataagttcttcctggccatttatccctgagcttggatggtgccctttcaaaaactgctgccagccataggacttgccttgcagtatcgaaacacccatttcttagggctaatgtttctcatggagctgtgggtgtctgaggacagagcttgtaccttgtcagctgctgggcccagcacctagcagattctcgtgcctgggaattgcctgggacgtgaacccacagtgaacgtgtaatgcactgagagcacgtcattaggcccacacagacatcttctgccccttcaccttctttgtcttctgcctccagcttcaatccttcactctttctctaagcagatgcccttatgtgtgcagcttatggcatagcactgtggactgggataagcagtgtcccccataaaactcatgtccccccagaagctgtgaatgggacctgtgaacccaaaagtatctgagacaggtctcaatccatttagaaagtttattttgccaaggttaaggacatgcccgtgacacagcttcaggaggtcccgacaacatgggccaaaggtggtcggggtacagcttgcttttacacatttcagagacatgagacatcagtcaatacatgtaagatacacattgctttgatctgaaagggtgggactacttgaagcaagggggttgcggggggtggtgccaggtcataggtagatttttaaatgttctgattagtcgaaagagttattatcaatagaagagaatgtctgggttatgataagaggttgtagagaccaaggttttatcacgcagatgaaacttccaggtagcaggcttcagagagaatagattgtaaaggtttctcatcagacttgaggtctgtgtggatgtttatggtggtcagcttttcctgaattccaaaatggaggaggttatgatgaggcatgtctgaccctctcctcattatggcctgaactcgtttttcaggttaactttggaatgcccttggccaattaggtagttgcgaggcctagaattttagtttaggtttacagaccttattgggaaatagggtctttgcagatgtaattagttaagcatctcaagataagattatcctggaatatttgggtgggccctaaatccaatggcaggtgtccttctaagagatagaagaagagacacagacacagaggaggccatgtggagttggaggcagagattggagtaatgtggccacaagcccagggacatctggagccaccaggagctggaagaggcaggaaggacccttctctagagtttggttttggaatcctggccttcagaactgcaagagagtaaatgtgtgttgtttaagtctcccagcgtgtggtactttctcacagcagccccaggaagctcattcatgggtttgctagggaaaggagtcagcgatgagcccaccagtaagcaaaatgagcacagcaggtaagatggcacaagagatgaagggtcctgtgtcataggaggtgagggactgtgatgagaagggtcgtcttggggagcagggtttgcaggaagatctctgagggatgggtggttttttccatggccaccatgtgctgggaggagagcaagttccaggtgagttaagggagtggtagtagccccatggtagtagcacacatcataggatgtgcttgaagacccagaggggttgagctggacgtggggactgagtgtgggggatgagatgaccagcagtctggacccagcttacatttgcagacaatgagaaaaccattggcgttgggttggctttcagggcagctgatggctttcactgtgtgttgggggagaaaatgtggtttttaaggaccgaggagacagataacagggaccagaatctacagggtggagcagagaatgcaaaggagggaagctgtggctcagggtggttgatgcagagacccattttaaatgttttctagtctggtgcggtggctggctcacacctgtaatcctagcactttgggaggccaggacgggaggattgcttgaggccaggagtttgagaccagcctgggtgacagagcaagagaccccatctctacagaaaagttaaaaataaattagccaggtgtggtgagcatctgtagtcccagctactcaggaggccaaggcaggaggatagcttgagcccaggagttccgggcttcagtgagctgtgatgctgctgctgcactccagccctggtggcagacagagcaagaccctgtcaaaaaaaaaaaaaaaaaaaagccaggcacagaaggacacctgtagtcccagcactttgggaggctgaggcgggtagattgcctgagcccaggagttcgagaccagcttgggcaacataacctgtctctaccaaaaatataaaaaatagctggatgtagtggtgtgcacttgcggtccctgctactcaggaggctgaggtgggaggattgcttgctctcaggaagtcgaggctgcagtgagctgaaatcatatcactgcgctccagcctgagcaacagacggagaccttctctcaaaaaccaccaccaccacaacgtaatgaacaaccccaacattttctgttgtgcctctcggttaagatctcaggttagttatgcaagagtagaatgtgggattggaggcaagtggacttctccttaccccagaattcatgtcataaatgctctgcacagacgaggcttctgggactcttggggagacctaggaggtgggtaatagggatctgaatctacacggtggagctcatgacccaggtcagatgatgccaagtttcattttatacattctctgttcttcttctctgctccttaagagcgcaggtcagtaagtggggttggaaacagtggactcttccttactggggtataggagttggcacgctaaatattctgcaaagcttgctcttgcaggaccaagcatctaaatagtaaggtctaacctcagtcatctgtttctggaggaaaatcccaaagcatggcctttggagtgtgatttagccctcattctcagattcagtggtgaagttcagaggggagccaatccctctgagcatctcgaaggtggacagaacagtcagctcaggaggaaatctcaaaacaacgcccctcctcgggagttctcttacctttgtcattgtagttcctaaaggatgcactccttttcctttctattctttaattcacagggtccttaaacatggttcctcagatttcaataatctatacattggagatcacaaagaaatcttaatactgccaatgaaaggctaaaaattgtaaatggcactttattttcagtttgacattactttgctgatgattcttttcataatatatatgatttgatttaccttattttttactttgccatctgctttgcaattaaatacacacacacacacacacacacacacacacatacacacacacacacgttttctttttaaagacagggctctgctctgtaacccaagctggagtgcagtggcacaattatatctcactgcagcctccaacttctgggtcaaacaatcctgccgtctcagcttcccaagtagctgggactacaggcatgtgccaaaaaaaaaaaaattaaattaaatgaatgcaagtccattctcagtatgaaacacatactgaaataactgcctgagaaatggtacgtggtagataaatgtgcagcagatgtgctaattggcctgggtatagaaatttagctatttggtctgggtatacaattttaggttgaggaccattgcactcagagtttagatatggtggtttgttttagtgtccactattcatgataagaagtctcagtctcatccttaataggattgacctgtatttttattttactttcattttcttggcattttcacaatgttctccttagccttggtgtttttaaattccaggaatatattgtcaggaaaaggactgctgattttctttctttctttctctctctcccctcctctcctctcccctcccctcccctcccctcccttcctctctctctttctttcttttttctttttctttctcttttgttgcatactctctgggctttttaaatctaaagactgactttctgctgttgagaacatttcctgtttaatttctttgaaaacttttcttctctctattttttttttctattctcttattctgaaactcatgttggtgaaccttctgaatcactcctgtaggcttctagctttctgaaattttccatttgtccctttattctactttctgagagatttcctcaatgatgttttccaaaccttctgttatttcgttttcatttcagcaaatcatatttttaacttctaataactatttcttatccttggagtgatcttttctatagcatttgattcttggtttatagatgtatccctctccccctgatcttttgaaagaatactaattggtgcagtcagaatttttatgtctgcctgtctgttccttgaacttctattccatgaaatgtctggtatttctggggttcttcccattccaccccataacttttcagttttctcttttgtggtgaaggtgtttttcaaatatctggtaatggtttatatctatatgtataaaaatgaggaatgtcggttgagctgtacccacttgccgactcgtctgaatttgtcaagcttatgctataggttgggaattccacttctgtgtgatggtaattatttttttcttgggctttttgtttcctttagaatagatcctatcatctgattttgcccctggtgatgggtatatttggcctctgagaattctgcagaatttcagtgacttctccagtttctcttattggctgatggttttctcctgcctctttgttggcttggggttcacacttgccttccttagcacactttttagtctgttctccttttatctcagaaagaaggaaagagaaactaggagctccacatccaccatctttgcttggaagattcctggtttacacttttaattacgtgattgaattgatgaaaatggatggaccttgaaaacatcatgctgatggaaagaagtcagacacaaaaggccatatgatgcttaattccatttacatgaaatatgcagaacaggcaaatccacagagataaaaagtgattggtggttgtcacaagctagggaagggagaaaggggagatactccttaatgagtgcagggtctctttttggggtgatgaaatgtcccaggattagatagaggtggtggatgtgcaacattgtgatgaattgtgttctttacaatggcgaattttatgtcatgtgaaatttactgtgataaataaaaaggaaatatgaaattattccattttcaaaaggctacatagtgtttgattccatttataggaaatatccaaaataggaatgtagagacagaaagcggactcatggttgccagaatggggagtgactgcgtaatgggtacagggcctccttttggagtggtgagaatgtcctcggattgcctggagttagtggttgcacaacattgcgcatggactaaatgcgagtcacttgtgcactttaaaatggtttgttttatgttatgttaatttcccgttaattttttgagagtttgcatggaaaggtgaagctctaagcaggtcgtatgtttaggtgtggggatacccattatgctgcttagaaatatgttcacacttagggctcagcactgggggttctacttggtaattctttctgcttccacactctttcaagatatgggtcagagaaaccctggtgaggacggggtaggggattggatctctggctctgttttgggcattgtgtgattttcgaggtctgtgggtgaagctcacacagtacctttaccttggccagctctgggctttgcagatgccagtcccgaatgcctgcttcctctcccaactctgtcctctgcttagagacaaaagaagccttacagacagctgaatgggtccatgacagctacgcctgttcttgggaagtaattttgatcagagctcaggcctttggaaatgtctaaagaagtagtaatcaccattattatcattttaaagctagtaactaagaaaactatagatagattatagataatggtagagataatttataatctatagactgtaggtagataggtagatgattgaaagattgatagatataaataagtagatacatagaggacatatatatgataggtagatggtaggtatagatagatggatggctaatagaaagatgataggtagagagatgatggagatagatggatgatagatgatagatatatagatgatagataaatagatatagatgatatatgataaatagatgatagagatacatggattagatagctagatagataatagagatacatgatagtaagatagataataaataatagatgtgaagaggattggtagatgataggtggatagatggatggatagatgataggtagatggatagatagatgatggatggatggatagatagatatatgatagatagatgaatagatgatatagatagatagatagaaggatggatagatagatgataaagatagatcgattatagtaagatagataatagatgtacagagaattggtagatgatggatggatggatgaatagatggatagatagatgatagatggatggatgtatagatgatagatagggatagatagacaatggatggatggatatatgacagatagatggatagatggatggatggatagatagagatagatgatagtaagatagataataaataatagatgtgcagagaattggtagatcataggtagatggatggatgaatggatggatagatagatgatagataggtagatggataatatagatattatccaatgatagatagatgatggatggatggatagatagatgatagataaatagatgaatggatggatggacggatggatggatggatggatgatgggtagatggatagatatggactgatgaaaggtatcttttgttctacagaattaagttgtaaagtttgctgtctgtaattctcactcccaatggagatgtcaggaattctcgttctttcttcgttcaagggtggggaggaggagtctacaggagcagctgtaacaggcacattttggaatttaccccattggaatgtaaaggtcaaggaggcagccctgtaccacacgtctgggacgcttgtgtttgttatatttagtgcgaattgtgggttggctttgcttggagtgctgcttccgggaaaggcgctgtggtcgcctacatgctgagcattttaatttccatagacagtacactgggctgcacactgcatgggacttctcggcattgctggctgccctcctgactgttgtctttctcctggcaacaggggcttgggtgcccaagaatcaagtggtttaaaagtcattaccaaagttcacatcagtcttgtgcacagagaattaaaactgctgtaaattatatctgctgtgagagctccttcctctcatactgaggcattaggaaattgaatccattctacctaatgaaacaatgtacttttccttatgttgtctctaccgcctcatacatccctgagttgaacttgaagtctttgtaagaaatggtctgtccagaatttaaataacatgtttggctgcttctttatggagcacgattcttttctttcctttctttcttttttcttttttctttttttcagagacagggactcactctgttgcccaggctggagttcagtagtgtgatcatggctctttgcagccttgacctcctgtgctcaagcgatccgcctgcctcagcctctcaagtagctaggactacgggcatgcaccacctcgcctggctaatttttttttttttccagtacagatgaggtcttgctgtgtttcccaggctggtttcaaactcctgggctcaaatgatcccccttcttcgaccctagcactgggattacaggcatgagccactgcacctagcccaaagcacagttcttttgagtgagttgggttacatctttgctgtaactcaggtcatcaagccatcacttccactttttgccttttgttttcacctaagatctaaacactttgggtgagttttcaagagtcaaacacaacataaaataagggatagtagctatgagtttccatggcattgcagcatcaggaaatgggcatagcagttgggttgactttgtcccttgtttaaggttccttcatactcctcctgtgttttgttttgtttagaatgaaaggaagcatgtatgcgaattagaatactgaatattcactgcaagtcgtgattttttttttttttttgagacagggtctcactctgtcatccaggctggagtacagtggtgcaatcacggctcactgcagcctcaaactcccaggctcaagtatcctcccacctcagcctctccgagtagctgtaactgcaggcctgccaccacgcccagctaatttttgtatttttcgtagagacagagtttcaccatggtgcccaggctggtctcgaactcctgaggtcaagcaattcacccacctcagcctcccaaagtgctggaatgacaggtgtgaaccatcacgtctggcccaagccatgaatcttgggagaggagaggaggtgactatggccccgtcacccctgctgtccctcaggagtgtaactctggtgtttctgttgattttcacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcaggtaaggctcagagatgcggcttgtgcccagctgggtcctatagaaggagggtcacctctcccctaagaggtcctaggagttattctgacgactgactgcccttcttcataggcctggatggccggcagtcatgatgggcatctgacgtttgtaaggaaccttcgaatcatgtgaaaatataggcgtgtgatcggcttcacaatactttaaaaaacaatactgggtttggttacagttcattctcccaaccatggaaactgaaaattcaattcttttttgtttgtttgttttttgagacagggtctcgctctgtcgcccaggctggagtacagtggtaccatcttggctcaccgcaacctctccctcccaggctcaagcgatcttccctcctcagccttctaagtagctgggaccacaagtatgtgcccccatgctcggctatttttatttttatgttttgtatttttggtagagacagggtttcgccacgttgcctaggctgatcttgaactcctggactcactcagtccacccaggttggcctcccaaagtgctgggattacaggcatgaaccatggcacccagccaaggagtcttttcttataatttccttttataattctctttgtctttaattctcaaataaagcaaatacataaataaatgcgtctaatgaataaagcataaggcttctcttaaatgtcatacattatgtaagcaataatctttttctttcatcaaccatggaccacttaaaaaaattgattttatacgaatgggacgaggaggcatttaatatggtagatgtagcaggaattgaatgtcatattctttgacaatgaaataataaatccagacattaatagctaaactaaaaagagaacaaataaaaaaccaaccagtgtgtcctcagacgtttgaaactggaagttttaaatgaaataactcaatccgggtacaaatgaaagcttgaattatgtactatttcagaaaatcactgcaatgtgagtgctacctatacaaagcaaagacagcaactacagtggtacaagacagaaaatttaaatcagtgaagaaattatccagttcaaatatatatgtatatacacacacgtatgcatatatatgtgtatatgcacgcgtgtgcgtatatatgtgtatacgcacacgcatgcgtatatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgtatgtgtatatgtacacgtatgcatatatatatacatgtatgtgtatatatttatatatacgtatgtgtatatgtacatgtatgtgtatatatttatatgtacaggtatgcgtatatacacatgtatgtgtttatatttatatacatgtatgtatacctgtatgtatatatgttcaactatatatttttatatacatgtatgtatatatttatatatacatgtattatatatgttcaaatatatttatatacacatgtgtatgtatatttatatacacatgtgtatgtatatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatacacatgtgtatatatacacatgtgtatgtacatatatttatatacgcatgtgtatttacatacatttatatacgcatgtgtatgtacatacatttatatatgcatgtgtatgtacatacatttatttatgcatgtgtatgtacatatatttatgcatgtgtacgtatatttatttatgcatgtgtatgtatatatatgcatgtgtatgtatatatatacatgtgtatgtgtatatatatgttcaaatgtatatgtatatacatataaaatatatatatttgaactggatttcactgatttaaatttaaaatatatatacacacatatttgaactggataatttcaaatatatatatttcatatatatatttgacttggataatttcttcactgatttaaatttaaaaaaatatatacatatatgtatatatatacatatatatacacacacacatatatatacacatatatatatatatatatatttttttttttttttttttttttttttttgagacagagtctcactctgtcgtccaagctggagtgccatggcgcgatcttggctcagtgcaacctccatctcctgggttccagtgattctcctgcctcagccttccaagtagctgggattacaggcatccaacatcacgcccggctaatttttgtatttttagtaaagacaaggtttcaccactttgcccaggctggtctcgaacgcctgacctcaagtgatctgcccgcctccgcctcccaaagtgccaaagtgctgggattacaggtgtgactcaccgtgcccagccccaaatatttttaaaataataatattaaaaaagcaaacagcagtaaaaaattcataaagataaaatgacaaaactaataattgggaacaagaaacaaattcaaggattaggttaacaaatcttcagggaggccaaggtgggaggattgcatgaggccaggagtttgacaagacaggctgggtgacatagcaagaccctatctctacaaaaaataaaaagagttagccaggtgtggtggtgcgcacctatagtcccagctagtcaggaggctgagatgggaggattgtttgagcccagaggttcgaggctgtagtgagttatgatcacaccactgcactccagactgggcaacagagtgagctcctctctctaaaaataaaaataacaaataaaaatgaatcttttattcgagaaaacataaatgtacaaaattgaaattagaaagaagtcatttggaggcagttttaaaagcaaatagtatatagaaccctttacagtagtgacactgggagtattgaagaagtgcttgatccttctagggaaatcggtgagatgttggttgttgtcatcagaagaaatagaaaccttttgtttgacaataactatgagaaaaactgaaaatgttaccaaaggcttatcttgtagaaaggccctggtttgggcaattttaagggaagttctgttaaattgctcatgatgaattaatttccctgctgcataaactgtcacagagcctagcaaaagatgaatatgttcacttattttaagaaactgttataatcttgacacccaaacttgatttacaggtttgattgtgtttacatttggattgagaaagccctcaaatacaggatgttaataaggcaactctagccctgtagtaaagaaataaatagtgcttacactaagaaagcaaagataggttattattttaaaacctattaatatcattcaacacattaatatgttagagaaagtcaatgataagatccttttaaaataaaaactaaacatataacaaaaagaattccaggccggccacggtggctcatgcctgtaatcccaacactttgggaggctgaagcaggtggatcacttgaggtcaggagttcgagaccagcctggccaacatggtgaaccctgtctctactaaaagtacaaaaaaaaaaaaaaaaaaaaattagctgggtgtggtggcaggcacctgtaatcccagctactcggtgaggctgaggcaggagaatcacttgagctcgggaggttaaggttgcaatgagccgagatggcaccactgtgctccagcctgggtgacagagcaggactctgtcaaaataaataaataaataaataaataaataaataaataaataaataaaaatccacatagattataaatatagaggtaaacatttaaaacatagagaaatcttagaagaaagtagatgaaagtttctcagcactgctgctatctgggactggagggttccatgtggtggggtgtcctgtgtactgcagggtgttgagcagcgtccctgggctccgcccaccagatgccggcaggagttggcagttgtgacaactaaaaatatctccacatgttgatgaaggtggatgttttgttcatctgaaagctggaaatgctggtgtaaattaaacaagatggaagaggacaccagaactgctgtgtgtcagagatattatgtgttaaagataaaacaaactgagggccacatttaaaatattataatggagaggttcttattgtccatcacgtacaaagaactctgaaaacactttaggggtttgcacgggctcgtctctagcacgccagaagcaaagatagacagacaaatacaaaaataggtattaaacacgagcaactggctgggtgtggtacctcacgcctgtaatcccagcactttgggagactgaggtggacggatcacttgaggtcaggagttcgagaccagcctgaccaacatggtgaaaccccgtctttactaaaaatacaaaaaacattaaccaggcgtggtggcgcctgtaattccagctactcgggaggctgaggcaggagaatcgcttgaacctgggaggcagaggttgcagtgagcccagatcgcgccacctgcactccagcctggtgacagagcgagactctgtcaaaaaagaagggaaaaaaaaaaaacctgactatattaaggtccaaaaatgcaccagtgagtggaaaggtacacatagcacatccagcaggttccgtgttttattttaaaagccggcgggggcgacggggtagaaaaatgctgttaaagagtgtaattgagttgcttgtaacacaaaggataaatgcttgaggggatggatactgcattttccatcatgtgattattacttattcctgcctgtgtcaaagtagacttaaggttcactcaagaggaactttaaaatattcagaaacaacatggcagaaatcgtgggaaggttcagtgttgcaagtcgggttgaggttttgtgggaccttttattatatgtttcgtagtcatggggagaattgagggatggcgctctgcggtggtcagggcagtggaagacgagcagtgagcaatgaccgtaaatgaccaggggtgtgggtggtgggagatcgcccctcccccaggctgtgtggtacaagcgtgttatggagtgatcttgcagggaaacctgctttaaactaattgtattcatgaaacataattctgcttccaggagtttattttagggaaatgagcagagctgaacaaaaagatgtaaggacataaatggcagtgccatttgtagtgaggtggagtgctgtttctcttgccctccccccagcccggatctttacgcaactgtggtgaagatgccataaattccataaataactgggccaaaagcagagggagatttgctgaaggaagggtactttttcagagaaatagttaccttaaatacagagcagtgaaatcttacaaataaatgtcgagtccaagagaaatgctaagagatagaaaaggtccgagagcttcaatatctgtcaaataggagagaaagaaaaagaaagaaagaaagaagtaactcctattatatttcagctctgagacaaagtttagattgaaagtgttccagatattgagcagagtggatgaagaaagctcaaatgtagacaccaagtggtaaaatttcagagcagcaaaaatgaagaaaaatcctaaatgcctttctgtatcaatctggttgtgacaattgatgtctcaaaattctggtgcaagataactttgaaatgaaagttctgtattcagctttagtaccgtaatttgaaagcaaaacaaagacttttcaaatttgcaaacgttaaaaatgttatccctcaaagatctttgaggaaaaagttagttgattgactcctgcaaaatggaatgtaatccaagaaaggcgagagtagccaagcacagtggctcatgcctgtaaccacagcattttgggaggctgaagtgggaggatcgcttgagttcaggagttcaagaccagcctggacaacatagtggggtctcatctctactaaaaaatttttaaaaattgctgagtgcagtggcacatgcctgtagtcccagttactcaggaggctgaggcgggaggatcactggagcctaggacattgaagctgcagtgagctatgattacaccactgcactccagcctgggtgacagagcaagaccctgtctcaaaataataataataatgataatgataatgataataataaatagaagagagcacacaggaagcagtgctgaataaataaatgtataaaacagagttaagtctgaatgtgttagtgcacagttacgaaaataatctggaattaacatttcacatgggaggtaattgaaagagcagagaagaaagaatgagcatatgttcatgtttttgtttcgtctgggaagaagacataggtaatgactatatttgatagaaaatataagcttaaatacgtgtgctgacagttgaaaggtggttaccaccagaaaactagaaaagatgtgtacaagtttcagagccttaatgggaaatgcgtggattgaagaaaacctgattcatgcaatcagaggtgggtgggaaagaattacactgatgtcaggcctctgagcccaagctaagccgtcatatcccctgtgacctgcatgtacacatccagatggccggttcctgccttaactgatgacattccaccacaaaagaagtgaaaatggcctgttcctgccttaactaatgacattatcttgtgaaattccttctcctggctcatcctggctcaaaagctcccctactgagcacctttcgacccccactcctgcccaccagagaacaacccccctttgactgtaattttccttgacctacccaaatcttataaaacggccccacccctatctcccttcgctgactctcttttcggactcagcccacctgcacctaggtgaaataaacagccttgttgctcacacaaagcctgtttggtggtctcttcacacggacgggagtgaaaactgaagaaatagaaaatctgatatatgtaaaaaagggaaaataatataaaatgaaactgcaggactcaatccaaatataaccgtgatcataataaacatgaatagattaaaattcctttttaaaaagataggctttctgaatgggaaaataaacataaaatccggacatacagtagtgtaggaggcagcttaattaaaaacaaacaaaatgttgaaaataaatggatgcatttgatatgattctgttccactatccaatctaagtaatggtcaattgttttatagattgttcttcagttgtttgttgttgttgttgttgttttgagacagagcctcgctctgtcgcccaggccggagtgcagtggcacgatctcagctcattgcaacctctgcctcccaggttcaagcaattctcatgcctcagcctccagagtagctgggattagtttcccgccaccgcacccggctagtttttgtatttttagtagagacggggtttcaccttgttggccaggctggtctcgaactcctgatgtcaggtgatccacctgcctaggcctcccaaggtgctggaattacaggcatgagcccctgtgcccagccttcagtttggttttgtccagtgttttctcatgattagactgaggttatgcatttttggcaaaaaaatcatcagaattgatgtaagttttcagtgtgtcatgctatggagtgcatgatgtctgtatgtcctgacctggtgatgttaaatttcatcacctggattaagtggtgtctgttggaattctccactgtgaaattattatgtttttcttttagtaatggaaaatatcttggcatagacattatacaaacagcctgtttcttctctaaaaatcagtgagtcttgtctgcaacagttgttactatagtgtttgcctaatcgtggttttctacttccctcattccttctatttcaattacttggaattatcttctaaattaaacctgccctttctttctcacatatttgtttattcaatagttatattaggtcaggcgtggtggctcatgcctgtaatcccagcactttgtgagactgaggcaggcagattgcttgagcccagaagtttgagacaagcttcataaacattgtgaaaccccatttctaccaaaaaatacaaaaaattagccgggcatggtggcatgcacttgtagtcccagttacttgggaggctgaggcaggcggaccacttgagcccaggagttcgaggctgcaatgagctatgattgcaccactgaactctagcctgggtgacagagtgagaccctgtatcaaaaagaaaacttatattagtgtaggctcatgaatatttatttcatattttgggcttgttgttttttgttattgattacattatttcagctttggcaattgggtgcttcccctagctggccccctgtattctttcaatatgcccccatccttttctagcacttgcttaatttttctgtcatcccaatatgttccagactatgatgaagtgggatttaagcaaaaataaataaataaatggaacagagcaaatttcactttgataaaatggacagtctttcaagcttcgagtctcaaacttgtatgcaactaacaatgtaagctttgaatacagaaagtaaaaattgatagagattgttatggacatctgttagtttctaccagctcagcatttacatttctctgcctctgcagcttacagagggaaactgtcttcctaagagctggcccaagtgcatgcatcttaagacagttctgttcaatttgtcacatttttcaagtatgcatgcatttctttttcataatattaatatttattactatatatgaatactagattgaaagcccaagcattcagtttacacacagaaattatgcaattatatatcgcttcacaaaggcagtgaacacattacattctacaaaatctacttcacagaaatttaaaaattctaaatatcaaaaggtacagctgaagaaacaggtataaatttggcagccagtaattttgacagggaagttgcagcttgcatgactttatttttttgtttgttttttgagacagagtcccactctgtcgcccaggctggagggcagtggtgccatctcggctcactgcaacctctgcctcctgggttcaagtgattctcctgcctcagcctcttgagtagcaggaattacaggcgcccaccagcacgcctggctaatttaaattttttgtttgtttgtttttgtttttttgcttgtttgttttgagatagagtctcgctctgttgcccaggttggagtgcagtggtgcgatctcaggtcagtgcaatctccgcctcccgggttcaagcgattctcctgcttcggcctcctgagtagctgggactacaggcgccaccacacctggctaatttttgtatttttagtagagaaggggtttcaccatgctggccaggctgatcttgaactcctgacctcaagtgatccggctgcctcggcctcccaaagtgctgggattgcaggcataagccaccgcgccaggccttgcatgactttaaatatatgaatatgaaaatattgaacttagagtaatcattgtgctttgtgttgattgaaaaatataacaatggctatcaaagaagcatgttcaaagatgcttaattcacttcaaaatgtcatacaaattgtggtggtttctatgcacctctaaagcttccgtcatttagctcaggtacattactaaagtaatatattaattctaccggtacagtggggtttcacaccattggcatttgcattcaagcatgcagaggcttttgggcacaagtggacggtgtgcacagctctaagccatccgtggaaatgtgctctgaacatggagaccgcagtgagggctgtggggattctctttgcattccacgtttgtgagcagcaaaacagcaccctcttgaaggaggaggtggttctgtgctgaatattcacccgctgtcccactatttggcacatgtctgttccagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgagtgaagactctctgcttgataggaaaccctccaagaccacatctctatccttaagcaggctgtcaacttttttttgtgtgtgtgtgacacagtcgctctgtcacccaagctggagtgcaatggcacgatctcggctcactgcaacctccgcctcctgagttcaagtgattctcccacctcagcctcccgagtggctgctattacaggcacccgccttcatgcccggttaatttttgtatttctgtacagactgggtttcgccatgctggccgggctgtcacctcttactggtagattcctgtgaggccatgtgcatttctatttctaacacagatgttcagtctattataatcaggcataacatacccccgagcactgtgctagaccctgctgaagagaacaggggattggaagacatgttcctaccccaggaatgaattataaccacagtattttacacgcacaaaatagaatcatgagggaaaaaacttgtgactgggcacagtggctcatgcctgtaatctcagcactttgggagcttgagatgggtggatcacttgaggccaggagtttgagaccagcctggccaacacggtgaaaccgtttttactaaaaatacaaaaattagccaggcatggtaacaggtgcctgtaatcccagctactcaagaggctgaggtggggggatcgcttgaacccgggaggcggaggccgcagtgagccgagactgaagcactgcactccagcctgggcgacagagcaagactctgtctcaaaaacagaagcattggtaaaagaagcattgcggcgggttctgcgtgttttgcttcaccaggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggtaagtcagggcagcccggacgcttagggtctctgttgcacacactcaactctgcagatgtaacacgaagtcagccgttgaccatacagtcacacctcgctcagcgacagggatgcggtctgagaaatgtgttgttaagtgattttgtcattgtatgaacgtcccagagtgtatctgcacacacctggatgatgtagcctactgtatacctaggctggagggtacagcctattccttctaggctacaaacccatatagcatgggagtgcactgaatgttgtaggcaactgtaacataatgggaggtatctgtgttctaaacatacctaaacatcacaaaggtccagtgaaaatacagtataaaatcttatgggaccaccgtcagatgtatggtctgtctttgaccgaagcacttttatgtgttgcatgactgtacttggcattgaacatgggctggccgtggtggctcatgcctgtaatcccagcactttgggaggccagggcggacagattgcttgaggcgaggagttcaagaccggggtgggcagatggcttgagaccaggagttcaagaccagcctaggcaacgtggcaagaccccatctctacaaaaaatacaaaaataagctggatgtgatgctggcacctgtagtccccaagccctgggaggctgagttgggagcagcagctgagctcaggagctcaagcctacagtgagctatgattgcaccactgcactccagtcaggttgacagagtgagaccctgtctcagagaaaaagaaaagagcatggctgtgttccaataaaactttatttataaaaacatgcacagtgtgtagttgcttgacccatggtagaatatagggagaattaaaaggaggcaacctgaagccgagtatttgttgaaatgggcgtcagtagagaggaaatgtgctggaatttttgtaaagtaaaagaaaatactggagcagtgaagaattgcctctaggtaaaggggaagttaatgaaactggcaaaaatgatgggaaaagcattgtcactaccagggagaattcattaggggaccagtggaatgctttggactccatatgcaattttagcattcattctggggactcctggtggagaattttggagggaatatgcacttatttttatcaatggcttgggttatcagtcttttctgagaaccaagagaatgtgtgcagctggcagacagaagaaatggaattagtaaccctgaaggcaagtgtttatgttgagagcttcaggcacatctcgcattcttggagtgaaccaagccatactttgctaacctgcttttgtgtttgctcattatgtaggggcagaccaaggcttactgaatagtttcttcaggaactggtcgaccacagacatccacaagcacctgccgttcatctataacttgagtagtaacacgatgtacacttacagccctgccttcaagcagtaagttctccaccctggcgaatcctgccagatctgccactaccgatccaccttccctcctggaagacataccagctgtcggcatatttaaaaactctatctatctatctatcatctatctatctatgtatctatctatctatctatctatctatctatctatcatctatctatcatctatctatctatcacctctatctaggtagatctaaatatctatttatctgtatagatagatacctatgtctatgtgtctgtgtatctagatctctatgtctatctatatagatatatatctgtctatatagttatctacctatataggcctagacatctgtttatctatctatctatctatctatctatctatctatctatctatctatccatatctatctatttagatctggatatctatctgtatacatagatctatatatctatatctatatatgtatctatatctagatctagatatctatatacattgatctatctaatctctatatctatgtagatatttatctatctatctagacctagatgtctatctatctagacctagatatctatctatctagacctagatatctgtctatctgtctaatctatcatctatcatatgtatctattcagatagatctggatatctatctataaacatcttatctatctatctatctagatctacatcactatatagatacctatatctatctatctagaactagatatctatgtatctagatatccatctagatttagatcttcatccatatagatatctatatctatctatctagatccagatatctatctatatacatagatctatatatctatatctgtatatctatctagatctatctagatatctatgtatatacatggatctatatatctctctatgtatctagatctagatctctctctatatagatctatgtatctagatctagatctctatataggcatctatccatctatgtagatctagacatctatctatatattaatacatagatgtatctatctatatacgtctttatatatgtatatacacacacagaaacacacacacacatctcgtttcctgcttgcttgttgctgtaaatgatagctagccaaggctctacgacaatgatccccaaagtgtggcccaaggaaccctgaccccacaactctttcaagtgtcttcaaagtcataactactttaaaaaaagaatttgaagatgtgatttttttccctttttgctgccattttctcatgcatctatgctgagagtttacagacactacatggcatgtgataaggtaataccctgaacacagatggagctaggaagaaccagctgtcgcctcttgggaaaatggatggcactcttctcacaatgattttttttaatatagaaatttttttaatgaaaaattatgaaatttatgttactgcataatggtttgattttttttaaagggattgataaatatgctttctaatttctcagttttaatatcgattattctaaatatggagagagagaatccacagggacatggccgagcacagtggctcacgcctgtcattccagccctttgggggccgaggtgggcggatcacttgagctcaggagtttgagaccagcctgcgcaacatgatgaaaccctgtctctacgaaaaaataaaacaaaacattagccgaatgtggtgtcgcacaccgctagtctcagctactcgggaggctgcggagggaggctcacttgaacctgggaagtggagtttgcagtgagccgagatcgtgccactgcactccagcctgggtaacagagcaagcctcagctcaggagaaaaaaaaaagaaagaatccacacggacaaagctctttgggttcctaaaagggtcaagggtgaggggaccagaggctgtgaaattcactgctccagaagatatggctataaatgaaaatagagaatctgagaatcaccttgggaatgaataattctagagtctgcattctctacagaggacacggtgtccctaaggaagagaaattgattcttgggagtgaaatcttgttattttttactgtataatcacagatgtaatgtacagaacatagatatgtcatgtgacttttgtgttcatatttcatgaggaggtgatccacgaaaaaaaagtttaaaaaggctcctggaggatggtgatgatgaacaacaaaaaagttggcaaggggaacatttagaatcctgtaaaagagaaaaaaagccaattgccttgccgcttgcattagccactgtaaaagctatttttttttgcccctgtcgttttaaggatatgatgatttgggctgctgtacttcacgtttttacaaaactgatttatttttcccgttttgggaaaaaatgtcaatggattacgattatgttttttgatatatagaaaataaaataactgcaaaaactgtgatttaaaaaatatatctttatgcaaaataactgcaaatgaaactactactactatgctgatagcagtggagtagtattattgatgatatattgattactatcttgatagtagtggtatgctagtattgctcagatattgattactgcattgatagtactagtatattattattgattatatattgattactatagtagtgatagtattttgttattattgatcacacattgattactgaattgatagtagtagtatgttactattggttatatattgattactatgctagtagtagtatattgttgactatatattgattactacattgatagtggtagattattattgattatatattgagtactatgttgataatagtagcatagtattgattacataacgattactacattgatagtaatatattgttattgatcatatattgattacatgcattgatagtagtagtgtattattattgattatatattgatgactatgttgatagtagtaatcttattatgggtcatatattgattactgcattggaagtagtagtgtattattattgattatatattggttactatgctgatagtagtagtatcatcagtaataataatcaataatggaaacccattgggacaagtccttcagaggctgtctttgaggagccccatggtaggtggatgctttctgggtgtcttttatcacatctgagtggaaatcagaatcccttctgtttccttctcagattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacagtaagtgggggattcccttaaaacccgtagctgaggacgaggagaacatccttgtcaccaaggtctggcgtggtttttttttgaaatgccccttttttgtctaaatactgtatttcatggaaaagaatactgagaagcaagcacctgttaaaaaaatttttaagttttagctcaaaatagagaatgcctaatgactggagatcctgttttgatgtgtaggcctggtgcagaaataggttattgaaattagccatcctcatcagagtaagagacactcatggacaagtggttcacaatgactgattacgacgtcattcgggtcaacactttccacttgaaaccatcatttgagatagcagttggaggaagtgtctgaagaggattttgtaaagttttgattgacaccaatttgattgcaaagaatataatgacagcccctcggtgtgctaaatggtggagtatctgcagtgtgctgaatgtaggctgcatctgccttgcagaagacctcttgcaattaggactcaggaaacttcttattcctaatggcttttttcactaaagtaaaaaaaaacttgagcttttttttttttttttttttaactagagcatttgtactagagtaccagagtattttttaactagagtaaagaaaactagagttttgtttgtttgtttgttttttgagacagagtctcactctgttacccaggctggagtgcagtgacatgatctcggctcactgcaacctccgccttctgggttcaagcaattctcctgcctcagcctcccaaggagctgggattacaggtgcctaccaccacgcccagctaatttttgtgcttttagtggagacggggttttgccacgttggccaggctggtcttgaagctctgacctcaagtcatccacccgcctcagcctcccaaagtgctgggattacaggcgtgagccaccaagcccggcctttttttttttttaactagagcatttgctagtacaacagagtctgctatcagcacatgcattgcctgggaaattgaaaagaatccctattttaatttttagtatggttttttatttgggtggatctaggctgctttttaaggactgctgaaaatttctctcaccgagtgacactagcaatggacgtttatttgtattcacttcacaaacattgacttgtcacatatttcctgctgggcgttttgctaagtactggattattaagtactggattactaagtactggattactaagtactggattgcataggagggaattttaaggcttagtgtcaaacggtcctgagaaagaaaacatttaggacaattatttaatgattggcagatgggagctgggagccctggctacacagggccccacccgccccccaggacagcaggtgaattgaggagacatagggaagactcactccacgtgtgtgtttttgtgcagctttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtaagtacctgcattcctcacaggtgtgatagtcagacgctggctcgcagtgagagagcagagagagccggcttccctggctccctggggaggggagatggaggggaagggctggtctttggcttgctgtggcattcaaggctctgcatttatttttgcattacggcacaccgaatcaagctcacctgctgaaagatgtctatgccccaatccctaggacctgtgaatgtcaccttgtgtggcaaaagggcgtttgcagttgtgattaaatgagggaccctgagctggggaggtatggtcttggattctgggagtgggctcttagtcatcacaaacctcccttcaaagaagaaggtggaagtgtgaaggtcagagaaggagtgtgaagctggaagcagaggccagagagagaggggattggaagacgctgggctgctggctttgaagatggaagaggaggccacgagcgagggaatatggtggcctccagaagctggagaaggcaggaaatggattctcccctaggtccccaagaaggaaccaaccctgccgacaacttgattttaatccactggacttctggcccccagaactatcagatggtcagtctgccttggtgtaaaccacccagtttgtggctgtttcttacatagcagcctcaaaaatctgatgccacaaggagacagatgctcagtctctcgcagtttacagattctgggggagccagagctctttcaggttcaaaaagggaggcttccgtcagtgccccctcaacccaactgcctggccgtgcatcctgagaggtttcagccgaacccctgacttgaacagtggttgaagtgaagatgaattcctgccggggttcaatgttcaaatgaatgttgacctgcacagtggtgtctgctgaggccgagtctgcagcactttgtccccatcgaagaaaaatgaaaatacaccttacttgcaaaacaaataatggaggccgtcatttctccagctccaatttctaggtgaatactttggaataatatcttgtgtttaaagatttcctggggccaggcacggtgactcaacacctgtaatcctaacactttggaaggctgaggtgggaggattgcttgagcccaggagtacgagaccagccggcaacacactgagacctcatctctacaaaaaaaagtcaagaaattagccaggcatggatgtgtgcacctgtagtcccagctacttgggaggctgaggcaggaggaatgcttgagccttggaggtcaaggctgtagtgagctataatctcaccactgcactcccgcctgggtgacagagcgagacactgtctcaaagaaaaaaaaaaagaaatcttttttttttttgaggcggagtctctctctgtcacccaggctggaatgcagtagcccaatcttggctcactgcaagctctgcctcccgggttcacgccgttctcctgcctcagcctcccgagtagctgggactgcaggtgcccgccaccgcgcccggctaattttttgtatttttagtagagacggggtttcactgtgtcagccaggatggtctcgaactcctgaccttgtgatccgcctgcttcggcctcccaaagtgctgggattacaggcgtgaaccaccacgcccggcaagatttcttgttttaaatctttaccactgatcctaacaagtttctcaacagaattattttgagatcatacttagggaaggatctggggactgggctgaaggaaagtgattcttttctgtatacttcagatagctccgggagagccgtttcttgttgcttataaacaagtgacctttagattttgcacacattgctctggaagacaccacacgcttcactgtactctggcgtaaattatgctctggcaactttatgcatgaagaatgtcggagtggtgatttcacattgacccaaacacattgaaaagatgtttaggttcagatggtgaagactgaggaggtgtaaaatgcgcttttctggtttttcattcctcatggtgtgccctgagcataccatagcctgggcctggccccaggacgtgcctcatgcgagtcaagtcaagagcctctgcttgttcctgctggaatgtgaagaattccatcagtggagcccttacatgatgtgcaaaacggctgcaattgtgctgagccatgctcgtttcaggatgtctaaggaaaaatcgcatttacattaaatgtttagtaggcaaccaagtttagactgtaaaccaaagagtatccaagaatgctgtggcattcaaggctcatgcttttatgtgcattacagcaccttaaggccaataaaggggaactcccatcccctgttgatgtgtattgaaaataattgaatgctcaaactcctagcctaaaaaagaaatattatcgaatgcttcgaaaacataaatttaggaagtgtattttgccaaggttaaggacacacccgtgacacagcctcaggaggtcctgacgacatgtgcccacggtggtcggggcacagcttgcttttatacaatttagagaggatgaggtatcaatatgcgtaagaagtacattggttcagtccggcaaggcgggacaactcaaagtggggcgggggcttccaggtcataagtagatagaggcaaatggttgcatttttttttttttttagtttctgattggtctttccaaaggaggcaatcagatatgcatttatctcagtgagcagaggggggactgaatagaatgggaggcagaggccctaagcagctccgctcccagctggacttttccctgcttactgatattggggttccaagatttactttcttcacaagactctattgagtcctcagaaaacggttttcaaaccatctttctgatttccggttgcgtaattttaatcttattccgtcactgaatcttgtacattagtggttttgcaaactatggcctgaggtctctctgaataaggatcattttaaaggattgtgtttttgcagatgatcttagaagcattcttctttttctttctttttttttttttgagatggagtctcactcgatcgcccaggctgaagtgcaatggcgcgatctcagcagctcactgcaacctccaccgcccgagtccaagcaattctcctgcctcagcctcctgagtaggtggacaggcatgagccaccacacctggctaatttttgtatttttagtaaagaccgggtttcaccatgttggccaggctgttcttgaactcctggcttcaagtgatccacctgcctcagcctcccaaagttctgggattacaagtgtgagccaccatgcctggctattaaaaacattcttaacagtttattctgaaccacagtgagcactccctcattcgtaagggcagccaccctctttcagaagcaagtgtgtattctccacccttcagcccctggagggatttccacggattgtcacagcccctgaaaacaagcttcccagggcaaacagtggttttccagagactccaaaagggaaaacagtcaggacgctccagtcccagctccagcccaagttgtagccacaccaatctctgcaaaaacagaaccatttccagagtgacagcacttagcactctggtttctctaaaacagcgcccgtcatgttcaattcatattaatctcgatggaattgttgccgtggatttttcttgacataagtcacttctacttttactttggattcataattgtcgatgaggtggcaacttaaacaatagatatgtagcttcgtgtttgtccgtccgtgagccacctttcaatcagagccagtcaagccaaacctaggagagactttcccgtggagggattggggcttctgaggaaagctcatggagagaatcgtgatgacagaattgaggatcatcctgccttgatgcccaaggaggtaagcaaggacacaaaagcacgctcatttcaccccagttaggtggtgtctattatcaaaaagacaaaaaatatccactgctggtgaagatgtggagaaaggggaactcttttccactgttgatggggattaaaaataagcacagccaggatggagaagagtatgaaggttcctcaaaaaactacaaatagaactaccacatgatccagccatcaccactgggcatttatccgaaggagaggaaattagtatattgaagggacatctgccccccgtccatgtttttgcagtttattcacaacaggcaagatacagattcaacccaagtgtttgccaaaggatgaatgggtaaagaaaatgccatgtatagatataccatggaatactattcaaccataaaaaagaaggaaatccatcatttgcagcaacatggatggaaatagaggacattatggtaggtgaaataagccagaaacagaaagttaaacaccacatgttctcactcatctgtgggagctaaagaaatttaacctcacagaagtgaaaagtaaggccaggcacagtggctcactcctgtaatccctgcactttgggaggctgaggcaggatgattgcttgagatcaggagtttgagaccagcctgagcaacatagcaaaaccctgtctctgcaaaaaaatacaaaaattagctgggtgtgcggtacttgccggtggtcccagctactcgcaaggctgaggtgggaggatcgcttgaacctgggaggtcgaggctgcggtgagccgagatcacgctgctgcactccagcctgggcagcagaacaagaccctgtctcagtagaagagagtgtactagagactaggaaaggtgggggaaggagaagatagggagagatttgttaaaggatacaaaattacagctagacaagaggaatatgttgtcatgttctatagccctgtaggatgactatagccaacagtaatctatagtttcaaatagctggacggaggatattgtatgttcccaaaagaaagaaatggtacatatttgacatgagggatatgctaattaccctgaccggatcactgaatattgtaggtattgaaccatccctgtgtaccccatgaatatgtacaattattatgtgtcaatttttaaaaagtaaattttttttttttaaaaaaaagtatgttcaacagccagcagccacgagaaggtcatcagctggtttcatccacagcaagagattgctggctccaaatccccaccccatcctcaaggggcaatattgcagaaaggaggagggtgggaaaaaaatctcaagaattggagaatcgccggtttccagggcccagaacaagacccaggaggagatgaagatcacccttgcaggtagaagctgtccctgtctgggtagtgctggggacagtaggtggcccttctgctgtctgtctgagcatgagctcaaggccaagggtaagatgaggggaaatgacccccagctgggctgagcgtactttgtttagggtatttaagcagttctcaaaagtgattgcagaacctgtatctcccatctcagggactctgcccagcctcacccctccctccaccccactgtcatgcccacgcttaggcttcaaaacatcaatggaagatgatagtgcagtgcccaactgcaggcccttacatgaataaactgtacatcacagagggggcggcaagggaggggaaaacagacagatccagctcagatggaatttgatctgaaggaaagtgataaagtgaagaagggatctgtcagccctgcaagcggccccaggcacagcgtgaaggggaggcagggagaggtcatgctggcctcagacttggacgctgaaatgtttagttacagccggaggggggacgcctgcataggtcctagggaaaggaggggacacccaggcattggagacccactgtgtagacgactgcgagacatgcttaaatatttagcagaaaggaagagaaattcgaatagagagattcaggaatgggaggaagggatggaggtgaaatcaaagctgtttaaatacagatgctcttcgatttacaattggtttacatcccaacaaacccatcgtaaactgaaatatcttaagtcaaaaatgcatttagaccaggtgcagtggctcacgtctgtaatcccaacactttgggaggccaagtgttggcagatcacttgagctcaggagttcaagaccagcctggccaacacggtgaaaccctgtctctactaaaaatacaaaagttagccaggcttggtggcgtgcgcctgtaatcccagctactcgggaggccgaagcaggaaaatggcttgaacctgggaggcggaggttgcagtgagctgagatcacaccactgcactccagcctgggtgacagagcaaaactcagtcccaaaaaaagaaaaagaaatagaaatataagcataaacttaaataactggggagcgttatgttggctgactgcaacacagatacgaaaaaccctgacagaataaaaagaattctaaccaaaaaggtattttgggccgggcacggtggctcacacctgtaatcctagcatgttggtaggctgaggcaggcagttcacttgagctcaggagtttgagaccagcctggccaacacggtgaaaccctgtctctgctagaaatacaaaaattagccggaaatcgcttgaacccgggaggtggaggttgcagtgagctgagatcgtgccagtgcattccagcctgggcaacagagtgagactccgtctcaaaaaaaaaaaaaaaaaaaaaggtattttggagttcctgtgtccacataatttcatccttcgatctcaccccctattctccccacctctccatcctaaggtcggtgaatactgcgtcggggaaattgacctaaaaaaatttgttatggtctatatattctctgatgagggtatttttctaaaagcaatgaagtcttcaggcttttaaaaggaagggattggggggcgaggggagggagagcatcaggacaaatagctaatgcatgcggggcttaaaagctaggtgacgggttgataggtgcagcgaaccaccatggcacacgtatacccgtgtaacaaacctgcacatcctgcacacgtatcccagaatttaaagtaaaagcaaaacaaaacaaaactctttttaacaaaaggtatgttgattgattggagattattatattacggtcacattttccaagataatatttgataacactgaacaaggagttgaaaatttgagctgttttgtatactagttatgtgactttggataaatcaataaatatttctgaacatcttaaaaaaaaaaaaaagagggatgctgtccatacggtatctgatatatagctcaccctccgcatctatgggttccatatctgtggattcaaccaaccttggatcgaaaatattggggaaacaaaattgcatctgcactcaacatgcacagacttttttctcttgttattattccctaaacaatacgacatagcaggtatcaacatagcatgtgcattgtaataggtatggtaattaacctagagatgatttaaagtctatgggaggatgtgcattgcttatatgcaaagacagttccatcttgtatcagagacttgagcatccgtggattttggtataaccaggaggtcctggaaccaatcctccatggatatcaggagaaattccatttcattaattcgtactcccggtggtctttgaaatgagtcgtgcaacatcactgtcacctgctgtccatttagtgagttactctgggttttttatttaggggagctgaaacacagatttttaaaaaaagtttattttcataaatcgcaataatgtcataaaagctgagtgtgcgtctggggctctttagtccagtagctactttggtatatataatgatggcaaggttgacgtgttttggttttgttgttgttgttgtttttgagacagggtctcgctctgttgcccaggctggagtgcagtggcacaatctcggctcactgcagccttgacctcctggactcaagtgatcctcccacctcctcccaggtagctgggactacaggaggtgccaccacacctggctgatattttgtattttttgtagagatgggtttcaccatgtttcccaggctactcttgaattcctgggctctagcgatctgctcatcttggcctcccaaagtgttgaaattacaggcgtgggccaccgtgcctgccccagatctgtgttttttaaagtaaagctgaatattaattttttccacatacattaatgtattaaggaaaaagttgcaattagtatcttctccagcgttttgtcttctagtatttggggtagggaaatgtagttaattaaaagattacagatgtccttcagtttttttttttttaagctatcaagtttttttactctttttgtagtgcatcttattttattcataatacacctttttgttgaagtatgtcttacttttttatttatttatttatttttttgagacagagacttgctctgtcgtccaggctagagtgcactggtgcgatctcggctcactgaagcctccgcctcctgggttcaagcgattctcctgcctcagcctcccaactagctgggactacaggcatccgccactacacctggctaattttttgtatttatagtagagccgggttttcagcatgttggccaggctggtctcgaactcctgacctcaggtgatccacctgcctgagcctcccaaagtgctggcattacaggcatgagccaccacgcccggcctctactaacattagtagaaccgttgactgtgtcccatatatctatgacacagttatctgcattttctgtcaatctttctccccatacttcagtctactgacctattttctagttaactgatctctttggctatgtctaatctgttgttaaacccacattctagcttcagttattatgtttttagttcaaattaacatcagatttttagttcaaataacatcaatgtagtttcaatactaccttgaaaatttttatctttttccccatcttatttaaagtatttctcacatttaattatagtccatgtctgataaattacatatctgggtttcaggtgggtttggttttgttgtttaattttgcttgctcttgattttcactcatttggtcttttcttgttgtatgatagttaattttttaattgacagccagacatggtaaatgaaaaagaattgcaaagacaatttgtagctctgaatcatattatcataacccaaagaggatttttttttttaattcatgtgatttgatgtgatttgtccataccctgaggtagtttgcccagaccctatctggggctgagctggagggaaattgggcttcagtgtttgtgatgaccagtctatttctggttctcctctcagtgaggtcacaaaagaaagcttgtggtgtgtaccagggtccctcattggtcctgattattaatatttatggacccctcagcctcctagcactgctggcaactctactcagtttctcagcttcccagcctcttatttgccctgagtggaagtaaggtaccaaatgtgacatttacctcttctgtttgtctctggtatcttcactcttaattttgtgctgccttagtagctctctgatgcacttaaaaaaaaaaaaaattctaggccaggtgtggtggctcacacgtgtaatgccagcactttgtgaggccaaggcaggcagatcacctgaggtcaggagtttgagaccagcctggccaacatggtgagacccccatctctactaaaaatacaaaaactagctaggcatggtggcacgtgcctgtaatcccagctactcgggaggctgagacaggagaatcacttgaacctgggagggagatgttgcagtgagccgagatggtgccactgcactccagcctgggcaacagaacgagactccgtctcaaataaataaataaataaataaataaataaataaataaataaataaaattctatatacattatttgtgcagcctttttaggtatttttggcagaagacttagtgtgaaacaacagcttcaccatttgctgaaagtggaaaaaatctcatttcagttcctgagctgatacatatatatttgtatttttagcattcaccacctccagcagtaataactttcacaaatttatagcccataatgcaaaggagtgcttccttttttgctgtaaatgttatctccttggattgtgtactggaacattctgtgtctgctgtctatctgttccctgcctcgtctgcctttacgatgtcctctctcagctttcatcttcccacacagagcattttgttttaagcatctctgcatatctcagcctctttccaatgacctgagaattcttctctggcctgcctccagtttcagagtcccttctttcaaggtgaccccatcttcagtcaggcttttaggggatacatcagtagaatagttattacctaaggataaaaagaaatgcagtttgtaaaagtcacattttatattcatgcattcacaagcttgccaaaaatgttcttaagagcggactttgagattgctgcattctcatcttaaaatttctctctgcatgatatgcaagggggaagtgtctactttttactagtaaaaataatggccatatttattcataaaagttggtttatgtttcggctgttaatattacttgttaagtaagcctctgggtcttgattagaaacattagcaagggctgactgaacttctcttcctcgtttaaattcgtaagattaacacatctgcagaaggcaagctgagaacttgcatcattatttcatcctctgtaatcaaacatataaccccgagttaaatcccttccgaggaaggattatacttcatgatcggccccgtggaacttatttatgtgtttatcgttgggagaaattagatgacagaaacagattgacattttccctaatccatttccaggaatggttttttgagcacttattctttgcctgtctggctgcttcatttatccatcacaataagtgtctgtgtgacatctcactgaaagccccatgactcagagagtcatttctgcaggtccttttccttgatgggtcagtattcaaatccaggacatccctctaccagccctggttgaagaaggaaattattcatttttatgggattcatatggtttatgataatgcagttattgcattcgtcattttttcccaagactcattttggtgttttgcaaggcgcatacccaaatcccgctctctcacttgctagttctcgtatgttgggcagtatctctgtctgcagattaaactttgcagcagtaagagggaaggctcaacctgtctgcctcatagggctgtcgcgattaaaaggaatcagggctgagaagtttatgagtgtcactcagcagccagccatgagcagccactaaaaaaggagtcctgttatcatggttgtctgatatctttgacaacttataattttgtgttacaccataattcttagaacttaattttatatttggattttacatacatagctgagatctgaaagaagaagcccatattttatttaatgttaatttttaaaaatttctctccagctgtattgaggtaccactgacaaataaaaattggtgtgtatttaaggagtacaatttgatgctttgctgtatgtatacattgtgaaacaatcattgtatcaaggtaattaacattttcatcacctcgcataaatgctgttttctcctcctcctcctcctcttcctcctctttctcctcctcctcctcctgctgctgttcttggtaatgagaacacataagatctactctcatagcaaattttaagtacacaatcctatattgttaactgtggtcaccatgctgtatgttagatccccagaacttatttatcttgtgtaactaaaacttcatattcattccttcaccaacatgtcttcattctaagcaccccgcccccagcccctggcaactactgttccactctattcttctgtgagttatttaaagtgcactttcggaggctgggcatggtgactcacctgtaattccagtactttgggaggctgaggcaggcagatcacttgaggtcaggagttcaagaccagcctggccaagatggtgaaaccccatctctacgaaaaaatacacaaaaaaaattagctgggtttggtgatgcatgcctgtaatcccagctactcaagaggctgagataggagaatcacttgaacccaggaggcagaaggttcagtgagccaagatcatgccactgcactccagcctgggtgactctgtctcaaaaataaaataaaataaataaataaataaaatcaattgcactttcgtgattatgagttagaatagtcaaattaaaaaaaaggttcatgattacagtgttctcttttacatcttaaagtttcagtaaatctcactaataatgacttttgggggtgttcagtttttatagataccttttttctatttctttctgtgctcctgttcctctgccttagggcattgcacatgctgatctgctttcacgtgcatttttcagcatgttcttcttcttacttcatttccagtcgttctacatcattggcttctactcagccttcaggcttcattttagatattacttccctaggagtgtctccccctttagaccaggtgaggtctcttgataacattttctttcctagaattgataaccattttctttcctagaattgataaccattttctttcctagaatttctcatggcttgccattttgtatttgttatttgttgattttctgtcttctttgacagtaagcttcatgaaggtgcagatcatatctgtgtaggccactgtttaatcttcactacctacctctccataaacacctgtgaaatgcatacattcatgcctcgattaggagaatgaactggacattctcctaaaagggaatgctaggatcagaaatttgggagctgagtatccgagtgactgatctccaccccagctgacatcactcaaaatctctgggatcatggcctgcgggtctgcatttgaaggattacaattctctgaagttggcctggtgcaggcaagaggggctcatgttgaggctcaaccccatccacccccaagaattccacagtgtgttttcagtgaggatgtcagtgttctcttatctctgttgctcacactcattaagctaactgctttgtgacctgacctgatgggggccccagtgtttggacacaggtttgcttcttgaccctgtatttgtcaaggtaggctagctgctataacaaacagcccccaaataagtaaaagtttatttctcatttgtatcacagccagctggggtggccaaggtatcctctaccccatgcagcctttcagggatccaggatgctcctattgttgtgcaccaccttctagggcagctcttctcaagtgagactccttgggaggattaggcgctgttgctgacggcagccactgtacgtaatgcattaagtaatctcctccccatctagcatggtgttagatatggaccatccttgggagagttgagaaaagagtcacctgatttgttctctgtttggttttattttcttatggaggcccagttcagagagggtggagggatcttgtttttcacctggctggtggtagaagagaggataggaatatcttattcctctcgttgcccagcccagaggtgactcacatcacctcctcacattcactcacatcacctcctcacattcactcaatctgcttgtgggaatcacttccatggtcctgtccaggtgcaaggaggtcacaaaatgcacttagacattagcccgagaagaagaagaaacaaacacaggtattggtgagcatatcaccttgccccagtcctatcccatatcaagttgtatttgcaccatagaggcagaaaaaaatggagtgggtattttcaattaagttgcatttatttgcacgaaggtttgacttaacttgcctttgctctttctttataacagatgatagcttgtcctgaaactgagactcctgccgtgataacgtgtgacccactgtcccagccttcccctcagcctgcagacttcacagagactgaaaccatcttggtattcctcatctatatgacctacacatggccagctctcttattgcttgttattttctcacagggtctatccccattacataccagtgggggcgccataggcttttaaaaattcctcccttttttttttttttttttttttttttttgagtggtttctcccacctggaataagttgtgttataattagtctatttctctattatccaggtggataaggaatctggctgtctgttcgaacttattgtggggttttctttttcgtcattttgttattctcttccactttgcttaaaaaaattaataagaaaaagatacagcgtctatatagcatctatgtctccattaatttttttaaacttttgataggacttgcaccatgtctaaaatcaatattccatgactatggattttattttaattctttttttctctaagtttacccttatgaatctgggcttttattgccacatatcatcagaaaactggctttatggacacccccctgtttttaaactctcaaagagactatcttagtaaaatgcttctgtaggcatttggtataaacaagtcaaatctctctctgaaaatttaacttccatgaattgcataagaacttgtagcatctcctcttgtctgagacttggtggatggctcagaaaaagtgaggggagagaagctgagctatttttagcattcccagaaaagaagatcgagtacagtccatcagtttttttaaaaaagttaattatagtgccggccgcggtggctcacgcctgtaatcccagcactttgggaggccgaggcgggcggatcatgaggtcaggagatcgagaccatcctggctaacacggtgaaacccccgtctctactaaaaatacaaaaaattagctgggcgtggtggtgggcgcctgtagtcccagctactccggaggctgaggcaggagaatggcgtgaacccgggaggtggagcttgcagtgagccgagatcacgtcactgcactccagcctgggcgacagagtgagactccgtctcaaaaaaaaagttataataaagatgaggtcttgctattttgccgaggctggtctcgaactcctgggctcaggcaatcctcctgccttggcctcctaaaatgctgggattacaggcatgagccaccgcgcctggcctcaacccaataatttgattttattttaccccaggataaagagttctccatcatttaggttagggctacagttccctgcagcccaccgcagactaatgatggaatggttatgttttagcagccagcaaataaagtcgaaagtgtctcatccgaggaaaccttcgaaccaagccaggaactccctgctgaggctctcagggaccccagtctgcaggatgcactggaggtggtatccaaattcttccccttgcccaaggctcccggtgggggccatccaccgtcactgaggtcaactgcatgcacacaacagctgttaatttttcagcctcatttaacaaaaaataagaatcggcttccctcttcccctgcctctgattcttctgtcttctctctggcatttgcctggggtgatcggccgactctcttttgccatcttcaagtctgatcatcacgctttttctctctttaaaagctgttctgcagaagggatcaggagggaagttgagggactgtggaaattaatgcgtagcaatccattttctgaaatgaagagattaaaagctgaaaattggagggagtggggcatgctaatgttcgaatccaaatggggcatgcaaataatttcttctttcaggatgaaatgagagatgcatgctttctgttccttcctcttagagatgttttcatcttcaactacgttctctccattgatgcatttaatgaaagcaattgctaacgttttctcttgctctttaagcatgatctaataatgccatttggtctttaagtaacaatcaatacagctctagagctaggtttaggtctagactgaaagttggtattgaacgcatgtttagagtgtgacctactgtgttggctaaatgccttccctggacagtcacccttggagaaaatgtgaacttgtttttctcattcttacttggttactgttcaaatgcagcattttgaacttaatttctagagctgttggttgaggtccaggtttcttataaacatgtgaatgtatcccttcagcatgttccatccttgtggtcatcatttgaggctctgtgaattgaatctgtagttattagtgagtgacagggcatcagtgtgaggttgggtaagacctacgttggacagctcagccatgtggtaggtttgggatcctggatgagttcattactttttctttttaaaaattattattattattattattatttagggacagggtcttgctgtgtagcccaggctggagtgcagtggcatgatcatagctaagcagtcttcctgcctcagccttccaaggaaatggaactacaggcatgggccactgcaaccagctaattttttatttttattttttgtggagttggggtttcactatgctgtccaggctggtctcgaacacctggcctcaagtgatcctccttttttggcctctcgaaatgctgggattacaggcatgagccaccgcgcccagcctgagttcattactttgcttcagtgttcatgaggtggagactgggttgcccacctcacagaattggaaggaggggtattaaaaaggagagtggtatagggaaagccctagttagtgcttggctcataaagatgaggaagatttcggtcattgatttgctaaaccggggcactttgacctcctgtgtgtccacactgtcctctaggggaactttatttagtatcttgtataataccctaattcataacattggagcagcttgttgttttcttggatactcatctcttgttagcagaaatgtcacaatcactgtgctgttttgtcttgaaaactagtataaggttgggtgctgtaggtcctgttaattccagaaacatttcattctcaggaactgaatggatctaaatgcaagtgctcttagaggggagaaatgctgcagtatcctgaagtggactttttaatttatttgttaactcttgctatcaccttaatcaataggatggctgtctttaaataaaatataatatatgggaatgagtgtagaaggcagaatcttatatgtaaaaaccttctaaaaacactgcggcaagtaattagagaagaaagtagtatatgcctatggtgtaaaaactcaaatttatctttctatatatctatctctatacatatcatgtatctatctatctacctcttatctattttctttttttttttttttttgatggagtctcactctgtcacccagtctggagtgcagtggcgtgatctcggctcactgcaacctccgcctcccgggttcaagtgattctcctgactcagcctcccgggtagctgggactacagtcacccacgaccaagcccggctaatttttgtatttttagtagagatggggtttcaccatgttggccgggctggtctcgaactcccgacctcaagtgatccacctgcctcggcctcccaaagtgggattacaggcataaaccaccacacccggctatctatctattttctatcatctatctcatctatatatccattcatcctcacatctagataatagatacatagatatagaagagataaaacataggtagtagatagagatgatagataaatgaatgatagagtgatagatgatagataggtagataggtagagagatattttagataaatagataaatgatagagtatagaacggatggatggatggatggataaatggatagatagattgatagaaagtagataggtaggtagagatcatagatagataaataggtagatagatgatggagtgatagatgacagatgatttattgataaatagaatggatggacagatggatggatggatggatggatgagtggatagatagaacataggtagatagatgagatagatgatagataatagatggttggtagatgagatagatgataaatagatgatagatagatagatagaaagatgtgtgtgtgtctattattgttaccatctttaaatttttaagagtctttttctagttcttggtaagaagtgtttaaagcaaatgtatttgttctttttgttgactcatctgaatgccaaacaaaatgtgtgtgtgtgtgtgtgtgtgtgtgttgttacacacttgcattttcatctgttttttcacatgacccttaagaaggcaggaactctgccattgaaaaaactatctgaattattatttaaattcctttgccaagcagtccaaattcttataggctttacttacaggaggtgagttgttttttcatttaacgtagtttggttattcactgtcatacaaaacagaagttttggtgggtgagagtattaaattagtgtgtgtgtgtgtgtgtgtgtgtgcacatgcgcatgtgtgcatgtgtgtgtttaaaatggtttagtggctagaaatgaaaacaattcttcagaaaaagagaacatatacaattacattttataaaatttcaaaacacttaagcaaaaaaaattatcttctaagcatattatactaaatctagtgtatatttagctcaaaagaaaagtgctgctgggtgtggaggctcacacctgcaatcccagctcactgggaggccaaggcaagaggattgcttgagcccgggaattcaagaccacactgggcaacataatgagaccccatctgtgcaaaaaatacaaaaatcagctgggcatggtgatgtgccctgtagtcccagctactgaggaggcagatgtgggaggatctcttgagcccaggaggtcaaggctgcagtgagctgtgactgcaccactgcactccagcctggacgacagagaccctgtctcattaaaaacaaagtgctagtgattcgcaatctctttttgagaactgagatgcatctttctgcgggaccctacactggatgggttttagcagtctttccctcgataatggacagctgcaaaaaccatctcccactgactgtcttccctaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatggttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgaggctcgtaggatatttcaggtgagtcagggttggatggtcatcggctttcagaaggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacagccatgtggcctccttccagtgtgtgtttgcctatttcctgcgatatcaggcttatattttatattaaaccaagggtagggcctttctattttattttcggccttttctattgtattttgtttttaaaatagtaagcatcgggctgggcgtggtggctcactcctgtaatgccagcactttgggaggctgaaacaggtggatcacgtgaggccaggagttcaagaccagcctgggcaacatggtgaggccccgtctctaccaaaaacacaaaaatattagccgggcatggtggcacacgtctgcaatcccagctactggggaggctgaggcacaagagttgcttgagctggggaggcagaggttgcagagagctgagatcacaccaccatactccagccagggcgacagagtgaggatctgtctcaaaaaaataaataaataaaatataataataataataataagcattatttgagctggaattgcaaggtaaaattttaacagtaaacaataaacatactttattttatttttgatttaaaatgttttttaactgtcatgtaataattgtacatatttatggggcatgtagtaaagttgcagtacacgtcatgtctactgatcaggtcacgggaattagcatatccatcatctccaacctgtaccattttttgtgttgggaacattcagtattctccttctatatatatatttgaaactatataatatatgattttgagctgtagtcatcctatagtgctatataccagtgatccccaacctttttggcaccagggaccagtttcatggaagacaatttttccagaaaccaggctggggggatggttttgggatgattcaggtgcatgacacttattgtgcactttatttctgttatgattacattgtaacatgcaatgaaataattatacaactcagcatcatgtagaatcagtgggagccctgagcttgttttcctgcaactggacagtcccatccaggggtgacaggagacagatcatcaggcattcgattctcataaggagcacgcaacctagatcccctcacatgcacagttcacggtaaggtttgcactgctatgggaatcttacgcggccgccgatctgcaggaggcagagctcgggtggtaatgggagcgatggcgagcggctatcaatacagatgaagctttgctcactcgccgctactcacctcctgctgtgcggcccagttcctaataggccatggaccagcactggtctgcagcccaggggttggggacccctgctatagaacactagaactaccttaaaaaaaaaaaacccaaaactggatctcatagaagtaagaactagaacagaggataccagaggtcaggaagggtagggagaaggggtgatggggagagatttgttaaagggtacaaaattacagctagataggaggagtcagttccaacaataaatttaaattatcagatggatttttcagaattgctggtcacagtgaaatgcatagaactgtttacttctaactttttgcgatcttgcaggatctctttaggaaaggtacccattttctgaactttgctttgtcagtttcattcattcattcgtcatatgcttattgagtgctctctttatacccagctgtgtgacatgggacaaatcaatacaccataagtttgggaatatacacttttttccacgagaaatcctcattgtcagaagtatcttcattcaatgggcacaatatgctgtgtatctcactgggtggctgtcaggggccaccgagagtgtcgttaaaaatgggcatgttgattgacgtctcatgtctccctagaatatataaaaccaaactgtgctttggccaccttgggcacatgtcgccaggacctcccgaggccgtgtcgcaggtgtgtgtcctcaaccttggcaaaagaaactttctaaactaactgagacctgtctcagattttcagggttcacaggtacagtgctgagtacgtgggtgggggtacctcactaccatagaaaataccctagtgacaaaccggcacgtgtaccccttagacctaacataaaagttgaaattatttaaaaataaataaataaatattatgagattattatcttgtggcaagtggaaatgatgtgggaaggaaaggatttctagatctgtcgaattggcagggtggattgatgcctacagatccacaggaataagttatagtatttttgttcctcaaagccacttggtcgaatcctgccaaaacctttggctgatgcttggaagcacgaaacaggtcctagtgttaacgcgttttggggtggaactgtagtttgaagcagaaaggggtttctttctgaccaccacccttgaattaggaaaagcagagcaattctttctggtttcataggcctctgctctttagtgtacagtaccattttaaaaattatttatttatgtatctttggccgattacagtgactcacacctgtacctggtactttgggaggccaaggcgggcagatcgcctgaggtcaggagttcaagaccagcctggccaacatggtgaaaccccgtctctaccaagaatacaaaaatttgtcaggcatggttgtgcatgcctgtaatcccagctactcaggaggctgaggcaggagaatcacttgaacccaggaggtggaggttgcagtgagctgagatcacaccactgcactccagcctagacaacagagtgagactctgtctcaaaaaaaaaaaaaaaaagaaagaaaaataaaataattaaatcatctattttaattattttattattttttatttttatttttttgacacggagtctcactcttgtccaagctggagtgcagtggcccgatcaccgcttcctgcagcctccaactccagggctcaggtgatcctcccacctcagcctctcaagtaactgggattacaggcatgtgccaccacacccagctaatttttttaaactttgtagaggcagggtctcataggagtctcactatgtggcccaggctggtctccaactcctggcctcaagcattcctcctgctttggcctcccaaagtactgaggattacaggcatgaaccactgtgcctggcccccattttttttaatagatcaaatgagttgcataggtttacaaacttgatgtcttctatccctgctctatccatcatcctaagaaacaaaatgaagtttttattggcacagacaatatctgttggaagcacattcgtgcaaatccagctatacctagtatgtgacatgtactgtgcaagaatatactttacacgggattgtagcatgccttgaggatgcttgtctggattccattgcatagttgctaaatgctgatgctctgtgagtctgtcattattgcagcattcatggcccaacactcagctgcacaaaagagcttttctgtttctctttccctcc

SEQ ID NO: 509 - DNA, 108953 bp, Homo sapiens
ctaaaaataaaaattgaacatataactcctgaactagtggatgaaaatgaagaatgaagaataaaattaaatacaaaaaaaatgaagagtaaaattaaataccaaaattagccaagtgttgtggtgaatgcctgtagtcccagctactcaggaggctgaggtgggaggatcacttgagccccagaggtggaggttgcagtgagctgagattgcgccactgcacttccgcctgggtggcagagccaggctttgtctcaaaaataaaaaaaaataataaattaaaaacctgaatactaaatggaagttaagaaggaaggaattaaaaaagaagaaaagtaaaataaaatagtaggaatagtgaatccttagttatgttagatgttcagtgatttaataaatctgtaaaaagacggagatgagatgatgcaatttaaaatgtttcggctgggcgcagtggctcacgcctgtaatcccagcactgtaggaagccgaggcgggtggatcacgaggtcaggagatcgagaccatcctggctaacacggtgaaaccccatctctactaaaaatacaaataaaatgtttcatgctatttacgagagaagcatttgcaacaaaatgccaaagagaaggtgaaaatagctggaaaaaaaatgcgcaaagcaaataaccaatagaaagaaagccaagttgggctagcaaaatcagacaaaataaccttcgaggtgcaaacaactttgaggcccaaatagaggttcttcccactaaaagaatgattccctgaatgataatggaatcttgacccagcctgcacctcaggttaagttaaaagtggaaatttaaagatctaagtgtgagattttaaaaagcatttccccagaaataccaggatctgtagatggaaatgttattaagaataaagatgtggagctgggcgtggtggctcacgcctgtaatcccagaactttgggaggctgagactggctgatttcttgagcccaggagtttgagactagcctggacaacatagtgagaccccatctttacaaaaaaattaaaaaaaattagtggacatggtggcatgcacctctagtcccagttactcaggaggctgaggtgggaggatcacctgtgcccaggctgaggctgcagtgagccatgatcacgccactgcactccagcctgcgtgacagagcaagaccctgtctcaaaagaaaagaaaaaaaaagaagaaagaaatgaaaaccgtagctcagagacagagaaactgagcaatgcataggttcagaagggtttgaaacagactgaattgtgtcttggcatatgagagaggtcgcagctataaaacaatgagagaagaaaccaaattccacataggcaggactgagacaattggctgttcttgtggatgatacgtgatcaaatctcaacctcatgcgatacttttttttttttttttgagatggagtctcgctctgtcacccaggctgcagtgcagtggtgtgatctcacctccccgcaaacttctcctcccgggttcaagtaattctcgtgcctcagctgggactacaggcatgtgccaccacgcctggctaatttttgcatttttttagtagagacggggtttcaccaagttggccaggctggtctcgaactcctgacctcaggtgatctgtccacctcggtgtcccaaagtgctgggattacaggtgtgaaccaccacacccagcctcatgtaatacttaaaaatgaactacaggtggattacaaacctgaatataaaagaaaacttttttttttgaaaaatagagggaaatgtcttataacctcagagttaggaggtttttcttagatacaatacaaaaagcataaccacgcccatagtcccagctactcaggaggctgaggcataagaatcacttgagctcgagaggtggaggttgcagtgagccgagatcctgccattgcactccagctgaggctacagagtgagagtataaaaaaaaaaaaaaaaaagcataacctttaaaaatgggttagcctatgtctacatttaaataataataataataataatgttccaacttcaggctctgaaaaaagtcaaaagatgagctgtcaactagaagaggctccttactgctcataccaccagggaaagtttaatatgcaaaatgcagtcatccttcagaattcatgggggattagttttaagacgccttcttccccgcagacaccaaaatccacagctgctgaagtctctgatataaaacgtgcagtacttgcatataatgcaagtatatgttcctgtatatttttatttatttatttggagacagaatctcactctgttgcccaggctggagtgcagtggcgtgatcttggctcactgtaacctccacctcccgggttcaagagattctcctgactcaacctcccaagtagctgggattacaggtatgcgccaccacccccagctaatttttgtatttttggtagagacgggttttaaccatgttgtccaggctggtttcgaactcctgacctcacataatctgcccaccttggcctcccaaagtgctgggattacagggatgagccaccgtgtccagcctctggtatactttaaattatctctaggttactcataactcctgatacgctgtaaatgctatgcaaatagttgttatactatattattttttatttgtattactttttattggattgctatattttattttttgaaatattttcaatacaagactggttggatctatagatgcagaaattctggttatagagcacaaactgtgtatagatagctcctaccaaaacagacggatggtgaaaaaaagaaaagaaaagaaaagaaaaagaaaatggaggagagagactatgaggcgactaaaagaagagggatatgatcattccattcgctgacaagaaaaattcaaagaagagggaattatgcaattgaccagctgatgtgtgttagaaatgctcagggtcacacatattcattgaaagccaatttaagccactatttaaatttaaaccgatttaaacaattgggcttttttttttttttctaaaaaaaaaaaaaagtcaattaggccaggcgaggtggctcacacctgtcatcccggcactttgggaggccgaggtgggtggatcacaaggtcaggagtttgagaccagcctggccaacatggtgaaaccctgtttctactaaaaatacaaaagttagctgggcatggtggtgtgtgcctgaggctgtgagactgaggcaggagaatcacttgaacccaggaggcggaggttgcagggagcggagatcatgccactgcactccagcttgggcgacagaccaagactctgtctcaaaaaaaaaaaagaagaagtatattggttccgtctggaaaggtggagcacttgaagcaaaggcaggaagactggaagcagggagagggttttcaggtcacaaacaggtgagagacaaaacagttgccttcttttgagtttctgattagcctttccaaaggaggcgatcagatacgaatctgcctcagggagcagaggggggactttgaatagaatgggaggcaggttggccctaagcagttcccagctggacttttccctttagcttagtgacttgggggtcccgagatttatgttcccttcacagtgtatgagtgagagcacttggaaactgagagtggaagtgtcgcaggccaggtctcactaacacaggcccccacaacacctgtttcagtattgactgagtggttaaatattaaaagccagtgctgttatacaaaggctggaatgtaacaaaagcccaccgagagtttttcccaggactttcccgggccttaaagcatgacaaaataatgaatgaattcttaacaggacccatttaggattaaacaagttttactgggggtctgcagaaactccccaggcctccacaaacaagtttattggggctttgaaggaactctgcaaacctcctggatttagcaggagacaacatgagggtaatcaccccggcacctggacccattagattaagtcaatttactgaggctcctgaggaagatcctcaggactcagaccttagttatagattaaaagaagttaatcacttatgtctttagataaatgcacacacatatctccacatagcttggaaggtatataagctctggaaaactataattttgagttagtctggtgataatttccaggccttctccctgtaacaggttgcagaaataaaaactctcttcctccccagttcatcggtgtttcattattgggctgtgagaaatagcaacccagttgggtccgggaacagaaggtttggtgttatcttcatcacaggcactggactgtcggtaaatttattccatgacaattcttcctaggtttcttttttatattacttgcttccatcatggcagacagctacactggcttcttgccatgaaaacgaacttctagtaacaaaacggaaacctttttttttaagtttcaggtttcaaggttttacttctatctgcaaagtgatttttaaccagacaatggcaatctataaacacaccgtgggcagcaaatcagaacaaactgcaaggtcgatagtcacgctgatgagcttgtttctgcagcctgctcctaagggaaggacaattttcttttctaacagtgcaatgttgtttcctccacagatatctacccaaagccaaaaccaccttactacccacagcccgagaatcccgacagcggtggaagtaagaatccgcaggcctgaaactctttctcaatctggtttgatgatgtttgcctttttatttactagcaggtttagcctggttgcatttgaaatatgtgtgtaatagctcccttactgggaatgtagtttctttcctcactggggggagcaagaaagtccaacggacagaaacaatcttattttccctttgctttgacatctagaaaccactaaggtgtacttgtaaccacccaactggttcactttgttggctgcctagacagagctgatttatcaagataggggaactgcaatggagaaagagtaattcacgcagagccggctctaagggaggctagagttttattattaatcattcagtctctggaacatctggggatcagggttgttaaggataagttggcaggtaggggcttgggaagtggggagtgctgaccggtcaggttggaaagggaaccatagggggttgaagtgaggttttcttgctgttttctgttcctgggtggatggcggacctggttgagccagattaccgggctgagtggtgtcagctgatccatccagtgcagaggctgcaaaatatctcaagcaccgatcttaggttttacaatagtgatgttacccccaggagaaacttggggaggttcagactcttgcagccagaggctgcacgagccctaaagtgtaatttctaatcttgtagctaattttttggtcctgcaaaggcagactggttcccaggcaagaagggggtctttttgggaaaggggcattcttaattttgtttcagagtgaaaccacgaactgaattcgttcccaaggctagtttggctcacacccaggaaagaacaaggacagcttaaaggttagaagcaagatggagttggttaggtctgacctctttcactgtcatcatttcctcagtcataatttttgcaaaggccgtttgatactcaaaggacactttgcattatcatcacagaaagctaatcaggctgagagacaagtcctttctctcacttgttttcagtgctccaaatacctttggcttaaccattcccaaacccccacgtgtgctgtgcactttatgtgttttagagttggtttctccattttttctaacatttggcagacagtttttttccacagatttattacactcatcattgaaaaatatgcaattcaaaaaagaaagagagtgaacgagagagagaagagtggggaggggggtgggcatggagagagaaagagaaagagaaaagaaaggggaaagaagaaaggaaaagatagattctggccattaaagttatcagcagttcaacaaccttaaaaacttaaatgtttgccaggcagagcagcgtgaagctggctaaatcaagaggggttctggaagcttcctggtagtttgctctggctttaaactttcacagcttaacagcgtgtccattcattgcagacacgcacatccagatggacagaaattatctcctcttacaaggaatcattaaaaacagagaccaagacccaagggaggtgacacccacttgaaaaactacacctcaggccgggcgtgggggctcacgcctggaatcccagcactttgggaggccgaggcgggcagatcacctgaagtcaggagctcgagaccagcctggccaacatggcgaaaccctgtctctaccaaaaatacaaaaattagctgggcatggtggcatgcgcctataatcccagctacttgggaggctaagacacgagaattacttgaatccaggagaggaaggttacagtgagccaagattgtgccactgcactccagccggggaacagaatgagattctgtctcgaaaaaccaaaccaaaccaaaccaaaccaaacaaaacaaaaccccaaaacaccacctcacccttaactgcattagttaagccagctagtctttcttttttccccctctttcatgatgaaaatcccaaataccacccacctttttctcctgctatttcctcctagtcttttaaaaaccattgtcctgcggatcatggctatgttgcaaggcactcatgggaattccacagggaacgtgtttcttgctgaaacatacttgggaaacgcccagttaaacagactgccgtgggcttccctcccagagaattcatcaggacttaaaatgtgtggctgggcatggtgggtcacgtctgtaatcccagtactttggtagaccgaggctggtggatcacctgaggtcaggagttcaaggccagcctggccaacatggtgaaaccccatctctactaaaaatacaaaaattagtcgtggcctgtagtcccagcaactcgagaggctgaggcataagaatcgcttgaacctgggaggcagaggttgtagcaagctgagatggcgccactgcactccaggctgggcaacagagcgagactccgtctcaaaaaaaaaaaaaaaaagaataagaaaaaaaaaacttaaaatgcgagatcctttaagatgggccatcttcagagtgtgaacactcagcccctcccacagcaaagtgattcatgaaccccaataggaggaggagtgggggaagagaggctcaggctggggaggtgaccccccatgactcaagcctcaatctcctgatgcttgtcccaacaaagaggaggcttcctttccgactttggtttttcatgttgtgcttaaatccagccacactgatgcctttaacatggcagtcctgaattattaatcaatactgtgtgaatccaaaatatctgagacaggtctcaatcagtttacaaagtttattttgccaaggttaaggacgtgcccgtgacacagcctcaggaggtcctgatgacaagtgctcaaagttgtcaggacacagcttggttttacacattttagggagacaggagatatcaatcaatatgtataagaagtacattggtttgatctggaaatgcgggacaactggaagcaggggcttccaggtcacaggaagatacgagacaactagttgcattcttctaagtccttgatcggccttttactgaaaactcaatttacatgtgagacagggcaaaggaatagtacttatgcctcagtctggcccagtgaatctgcatttttcatcaacaatagggcagaggaagcaatcagacatgcatttgtctcaggggagcagaggggatgactttctgtcccacacctgtgaagatgagctgttggtgtacattgccagggtgaaattccacagaactgttttagggtaaacaaaacagtttactttcctcagattgtgaggacagtatgtagcttttaaaaaacttaaaaaaatttttttgtagctatcttatttagaaagaaaatgggaggcagatctgactaactttttttttccagcttgacttttcccttggcttaatgattttggggtcccaagatttattttcctttcacaattgaacatcagaacatggagtatttaacacaggaaatgagcaaatttaacgtacacacccaaggaaaaggaaaaatgaagctggttggaagttaattatggatagtgtggtatatgagcagaaattccccttaaccagtgttcttgcccaggctagcccaaatgagcccaggctagcctagattcccaagtgtgtatcttgagaacgaggaagagccctagaaaacaatgtgtaacgtccctccaagatggggtgttctggaacaatccctcagacaacgaaggcaattgttgatgggcaacattgggaagaccccagagatggaatgtcctaggcctttccatgttctctttctcattctccctccattgacttgataggtggctgggggatttataagtatttaccacacaccagccagctttctccggatggctccaggcatgcttggagcccagtggtctctttcccttagaatttgatctggaggaacccaaaattctctctgtgtcctttgaaattcagcacatttttcttggcttccatgagctcctgtggcatttctcaggccaactgttgactctgcttcctatgtctgtgcttgtccctttgagagatgtcagcgttgctcaccgattcttttctctgaccccagcagctcctatccatgttgtctttttttttttttttttcagacagagtctcactgtattgctcaggctggagtgcaatggcacgatggcatgatcttggctcactgcaacctccgcctcctgggttcaagcaattctcctgccttagcctcccgagtaactgggattacaggcgtgcaacaccacacctggctaatttttgtacttttagcagagacagggtttcaccatgttggccaggctggtctcaaactcctgacctcaggtgatctgcccaccttggcctcccaaaatgctgggattacaggtgtgagccactgtgcctgtcctcatgttgtcttgaaagtaacaagacaggcacggattctttttgatgcaagctgttatgggatgaattatgtctccccgcaaattcataggatgaagtcctaacccccagtttcctcagaatgtgactgtctttggagatggggcctttaagaaggagattaatgtaaaatgaggtcactagggtgggtccggatccaataggactagtatcctaataagaagagatgaggacttagacacacacagaggaaagattatatgaagacacagggagaagacggcatctacaagcccaggagagaggccttaggaggaaccagcccagaccatatcttgatctcacactcccagcctccaggactgtgggagaatcaatgtctgttgtttataagccacccagtctatggtgttctgtgacagcaacctgaaatggactaagacacctcataagaaggggagatgaggacgcagacacacacagagggacaatcctgtgaggacacagggagaagatggcatctgcaagcccaggagagaggcctcaggaggaatcagcccagcccacacctggatctcagacttccagcctccaggactgtgggagaatcaatgtctgttgtttataagccacccagtctttggtattctgtgatagcagcctgaaatggactaagacatctcataagaagaggagatgaggacacagacacacacagagggacgaccctgtgaggacacagggagaagatggtgtctacaagccaaggagagaggcctcaggagtaagcccaggaatcaatgcagttggaggttctgtgtgtgaatggaggagggaagctcacagatgaaggcgttttgagggaggactgaccttacagtgaggtacccagagacttcctgaaccaagccacgaatatgcagctcgtgctccgggcagtgccttctggcctggaaaccaaagctcccttgtgtccagtccccactcctctgtttggcccccaagtttccataatcccccacagttgtatcattttagagacctcaaaagagagtctaggctgggcgtggtggctcatgcctgtaatcccagccctttcagaggccgacgtgggtggatcacctgaagtcaggatttcaagaccagcctggccaacatggtgaaaccctgtctctactaaaaatacaaaaattagctgggcatggtggtgtatacctgtaatcccagctacttgggaggctggggccagagaatcgcttgaacccaggaggcggaggttgcagggagccgagattgtgccactgcactccagcctgggcaacaacagcaaaactccttctcaaaaaaaaaaaaaaaaaaagagagtctaggcagggcatggtggtccatgcctgtagtcctagctatactcaggaggctgaggtaggaggatcacttgagcccaggaggtggaggctgcagtgagctatgattcaccactgcactccagcctgggcaacagagcaacaccctgtctcaagagagagagaaagggaaagagagagagactattttgagaagtgaaaaaccagtcattctcagcccagatttccagtgttctgagacgtctgtcctgaggaaggactttgagaacagcatccttgccttttttgtgaattaaagtaatttcactcttgagccaatgtggataagcacttgacaggtactggcagtgccaggtaccaggaatatagaatgggtacagaaaataaagtttctagtccagcgacaaaaaggtgctgaagatacagactcatgtcgtgcaaagagcttgcactgattatttcatttcggcttcttgaatagggtcaaaggacatttaagctgagacaggagggacgagctaattaatgcttttccagatgacaaatggattcttcaaatatttagggagagtgtaaagtgatggacagggaacaggaggggtcatgacagaaggaatgccacctgcaaaagtcctggggcagggctgggcacggtggctcatgcgtgtaatcccaacactttgggaggccaaggtgggcagatcacctgaggtcagaagttcgagaccagcctgggcaacatagtgaaatcccatctctactaaaaatacaaaaattggccaggcgtggtggcacacacctgtaatctcagctactcgggaggctgaggcaggagaattgtttgaacccaggaggcagaggttgccgtgagctgagatcacaccactgcactccagcctgggcgacaaaagcgaaactccgtcttaaaaaaaaaagtcctagggcagaaagctcatggtaaacttgaggaacatgcaaaagtcattgcaaaaagttttaagaaattcaaatgaagccaggctcagtgtggctaatgcctatgatgattccagctctttgggaaggcaagacaggacgattgcttaagaacaggaatttgagaccaacctgggcaacatagcaagaccttgtctctacacaaattttaaaaattagccaactatggtggtatgcacctgtagactgagctacatgggtggctgaggtgggaggattgtttgagcctaggaactcgaggctgcggggagctatgattgcaccactgcactgcagcctgggcaacagagcaagactctgtctcaaaacaacaacaacacaaattcaaatgaaacggtgtaactcaagcaagatggaaatacaacacactatcaaaaggtcagatgtttcatcctaacatttatagaagtgactgacttctgtaaatggtgctggcatctgtagtagccctaaacagggaaaggtcaacaacgcactttctgccctgttaatttcagagagccctggacttcttgcgaaagcaccagtggtgtaagtttttgttttttcattgtaagctctgaggtggtattatgaatattgtctacatgattaataagctccgtaaaagcaatgggcagtaacatcttttctgtactttggcattcttatttatagatggtatctacctgaaagatgtcattatttttctgaaatcatactgttgttttccaacagatatctacccaaggccaaagccacgccctcaaccccagcctggcaattccggcaacagtggaggtaatgagtatttatttatttatttttattttattttattttattttattttactattttatttgattctatgttattttactttattttaccattttatttgattctatgttattttactttattttatttgattctatgttattttactattttattttattatttattttggagacagggtctcgctctgttgccctggccagagtgaagtgatgtaattgcagccttgaactcctgggctcaagcaatcttcctccctcagcctttcaagtagttaggactacagatgtgtaccacctacattgcaccacctatatttcaccacctatattggctatatttcaaattttttgcagagacaggatcttgctgtgttgttcaggctattcttgaactcccggcctcaagcaatcctctgcctcagcctcccaaaatgctgggattacaggcaccagctattgtggcccagcctgataatcagtattaaagtccattttagaagtgtttggggccaggcacagtggctcatgcctgtaatcccagcactttgggaagccgaggtgggcggatcacttgaggtcaggagtttgacaccagcctgagcaatatgatgaaaccctgtctctactaaaaatacaaaaattcgccgggcgtggtggtacatgcctgtaatccagctactcaggaggatgaagcaggagaatcgcttgaacccgcaaagcggaggctgctgtgagttgagatcacgccacagcactccagcctgggagacagagcgagcccctgtctcaaaaggaaaaaaaaaaaaaaaaagaagtgcttcacgcctgtaatcccagcactttgggaggccgaggtctcctcaggcagatcacctgaggtcaggagtttgaaaccagcggccaacatggtgaacccctgtttctactaaaaatacaaaattagctgggcagagtgacgcgtgcctgtaatcccagctactggggaggctgaggcaggagaatcgcttgaacccaggaggcggaggttgccttgagccaagattgtgccaatgcacaatctatctaggtgatagagtgagactctgtctcaaaaaaaggcgggggggtggttggatacaagtattatttaatgacttaaaaattctcatctccatggtgaaagaccaattgcttttgaaatgcacagacattgttttgcgaggagttcagttctactatccaccagcacctggggattacatttagttgatagtaaataaatttaaatgtttttgatgacattgactgaaaaataccatgcacactaagacatttcaagttatgatggaggaaggcaattttttcttgtttttttttttgttggtctgtgttctactcacttattcttccctctgcaagagttatctgcggccactttgcctgtgttcctacagcacttcccatctccgccttggcaattgtgtctcacgaacgtgagacactcaggaaagagatgctggtctgtaaagttggaagagtctcagcgattccattggtggggcaaatgtgtgcagattgaggaagctaagatacactgggtgtcttcctctctccacctgctttaaccattgggagttcccctgattgtgattgtttcaggacgttgcttggatgttgtcatattcctagggttcaaggcactccgtgaaatccaaggaaacaagctttgggtatgtcccagtgccttttcccttgggtcttgcaactgaagaattgtgtttcttccctagaaaaacgaacacacttttgcccactcacccacctcctgcaagtctccaaaaccacagcgttgtatcctagactatgttcccccaggaggtggttcctccctctgcattcccgtactccatactgcttgatatgttcttacatgcaacaccgtgcaattgtgtttagttgattcctgtgaattagaatgagaactctacatgggcatggatttttgcctttcattcactgctgcattccctagtctggaaagctgtgcctggcacacaatgagtcctaggtgaaggtcagtgaagtcattaatgcttgagtcccaacaggcaaacagctggattcatgaatgaaagacttaccgctacatcccttcatcagggtgtatagcttcaactccatttcctggaaagctctacaatagttcttcctcctcaaaaggctctggtcttgtgattcatagcattcgtccaccaagacatgaacaagggatctttatgtcagaggttccctgttcaaagctgttttagaggccaggcgtggtggctcattcaggtaatcccagcactttgggaggccgaagtgggaagaccacttgaggtcaggagttcgagaccagcctggccaacatggtgaaaccccatctccattaaaatacaaaaattagccaggcatggtggcatgtacctgtaatcacaactacttgagaggctgaggcaggagaatcacttgaacctgggaggcggagttcagttggagttgcagtgagccgagatcatgccattgcactccagcctgggtgacagaacgagactccatctcaaaaacagtaaaaataaaaaagctgttttaggaaacatcccttttttattattttttctttgagtcagggacttgcttggttgcctaggctgaaatgcagtggcgggatcacagctcactgcagcctccacctcctgggctcaagcaatcctccgactttagcctcctgaatagctgggactacagacacacagcactccacctggctaattttttcttttttctttttctttttctttctttttctttttctttgtgtgtgtgtgtgtgtgtgtgtgtatgtgtgtgtgttgggacagggtttccctctgttgcccaggctggtcacaaactcctggccttaagtgaccctcctgccttgacctctcaaagtgctgggattacagatgtgagccactgagcccagccctaggaaacagcctcttaagccaagtgcaatgactcttgaactccccagagcctctgtgcatgctacctcgacttcagcttcacagatgtatgcaactgcgggatcaggttaggggcactcacttaccggcagtcccaaagctctggagagtctgtgctgagggaatggtccatgttaaagcaaagcagaacaaccactctgccttttgtattttatacttgttttttttttgaaacagggtctctctgtgtcactcaggctggaatgcagtggtgtgatcatagctaactgcagcctccagttcctgggctcaagtgatcctcctggcagatgggactacaggcgcacaccaccaagcccagataattttttgtatttttttgtagagacagggggtctcactatgttgcccagactggtctccaactcctggcctcaagcaatcctcccgcctccacctcccaaagtgctgggttgcacccggcttgcatttcacacgtttaataaactcaatcagcatgtttcctaccccctagagtgacaatggtgcacattagcatggatttcttatagatcgagaccaaagacctaattacttatctatagaccaatcttggagaggaaaggcagactccaagggttaattcggggtccaggaaccacagaaggaaggtctccttggatctcgtttgagcctgaagtagctcagtctatgacagacaccatcagagggcagaggcacaggtgaacgcagcagtcggaactttgtcagagcagcaaaggacatcttaggaaatgaggcttgcaaagcagccttgggttattgagaaagctctctcagcgtggattctcagggctctgggatcttctctgccttgcaggtgcctctttgttttttgggaggaagcaggtgggtctcatgtgtcagggcagtaaggagcaggaatgaatggatgaaacaaatctgttggggtgggtagcggctgtgctctggggagccaagagagagacagggggatggtgctggtttcagacaagatagttgagcaggaacttgaaagagaaaaggagagtggatcgtggggacctgagaagctggaattctccctggggaatcggccactgccaacgtgagggctggggttaggagcatgcctatggtgatggagaagcctgggggaggtgcctggttgatggggcaagaggagccatctggagagaaggaaaagcctggagtctccttccgggcttgcttaaggactagggaggggcaggacatgagatgatgttggaggattctgagcaggggatgggcctaggtgggaggtggggcagaaggagagctggacgaggacatggtgagaggtgatgttggctcatccaggaaggacggccaggaggaagcagagggaaaggggcatgcaaaggtccagaggcaggagcaacggggaacatccagggaaggagggaagggcaggggatttggagatggggcaccctgagagagggatccaggcagcaggcagacacgacagcctgagcttcaccccagctcacggttggccctgggagggctttgagcagaagaggggcaaacatcagcaatatgaggccacactgcagacgttctgggccctgcacacgcctccttgcaggcaaggcggccagcccacaaggtaatttaattcctggtgcctgtgggcgtcctgcaaagagccagttggcgtcggaacgctcttctccaaaacctgtgccagtgcccccagcgcagacctggtgtgaaggggacctttggagaggtctcatgagcaatgccgcgtgctctgccccacaggttacttcaatgatgtggaccgtgatgacggacgctacccgcccaggcccaggccacggccgcctgcaggtaggtgccgagcctccccagatgcgacacattgaatttgcacagagagggtgggatgagaggcctgaagttggggatgagagagctgaggttggggcagagttggtgacgagcagacgataagctggtgcaggggatgacagagaaggccccatggccgcatcagtggggtttgcggtctgggcatctgtccgcctctccaggctgggggactggatggaaacaaaatgaacaggcagaactggagggtccactgaaacacttgcggtcatttctgtttagacttgtatatgtgtaagtgtgggtgtacatgtccagacacacctttatatatctgcatgcttatcaatcttcatttgtgtgtatatagatgtttatgtatctttatatttgtgtgtatatatgcttttaaatatatataaatgcatctacatatgtaggtatatggtttttttcatgtgtgtatatacatgcttttgtatatatacagtacgtggatacctttctctgtttttatatatgtatatcctgactttatatatatccttatatatatctttacataggtacatgttttatatgtgtatatatatctttatatttatatgcagatatatgctttttatatatatttatgtatatgtatatcgtttaatatatctttttaaaaatatatcttcatgtatatctttaaatacatatacattttatatacattttaatattttatgtgtatgttatataaatatatatctttacatatataattaaatatatgcctttatttatatacatctttatatatgtacatatatacctttacatgtatgtgcctttatttatatatgtatatatttatatatacacttttatatatacatatgtgtatatctttatatgtgtgtataaatgcctttatatacgtacacatatacctttatgtgtatatacttttatatgtgttatgtatgtacacacaactttatatatacatgtgtatatatctttatataggtatataaatgtctttaaatatgtatatacatatcttttgtatttatttatttttttttgagacggagtctcgctctgtcgcccaggctggagagcagtggcacaattttggctcactgcaacctctgcctcccgggttcaagtgatgttctgcctcagcctcctgagtagctgggattacaggcgcctgccagcacgcctggctaacttttgtatttttagtagagacggggtttcaccattttggccaggctggtcctgaactcctgacctcgtgatccacctgcctcagcctctcaaagcgttgggattacaggcgtgagccactgtacctggtctatatgtatatcttctaatgtatctttatatatatctttaatatatctttatatacatgtacattttatatacatttttatattttatgtatgttatataaatatatacatttatacatatataattatatacctttatttatatatctttatatgtacatatatacctatatatgcttttatatatgtatgtgtacatttatatatacacttttatatatgcatatgtatatgtctttatgtgtataaatatcttcataaatatatttatatatctatacataacctttatatatgtataaatatcttatataaatatatattttatgtgtatatatgcattatttgtataaacacatatttgtaaatgtctttccatatatatgcatatatagcttacatatgtttctatactgttatatataggtgtatacctttacatatgtatgcatactgttttatatatgtgtatataggtcccttcatgtatatatgtatatacatttaggtatatgtgtgtgtgtgtgtgtgtgtatatatatatacacctttatatatgtacatttatctttatacacacagacatatataaacacttctaatataaagttttctctgtaattggaggtgaatgtctatcaataatctttcatatagaaatacaagtacagactataggagacagagatgcatacaacattgggctgaagagtgtgatgtttgaggctttattttcaagcatgtgaggtttctggcctgtttagttctgcaattttattttagaagacataaaggacttgtcccagatattttgcaaagctggacctgcatctttcggacaaccagattgcatccagtcatcttttctgccgtgtttacttgcaataaataaagagcgctgtcttaggatttattacaataacaatcaggaataaactaaaaattactagttatttttgaaaggagaagctgagaacatttacgattgagaccatctgctggaaggtcctcctaatccggcgtcggcgtggctgatctcatatcagtttctcggcaggaagcgggtgcgcctgcgtgaatttggagtccccagggtaaatgttagtcccgtgacggcaaagtgtttttgatagctagagctcagtgttggcatgagttttcccacggggaagaggaagctttggtggggccacccttgactctcccctgctggtcactctttggagctctcttggcagtgacacgttcacacgacttgttgccattcccaatgagctggacagaccaacacctgcaggaaaccccacgctcagacacctgaacatccctcaactctaccttctctgtctaacaggaggtggcggcggtggctactccagttatggcaactccgacaacacgcacggtacccctacatctgggcatgcgatggtgggtggagggtgggaggggtcatctttctagggctcccgcttgcactctgccctgggccttctacctggagtctttggtgagtagggtgctgtgtgctggtgcctggtcttctgagaacctgtctgtgctgggctgttctgcttctgttccccaggagggtgggtgcagccacacatacacacacgcatacacacatgcacacacacacacacacacacacccctttaggtaaaagtaaacagagcaaagaactatacaactaattagagaaagagagcatccaacaaactggagagcatccaacaaattctttaggggcgcagctcgcttacttcaagcagaatagaaaacactttcaatggctgggcgcggtggctcatgcctgtaatcccagcactttgggaggctgaggtgggaggattgcttgagcccaggagtttgagaccagcctggacaacatggaaaaaccctgtctctacaaaaaatacatatatgcaaaaattagccaggcgtggtggcatgtgcctgtagttccagctactcaggaggcagaggtaggaggatcacttgagcccaggaggtcgaggcttcagtgagcagacagagataagatcgtgccactgcactccagcttgggtgacagactgagatcctgtctcaaagaaaaagaaaagaaaagaaaagaaaaaaagcaagagaactcttttggtcggtgcttatgcccagagtgaaagccgtgttctacagaagccataaacaggctcttggcttggttgagtttttctcatggagaccaggggaccttgaaaccctcagatcctctccggtttggaaaacgactgaagcaaaatgtcatcactgagaaagaaaacaataacaaaacactctgtaggttgattttaaaccatcatctccgttttaacattttccctttgttaagagttttgtacaccttcaatgaattgagtaaccatcttttcttttttttttttttttttttgagacagagtttcacttgttgcccaggctggagtgcagtggtgtgatctctgctcactgcaaccttggcctcccgggttcaagtgattctcctgcctcagcctcccaagtagctgggattacaagcatgtgccactacacagggctaatttttgtttttttagtagagacagggtttcaccatgttggtcagattggtcttgaactcttgacctcaggtgatccatctgcctcagcctcccaaagtgctgggattacaggcatgagccactacacctggctaatttttgtatttttagtacagatggggtttcaccttgttggtcaggctggtcttgaactcctgacctcaggtgatccgccctcttcagcctcccatagtgctgggattacagacgtgagccaccatgcccggccttgagtaaccatctttttggttaaaactaatatgtgccaagagctctggtaatgtgggaagtacttttttttctttttctttctttttttttttttaagatatggtctcattaggctttgtgagagccaaggctgttggccccctaagttttctctgaatcactgacatgaggcagcttaattaacaggagaaaaagcgtataaatttattgagtggatatacacgcaaaccttcagaaccaagactcaaccaccaatgggatgcaaaagcttatagaccatcttttttaactttgatgttaggttcaggggtccttgtgtagggttgttacataggtaaattgtttgtcaccggggtttggtgtacacattatgtcatcacccaggcaataagcatagtacctgataggtagtttttccatcctcactctactcccaccctctgccctcaagtaggccctggtgtctggtgttcccttctttgtgtccatgttgtcaatcgagaaaaatgacgagacgagcgtaaaagatttatttgccaaagttaaggttaagggcgcgccccaggagacaggtctgtggccttctccgaagatgattttgaaggctgcaaatttaaaggggaaagggtgggggtagggaaaaagagttattcatgcttttgtctggctcagtgaatctgtgtttttttacataagatggcatagacaaatggggcagagggaaaatgcagggaatctgcatgttgcataagataatctggacaaaatggggcaggggagcaatcacatatgatttgtgtctgctgggcgggggtgactgcaaagctgtcgatttgcatattgtcatggtgaaatcttcacagctcactaggattttccttgtgggcaaaatatgggggagacgtgtagcttttcatcttgtagccattttatttaggaaccaaaagggggaggcaggtttgtgtgacccagttcccagcttgacttttccctttgactaaatgagttcaggatcacaaaatttaatttcctttcacaatgcgtactccgtgtttagctcccacttgtaaatgagaacacatggtatttggttttctgttcctgcattagtttgctcaggagaatggccaccagctcgatccatgttgctgcaaaggacatgatcttgttcttttttatggctgtgtatatgggccacattgtatatgggccacatttcccttatccagtctaccattgatgggaacctaggctgattccatgtctttactatttgagtttgctatttgttgttctttgcaggaagaatgtgggctcagagcatggccccaaataggtgacgttggtaaagcaggtttaacgggtggcaagccaggtgatgagagggagacaggaagaggcctgcttagcaagggggtccttgttatgcagatgaaggttcccaggtagcagcgctcagagacgaccatggtaaatgtttcttttcagacctgtaaaggtgtcagagtctccgtttctctctcctacatccaggaaaagcttagaaagggaaggcctggctgcaacagcaaagatcctctacagatgccaatttccccacctcagtctgctggccctggagcggcaatttcaaaataaggcaaagcaatatattttggagtaaaatattttgatgtccgtcatcttcgttacctcggaagcgagtgttgtcatcagatccatttaacaaaatgaaagcaatgcatgacgctcgactgtccacttcaaaggagcaatagctgtggccctataggtagcccatcctcagaactcactccctatgacacagacaagcttcaggatgggagggggctcatgacaaagtgctcattacctggggtcaagaactgtctacttttggccgggcatggtggcccacgcctgtaatcccagcactttaggaggccaaggtgggtggatcccttgagttcaggagttcaagaccagcctgggcaaaatagtgaaaccctgtctctacaagaaaatacaaaaattagctgggcatggaagtgtgcgcctgtggtcccagctactcgggaggtgtaagtgaccctggaagtttgaggctgcagtgaaccgtgatagcaccactaccttccagcctgggccatggagtgagaccctgtctcaaaaaaaaaaaaaaaaaaaaaaaggacactaaaaaagaattgaccaccttcaactcaacgtactatgagatgagttccttccaccatctttctggaactagctaaggggttccccttacctactacctaggtagacctgatttattaagacgggaatcgcaatagagaaagagtttaattcacacagagctgactgaacgggagcatgtgaagcagctatgctgtctggggtacatacctggggttcattgttgcacgctgagaaagaattcaggacacagacacatgtggttgggttaaggagttgaaagtttaatagaagaaaggagagaggagagcagctccttgcaagagagagagggagagagagaaagagagagagagaaagagaagcatctgaaaaagttgggaggttgtggaccgcagcagcttttgtaggcaggctggaggaggtggtgtctgatttacatagggcttacagactggttcgatcaggtatgacttctacatagtgcgtggggaaggctggtggccccaccctaattttgttatgtaaatgggctttccagttggtcagtgccatcttgtctgctacttactgtacatggggctgacaaagaggagggaagatgaagctgccatcttgaacgtgtctaggccctagttcctgccggcattcacccatgtaagctcctagctggcttgtctatgtctgcagctcaactttattttttattttttatttttttttgagacggagtctcgctctgtcgcccaggctggagtgcagtggcgtcatctcggctcactgcaagctccgcctcccgggttcacgccattctcctgcctcagcctcccgagtagctgggactacaggcgcccgccaccacgcctggcaattttttctatttttagtagagacggggtttcaccgtgttagccaggatgatctcgatctcctgacctcgtgatccgcccgcctcggcctcccaaagtgctgggattacaggcgtgagccaccgcgcccggccacagctcaactttacaggctgctctttgttagaaaatgatttggggctgcttttcattaaaaagaaaagccttaccaaggactcccatacccttgctatgtgcctaagtaattaactaattccttcttaactcctatatcaactggaggttttgcttttttttctttaaacagggtttcattttgttacccaggctggactgcagtggtgaaatcatagctcactgcagcctcaacctcttgggctcaagcgatcctcccgcctcagcctcctgtgtagctaggaccacaggtgtatgccaccacacctgcctaatttttaaaaaatttttgtagagatggggtctcactatattgctcaggctggtcttcaactcctggcctcaagtgtttctccgacctcagcctcccaaagagctgggattacgggcatgagccactgcacctagccaagactggagttttatgactcaaatcagcttcccccaaaatttggacactgggctttttaacgtgtaatttggctggtaggagacccgggcgtggggagtgctgagtggttggttggaggtggaatgacagaggacggacatgggttctttttgttgtcttctgttcttgtgtgggacggcagagctcgctgagccgcattaccagtctgggtggcgccggctggtgcatctcaatgaagggtttaaaaaatgtctcaacttcaaccttaggttttacaatagtgatgccatccctaggagcaactgaagaggtttggaatcttgtggcctccggctgcatggctcctaacctattaatataatttctaatcttgtgactaatttgttagtctttcaaaggcagtctgatccccggggaagaagggagtttgtttcagaaaagggctgttatctttgtttgaatgttaagctggaacttcctcctatggttatctgagtctgtgttcaggaatgaactagggctgttcgagggctacaggcacgatgcagtcggttaggtcagatctctttcactgtcgtaattttctcactgttataatttttgcaaaggcggtttcaatttaactgaaaatgtcaggcaaagaccaaatttaatatttttacagaaagccactgggagtagttttttattgttttattatttatttatttagagacagagtctcactctgttgcccaggctggagtgcagtggtgcaatcatagctcactgcagcctcaaactcctgggctcaagcgatcctcccacctcagcctcccgaggagctggggctacaggcacacaccatcatacccagctaaatttttaagaaattttttgtagagatggggtctcaccgttgtaactgcccaatgggtttaccttgccccctgcctaaacagggccgatttatcaagacagaggaattgtaatggagaaagagtaattcatgcagagccagctgtgcccgagaccagagttttattattactcaaatcagtctccccaggcattcagggtccagagtttttaaagataatttggcgggtaggggcttgggaagtggggagggctgattggtcaggttgcagagggaaccataggggggtgaagtgaggttttcttgctgttttctgttcctgggtggatggcggaactggttgagccagattaccgggctggctggtgtcagctgatccatccagtgcagaggctgcaaaatgtctcaaacaccgcgcttacgttttacaatagtgatgttacccccaggagcaatttgcagaggttcagactcttgagccagaggctgcacgacccctaaaccataatttttcttttcttttcttctttttttgtttttttcgagacagagtatcactctgttgcccaggcttgagtgcagtggtgtgatctcggctcactgcatcctctgcctccctggttcaagcaattctcctgcctcagcctccccagtaactgggactacgggcacatgtcaccatgcccggctaattttcatatttttaccagagacggggtttcaccatattgttccggccggtctcgaactcctgacctgaggcgatccaccctcatcggcctcccaaagtgctgggattataggcttgagccactgcgcccagccctaaactataatttttaatcttgtagctaatttgttagtcctacaaagtccaactggtccccaggcaagaaggaggtgttttcaggaaaaggctgtgatcagttttgtttcagagtgaaaccatgaactgaattccttcccaaagttagttgggcctatgcccaggaatgaacaaggacagcttaagggttagaagcaagatagagtcggttaggtctggcctctttcactgtcatcatttcctcagttacaatttttgcaaaggtggtttcgccacgttgcccaggctggtcttgaactgggctcaagcgatcctcctaccttggcctccataagtgctgggattacaggcctgcaccaccacatccggcccaccttggagcgtgttatataaagcgagccgtccccacacccctacagcctacgaatgagccttttcaccccatgcacgattctctgaaactgctctctgtaaggagctattcgggacacgttcttttgttctctggcatactcatcaggtagaaagaagtgattcagcaagcggctcccctgagagccctgatcgtttcctgttttcctgtgaagttagtctcgggaggtctgcgctgtgccatttttgggggaccattatctggctcccgaatggatcaaagcttactggtcagggggctgctgtatccctggggcaaaactgccagaaaatagcaggtagccctgtggtccttggcagggccagggcccggtggaagcagcagctgggccaagaacatcaggcgtgcatgaggcacagcccagttttgggagcatgacgcttgttttcgaggatgcctgtgctccccttcctgcctggacccctgctctccagccccggcagagcgaggctgtgagtcagcgctcggattagcatcagcatggaggtgccggctgggatgcaagccgccgccatgggatgagtcacgcggcttctccccgaatccccaaaggaggcagagcgtgttaggcttgttctggcttcatgcagagcactgaggggtgagggctgaccgtggctggccgcggagggaagcccaaagtctggcctccctgcggagactggggagaaaatgttgcgctcgtcgtttttaaatactgggggacaagtttcccttgtctgctaaggctgccattgtaaattacaagagtcaggagggctgaagcaaaagggatttcttctcccacagtcctggaggctggaagtctgagatcaaggtgtgagcagggctggttcctcctgaagcctctctccttggctcgtcgacatcatcatctccctgtgtcctcacagggtcgtccctctgtgtgtgtctgtgttccaatctcctctccttatgaggtgtcttagtccatttcaggctgctatcacagaatactatagactgggtggcttagaaacagcagacattgattctctcaccgtcctagaggctggaggtccaagatcaaggtgtgagcagggctggttcctcctgaggcctccctccttggcttgtagacaccatcttctccctgtgtcctcacagggtcgtccctctgtgtgtgtctgtgtcctcatctcctcttcttataaggtctgtagtcctattggattagggcccaccctagtgatctcgttttattttaatcacctctctaaggacgttgtgttcaaatacagtcacagtctgatgccctgggggttaggactgcgacctgtgaatttggagggggatatagttcagcccatagaacccactatccacataagtcattccacttcaaaatcagcacaaagcattagttttaaaaatctcaaatctgtatttttaaaaattgctcttaacacattagaaaaatatagaaaaactttttttgctgtttttctgagacaaaatctcactctgtagcccagcctggagtgcagggacgtgatcatagatcattgcagcctccacctcctgggctcaagcaatcttttgcctcagtcgtctcccaagtagtagctgagactacaggtgcacatcaccacacccagctattttttttttttaagtagaaacggggtctcactatgtttctcaggctgggctccaaatgagctcaagtggtcttaccgccttagcctcccaaagtggtaggattacaggtgggagccaccacacccaacctggaggaactctttttttttaaaattttaaataaattactatttgtggcctgcgttttcatcctattctctttttttttaaccaacatttgctggcatttttttttatgccgaagaaaacacctttgcccatctatgtcaggcctccagaccctcagggatgtacatctaatgcaccttcagccaccggtgtaaacagtaaacaggggccagatggcgcctgtgcaccttccctggccttgggagagcattggaatctctgcagcttttaagagcatcttgcttcaggtttgctgacctgcttgcttctgtaagatcatgcagacttcctgagcaatatctagcatttcatggtctcttttctatcctgcaggaagagggggctatagactcaactctcgttatggaaatacttatggtaaaggaattatgtcttacagaatatgtgaggcaaaactgtccatttgcaaataactaacacactgtctgcactgatgggaagctgatgctttcatccagtgcacaaccaactggccgttcgagtctctcatttgcattttccttggtcatccatgctggggggagatgttgtgcatgccctgaggacttcatttcttcaaaggaactatggcccacttacaggtgttactgggtgcatgtgtgtgcacgtgtgtgtgtatacatatgtgttcacacacaggtatgcttgtgtgtattgtgtgtgcatgcatgtgtacatgtgcatgtggattttgtaatcatgtgcataagtgcatgtggatttcatgtgcatgtgtgcaagtgtctgtgcacacatgtggattgagcacatgcatgtttgtgtatgtgcacagatgtgttggcatgtacttgtggattttgcatgtgtgcatgcttgtgcttgggttgcatgtgcattgcatgtttcccatgtgtgtccattcacatgcatacatttaggggtgtgcaagcacatgtgtgcatgtggatagatgcaggagtgtgcatctgggtgtgctcgtgtggtatgtgcatactgcacgaatatatcatgtgcatctgtgcatgtggattgtgtgtatacatgcgtgtgtacaggcatgcacacacacacatgaatgtgtttgtgtgtgcatatttgtgtgtacatgcatgtgtttatgcatacaggtgtaaacatgtgcacacatcggtgtgtgcatgtgcacacatgtgtacatgtgtatgtttaggcgaattgtgctttatatgtgcttttgttgcctgtgtgtgtggtatgtgcatgtgtgtgtatgtggggatgtgtgggatgtgcatgtgtgtggatgtgcacattgcattgtgcttctgtgttgcatttgtatttacatgttgcacatgtgtgtaaatgcatgtgtgtgtgcacgtgtgtatgcgtgcttgtctgcctgtgtgttgcacgtttgttgcatgctgcatgtgtgtatgcatgtgcacacacatttgtgcatgtcagtgtgtgttgcatgtgcttgtgtatgaatggcgtgcgtgtgtgcatgtgtgtccatggggttgtcagcctgtgtgtgttttgcatgcgcatgtatgtagactctccaatcctgaaattaaagctgcatctccctctccctggtattatccccattctgctaatgaccattagacatggcatacacattcacattcctcctccttatgctgcttggctgtccccctccccccacaagaatgtaaattccctgaaaacagggatctgtgtgctgtgttcacagtcgcatcctcaacagtgcccggcaatataaggccctccataagctctgctgaataaacacgaacatccttttccgcttacaggtggagatcaccattcaacgtatggcaatccagaaggtaactgattgactcacccggtcccaacctttaataagagcacactctcctagatcagtgctgggaggagctgtgtgggcttctgtttcccaacctcatgactttcacggagcactcatactttgtatgtatataaagtagctcctgaataaaaatatctgaccttcagcacaggaccaatcagagttcagagaaaggagaggcaagcattggttttcactgcagaagatgccccttagctctcaaagcaaggctgtgaatgagtgctgagactattacatttctcccagtaccaccattactcccctttctttgaccagcactaacttgaaacccaagaaggacaggagaaaggaaggtatgaacactctgcccaaagaagccatcagagtgcactgtcaatcccgtctcaggtcaaaggagggagaacttgaagcccagaaggctgactttgtgtcctgtattgttgggagaacaggttccccattccctaagggtcatattcttagagatttgggctgacacctgcttgagtttaagttgagagtaaacgcactcaaccccaaggctcttgtgagttttcaattatgggggaggagaaagtgattgaaggtgacctctacctttcaatgatcatgcagagtactagtatcaatatttttggggtatgttggcatccttagaaaaatttatggtttcacctttttccctctgtggtgtaaagtgaggtccagagatggaaagggcaaggcaaataaacaagtaattgcagtcaaatctgatgaataatttcctggaacatatgggatcctgtagcaaggcagaagggatactcctagactaggttaggtgagggaggtagggtttcctggagagaacaatatccaagccaatcccccaaaatatgggtgggaggtgcccaggagaagagtgaggtgtcagggaagatggtgcactaggtagagctggatacacacgtggggacaccggaaattgtgtagccaggatgtggaatgcaacgggaaccagggaaggatgcaatggtgaccaggaaagacctccaggttagcagaggtggagtctgcacttcatagaaccttcatgggaaggagcctgcccctgttgatatgtaggtgaagaatggacctgagggggctcactaagacccagggagacaccctttcagaccagttcagtactccctggaaatgatgacaggctgaattaaagcctgggcaaaggaggcaaagagaagcagtcagcttggatgaccacttggtaatgacaattgattgtacttgattgatttgtaagagatgagagagaggaaaaggtatgtatcagtcagctatgctgtgtcacaaaaaaccccaaaacttagtagctggaaataacaaccatttattatgttcgtgattatgtgagtcagcaatttgggctgacaccattctagtggtcctcctggtctcttctgaactccctctcttgtgtgcagtcaactgtaggtgtggccagcgctttgaccatgtttcctgggtcttcttatgtatctgggactttaggtggaatggctcatctcagcttcatgtgggctctcacatccctccaggaagccaggccaggcttcatcacatggtgaccagacagggtaccaagagcatgaagagaagcgtgcctgggcttagagccaccatgccttcacttgtgtgacattctgttggctaaagcctggattttcagaatgaagatgcagctccacctctggatggggaacactgtgaaatcatactgtggagcgtgttcatgtagggaggggaagaatagagggctgtctctcccaggaggcagggtgtggcgggcggcagcatcagccgtagagcaggttcttgcgttcagtgacaacactcttccccccagcatggcagcctcattcgtggagcagtcttgtgtccctcacctatgccatgccatgtattggcccaggtgttcaaccctgtctgaagaaagccatgcatggaaagggtggctatttcaaatggaaacggtgatttcttccttttttccctttggaagtgttgatttttgtcacatcaagctccttcttgttctttgtgcaggagtgccaaagctctggagcaatttgccatcgaggcattgaggatgcttgtgtctagtgtgtgcttgggtctagagttccagcatgcctttgaaagcaagcctatctggcagtttttagtggaacaatatttttgcatgagtgggcattctacatctaaaaaggcacaaaatagttttgacatgtgcctgtcatcccaactactcaggaggcggaggcaggaggatcacttgagcccaggagttcaggacgagcttaggcggcatagtgagaccccatctctaaaaaaataaatcaggccaggcgcggtggctcccctctgtaatcccaacactttgggaggctgaggcgagtggatcacctgaggtcaagagttcgagaccagcctggccaacatggtgaaaccccatctctactaaaaatgcaaaaattagttgggcatggtggcatacacctgtagtcccagctattcgggaggctgaggcaggagaatcgcttgaacccgggagaaggaggttgcagtgaactgagatcacgccactgtattccagactgggcgacagagcaacattccgtctcaaaaaataataagaaataaataaataaataaataaataaaattaattaaaaggcatacatgaattgacttcaacaaacaaacaaaaatgccaagtgcctcgtctgtgcaaatcctggccttggatgtcttcagtggtaaaatgtggttgacaagcttggctctttgtgaaaacagaattacttcctaaggtttttttttctttttttttaaattaagtttctcttttttttctgtgaatacaagggtgggaagggacgtgatggagaagttactagatagatgcaaaagttattgcagtttttgtcattactttcaatggcaaaaaccgcaataacttttggaccaacctaatatttaagcagttttcctgcagccatgtttttttctcggatgagcttgctttttctccactcctgcaggcaatatggtagcaaaaatcgtgtctcccatcgtatccgtggtggtggtgacactgctgggagcagcagccagttatttcaaactaaacaataggagaaattgtttcaggacccatggtaagtttggctctaaacattgttttgcttgttactaagcctgatttaaaaaaaaaaattactttcagatgtctgtcactagcaaggttatttctggttaagttcaatatacataacttgcctaataatgtgattttttaaaatttatttttattctttttgagacagagttacactgtgttgcccaggctggactgcagtggcaggacctcggctcactgcaacctctacctcctgggttcaagagattctcttgcctcagcctcccgaacagctgggactacaggcatgcaccaccacgcctggctaatttttgtatttttagtagagatggggtttcaccatgttggccaggctggtcttgaactcctgacctcaagtgagctgcccgccttggcctcccaaagttctgagattacaggcgtgagccaccgtgcctggccaacaattgggttttcatggtcaggtgtgagctgtaccttcctctaaaccttgttacaatgaggctggcacattatctgtctaatgtaaaagaggaggagaaaaaaaggaaagaaaaagaaacaaacaaacaaaaattaccaacctacattgcaagactataagcatgacggttggtttaactacctgttctgttttgtattcagtgaaattttcgtcacaggcgagtcaggaaaaatacctgggttgaatgtgaatgttttgcccagaaccccacccgcaaagaaaactaccgaaacactgaattataagcctctctgaaattccgaaggtgcgctcagaccataggggagaggaaagatctgctgtggcttcctggttcaatgccggctccacactcctgggtttgaagaatcacttgggatttgagagcagaggatgccctaaagaaatctctgaaacaacagtcagggattgttttatagcctaaagagtgactcagatctttaactgggtgtctctggaggcttggtttaaacctcaggccacccacgtcagaatctgtctggagtttgcccagggccctctaactcataccttctttgtgtccccgaaggaaaccagaaaggggtgcccattcctacggtgtttgctttaggatttgcatttggcctcaaaaatcctaaaaccttcccatgcgctccctctgctggtgaatgggcagtatcaaccgttagctaatgaacctccgtttggggtgagcctccgtctacattacgccccgtcctgaaattttaggaggaaactgagtttctgaaaaactgccttattttcctggcaacctgagagcagattcttgggttcagtgacaacactctttcacccaacatggcagccatcattaacgaacaccacgtgttaacttcagtagcttttgtggcagtgatttgtaagcctttgttaaccaagggctgaaactgagtaagcagagagaggcacccatctccacaagcacaaaatgtaagggcggggtacaggggtcccccacaaactcaataatcaaggcaaatatattttagtgcaatattttagaaggaaaatcattggaatgggggccagttgagtttctgaaataggtgtagttttaaaaacgtggatgatgcctgccccatttatctgaggtggaaggaagcacgtttttgctaaagaggtataatgtcttgaagctctttcatgccttttggctgcctggtaagtatttttgtctactttctccattgtacttcgatgataccctcaccaggtattcccaagcaccaagtttatcttcccctcccttaaagttcctgagatcagaaaggaggatgtagacagagtgagctgatgttagggagatctcttcaagggtgagcagtgacatttatgtggatcctgggcctatatcacctcgctggctgtaaagcctttatactatctaggaaatatgtgcatgacagcaaatacgtatgggtttggtatcaaatggggctcagagctctgcgaacttgactctaaagttccaggctgctgctaatggtacccagctgtccacctctccttagttaggtcattaattttctctgtctcctaaaggatgacgtacatggtatactaaccatatccatggtgatgtggtgcagtgcacaacctgtggaactgtgtacctgctgaggccatacactgaagcttgcacactttgtagagaaagagttgtagtaacagagctacacagatagaagcagatgtctgtcacttgatgtggacttttaagaatcatactttgcttttattttataaagtggagcaaatgacaacatcacttcagaagttataaagaccaacaaggccatattcgaaaaaagaagttcctacaaatattagttttaaccaaaaaggaagttactcaattcatttaagatcatcaaaatccttaacaaatggcaaaatgtcaaaaacaatgttttcaaaacgaatatttgtttccagatatgattttaacagtttttaaatattttctatttttaatttttcctgctttattgaggtatagttgacaaataaacattgtatatatttaagatgtacaacttcatttctgcatcatttatttgttctaatctatctccttctgccgaatgtaaagcaggtgtcatgtagacagcacatagtctgatcttggttttcttttttttaaaatagatttttcattcttctagctttattaaagtatgatagacaaacattgtatatatttaagatgtgcaacttcatttctgcttcatttttttctgttctaatcttccttctcctaaatctagagcaagagtctcttgtaacagcatagaattggatcttggttttctttttctctgtttaataagacttttttttttgcccccacaatgacatttgtttctaatcttcctttcagaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattgaatgtgatgtggttataaagataagttaggcagctagaccctgcgttctaaaaaaggattgcttgcaatgttggtttggctattcatttgcacaaagagactgtggctctctgttgtgagatcttcagctacctcatggtgcaataacacacacacgcttaaccatgttgatggcacaaagcggtgagcagtagggaggtagaatatcttggtggggaggggatgttatcagcttctgggagatgaagaatattgttgaggttccaaagatgctggacctgtgctaaattcttcagtgatatgaaaaaatcattgagcattcattattgcgaatgaagtggggatgcattatttctgacacccacaagcagggtttgatcatcctttcagctttgagatatctgcacataaaattattattacctgaagaaaataaggctgcattttgaaatgttaagtgcaaaatgactgatgttaaaaccatctgggggaaatcttgggatgctttttcctaggaaatcatatggttgtgatatgttttggcgcataggagacagaaatagtgattatcaggcgttgagcctttttgtagtatttttagtctttgatactctgtaagtgctagttcctaaggcaccaacattgcattccttggtttatactttttctattcatcagggtaggaagtcttaaatccttaggcatccaagaagtatactagctttttgcttctcttttagaaatacttgtggggagagaaaaaaggatggtttgggcatattggtatagtttgagtaaactaaggttaatgttcatataacatttagactttgccataaatatcagaaccaaagatcaagacattcatgtacagtctggaatgtatatatggggcccataaaaattcccagtatgcatgttttatgctcaccattatgaattggggtcttcaaagagagaaggttgaaagtggaaagcacttgaaagggctccccggtttgtaaaatatctttaatcattcacattaggtacctcggagttgcgggtctcaaatgtggattcatgcatcatttgtgcagtttgaagatagtccatatttcctatttcagtattaggtcctgcaacacttttcaattcttgtagaaggtttttttcaggagtggtgatgtctgatgctcaattactattttccctataagagtttcagcatgagcttaattaaattcttgtgaaaaaacctgtgtttttagttacacacacacacacacacacacctacttaaatggaatctaaacatttttagcctttaatccattccattttctaaaactgtcataaactatttttaatcattttaaataaatgtaaaagaaaaataactggatttgattattgaatagtttttttctatatttcacaaataaattgtatgaaatgactgtagaagtggccccaaaattatgaaccttcgtagctgtgaatatgatgccataaatctcttttaaagctcaagatagactatgaacatatgaaatacatagttacctaatcatgagactaaattcacctgggtgacaaggctaacgttcaagctacttaagatgaaaatatttgaatcatgattgcttgggggaacctctctttgaggggtcatgaggaccacctgctgggcattctgttttcatgctgagaaggtgagaattgaacagatgagaaaagccttgataaaacgtcatctccatgtaatttagagaaggataaccttgactgtacagctgacccttgaacaacacagggctgaactgcacatgtccacctgtatgtgagtttgcttctggctctgccattactgagacagcaggaccaaccctccatctactcaatgggaagatgataaggatgaagacctttatggtgatccgcttccacttaataaatagtaaattcattaattttatcttccttatgattttcttcataacattttctttcctctagcttactttattgtaataatatggtatgtaatacatatacaaaatacgtgttcaactgttaccagtaaggctttcagtcaaccagtatgctatgagtagttaagtttttggagagtcaattcatacagcccttgatttttttttttttttcaattaagttcatttagatggtcagaaatgtcagttaagcgtcatttgaaggtaataactaaccttgaaaaactagtggcttgggtatagttttccaaaaagttaggctgggcgtagtggctcacacctgtaatcccagcactttgggaggcctaggtgaggggattgcttgagcctaggagttcaagaccaggctgggcaacatagtgagacccccatctctagtaacgatttaaaaattagctgggcgtcgtagtgcacacctgtagtcccagctacgtgggaggatcacttgaacacagaaattcaagaccatagtgagctgcgatagcaccactgcactccagcttgggcaacagagtgagactctcaaagaaagaaggaaggaaggaagggagggagggagagagggaggaaggaaggaagaaaggaaggaaggaaggagagacagagaaggagggagggaggaagggaaggaaggaaggaaggaaggaaggaaggaaggaaataaatttgattcttttcgcccataaatttgtgatgaagcaccagttttggaaagcttccctgctttggtagaaatagcagatggcaagattctgatatcttctactatgaagttcaaagcagtcagaagtgggcagcttggtttttctgaaatttatcattctgacatcggactgagacctagaggagattttttaatgccatctgacagatctaaaatacatcttctaagagtactatgcaaaagtggcagctgtcctgtttgcttggcttcattgatccaaaccacagggttgacaattttccttcacatggatacagtgagggattctgcagttatatgaggcatttgagtcaaggtgatacttgcttcttgattccacagatgccactttttgcctttgaggacttgctaaagagttcagacttttcctactgtatgttttctgtgcagaagtcatgttgtgtggtgaggaccatggattttatttcatttcttaacctttctatgcaaatgagaccttgaggctgcagagaacaaaattattgggatgcacaaatccaaatggaaataggctcagtttagctaaggaggacacttgtgttatcttgtgattctaatgacgttcaagctttaatcacaacattttcgtgcaaaaggaaaaatacatatattatatacgtgtgtgtgtatctcctgtaaaataaaaacaatatattgtattaaggaggccttgcagctgttgtccttatagcttcagaaattttatttttttcaatatattattcttaggtctgtagtatgaaagttcttttaaaataaactgtacaacaatttcacaaaatattcaaaataaaaaagagggagtgtttggatattaattgtcactaaatttaataattaaaatactaaaaattttacaaaggggtgaccacactaaaattcatatatccccaaagatctcttaaaaattagatttttcaggctgggtgcagtggctcatgtctgtaatcccagcactttgggaggccaagatggggggatcacttgaggccagaggttggagaccagcctgggcaacagagcaagaccccatctgtacaaaaattttgtaaaaattagctggatgcagtggtgtgtgcctgtagttatagctacttaggaggttgaggcaggaagatcacttgagcccaggagttcaaggctgtagtgagttatgattgtgccactgcattccagcctgaggaacagagtgagagcttgtctctaaaaaagaaaaaaaatagatattttgaacattgcaaaagcctacaatctttttaatattgattactttagttaaattcttctccatttaatgtgattttagaagtaatccttttacatctggaaaatggagaataatttattatttcacccagagaatgataaatcaatcaatcaaaatatagcaatctagaaagctaataaataatgttctaattagggagacctactgccagtaggagtaatagataataacaatactatttgctgaatcattttattttagtagaaaaataagctttcaaagtaatttatttacttatttatttatttttgagatggaggctcactctgtcgcccaggctggagtgcagtggcacgacctcggctcactgcaacctccgcctcccgggttcaggcgattctccctgcctcagcctcctgagcagctgggattacaggcacccaccatcatgcccagctaatttttgtatttttagtagagacggggttttgccatgttggccaggctggtcttgaactcctgacctcaggtgatctgcccgcctcagcctcccaaagtgctgggattacaggcgtgagccactgcgcccagccttttaaaataatttacatactttacacatgtacacataaaaatggatgttggttggatgtggtggctcatacctgtaatcccagcactttgggaggtcgaggtgggtggatcacttgagcacttgagccttggagtttgagaccaagcttggcgacatatcgagactctgtctctacaaaaaaattaaaaaattagctgggcgtggtagtacatgcctatggtcctagctacttcggaggctgagacaggagaattgcttgagcctgggaggttgaagcagcagtgagctctgattgcacaattgcactgaagcccaggtgacagagcaagaccctgtcaaaaaaaaaggatgtcagtgataatgagttgtttataaagatagaattagagttccagggatgactggagaggtatagtgtattataacccctaccatgtgcccgtcagggactggtacttaaaagtcaaaacagtaactgcagaatttgagaggtgtacaaagatagtctctcaaatagtgctcagttattagttcagcgatggtcagtttgtgcatagctatgaaactagcttatcacggtaaaaagtgtgtacgcttcactatcttgtagcatttagtttcccagcagggccatgcgacacccagtggacatttctaaattgtacattcaaaaaaatgttaccactggctgcaacatttttttcattaaacataaaagttggtcttgggggtgtcattcaatgccttttctgcttccttcagaattctaaaggcttccaccacaactttgatctgagcccagttatgaacttcatacaaagctgcagggaggagcctgtgtctgttgaagaaaggctcacaagatcccatggtaaggggagaggagaaggggtaatgaggaagaaaggcagctttccaggggccgagtccggaagaccagacttgtcagagaatggaactagcttgtccagtctcagcccatgagagagtttcacgccacgtgctattctggttctgaacattgagcacttgggtgacttggaatggcctccatctaagctgcatcttcccccatagttccaaatataaatgcaatgcattccctgggttcctgccagccattgtcacgtttttgcttcacagctgtctcctccctgctccccgtcctattcatctgccccttgctagacaggtattcatgaaacatgactgcttgtttatgaatagctgggatgtagacatgacatacggaaagagaagctgccaatttttccccaaccaaaagtgaaaacagtgcttggacctaacaagcatagaatgtttgatcccatagcagagctggtgggaaggctgggggcaaaatctgacactgtccaccattggctgtagaccaaagggaggctgcagaccaaagggaggccgcagggaggtgagatcatttcaatcgcaggtccccacccactacgagcacttcctcacccacatcctctgttctaatcttttctgtctatctcttatcaacttccaacatatgataacgtatcaccttttattgtttctctcccggctccatccccactagaatgcaactgctacaaaggcatggatttgtccccagtttccagaaacatgactggcatgtagtagatgctcattaaagacttatttatttatttattgagacaatgtcttgctctgccgcccaggctggagcgctgcagtgtgatcctggttcactgcagcctcaaactcctgggctccaacgatcttgtcacctcagcttcctgtgtagctggcacaacaggcatgtcctaccatgcctggctaatttatttattgtttttgtagagacggggtctcactgtgcttcccaggctggtctcgaactcctgggctctagtgattttcccaccttggcctcccaaattgctgggattacagacttgagccaccacgcctggccctaaagacttattaaacacacgggaaaatgaatgaatgaagccctcgttcaggccacaactttaataatattaaagaggagatattttcttttggtattctagctaaagacttttgggatgagatggatagggatattaacaaatgtgtgtgtttttaaaaaatatacatattatgaaataaaacatctggaagacctccataactcaatgaaccaatattctacaaatgacccatgtgtgaagtggcagaatcatgaatggataaaaggtttgtctgaagcttaagataaacctgtgggttttaaatgtgtagactttaaaaattcagtgataggatttcagattccacactaccttatctttgagaagctattgatgatcaagttttgtcatcaaaggagaacattcacagttatttgaaaagattactaaaatactttttctaactatgtatctttgtgaggctagattttcttcatctactttaacctgaacaacataaggaatgctgatctgagaaactggttgtctcctcataagtcagatattaacaagatttgtaaacatgtaaaacagtacactcttcccctatgaaaatttttctgtttgaaaaaatatatcccatttttcataaaattatgttatttatgtaaaatgtagtggatttatctttaaaattattaaatagtcaaaaacttcattttaattttagaaaatatagaaatattaattttaatttattacagcgttaaatttaatgcaatataatttaattacagaacatgtagacatttacaatgcacaaaaacaaaagttcctctaggcccttaatcattgttaagagggcaaaagaggcagggcgcgacggctcatgcctgtaatcccagcactttgtgaggccgaggcgggcggatcacctgaagtcaggagttcgagaccagcctggccaacatggtgaaaacccgtctctactaaaaatacaaaaattagccgtgtgtggtggcacgtgcctgtagtcccagctactcgggaggctgagataggaaaattgcttgaacccgggaggtggaggctgcagtgagctgagatcacgccactacactccagcctgggcaagacagagagagactctgtctcaaaacaaaacaaaaaaagaaggcaaaggaatcctgtgaccaacatgtttcacaatttctgcttgatgttataaatgatggcactttcccccggaaatctctgcagttttatcagtctccctccctgtctgaccacctcaatccttttctatctctgctgactcaaaatggttgaagcaataaagacagcatctgtaacaagatgtacttagattcaggacctctgggctgggtcagtttgagggcttaacaatgtcctccagtagccaggttctctgtgtcttgcagtcctgtgtttcataagtcatcggcccatttcactcatggcagaagatggctgctgtacctccagccatcacagcctcatctactaatatctggaggcccaattaggatcatttcctcccagattttctcttttaagagcaaagacattctttcagggatcaagcccaattcctcatccctgatttacacacagcccctaactaaaagtaatcaggtgtaggccaggcatggcagctcacacttgtaattccaacactttgagaggctgagtcaggaggatcacctaaggtcaggagttcaagaccaacctggccaacatggtgaaacctcgtctctactaaaaatacaaaattagccaggcatggtggtgggcgcctgtaatcccagctacttgggaggctgaggcaggagaatcgcttgaacctgggaggtggaggttgcagtgagccaagatcgtgccatttcactccagcctgggcaacagagtgagactccctctcaaaaaaaaaaaaaaaaaaaaaaagcctgagaaagcatgaaggaaccctgggaaaaaatacaggctccaccaacaataaggaaaaatgatggttgactgggtagccagtagcatgtgctgcaaatcatttgcttattttgtgtcaagttgtttgccaatgtagctctttatatattatatattattatgttactctttaccaaaatataaaatattgagatgtaattgtagttgtgacccacacacatacatgtaaatgcatgtattgcaaatgtgttctctcattctgtatttgtcttcaattcttagaacctttgtcacaatcatgtcgtgcaatcaagtagcttggcacaaacatctgttctgtgccttctgagtttgattttttgttgttgttgtttgagacagagtcttgctctgtcacccaggctggagtgccgatcatggctcactgcagccttgaactcgcaggctcaagcaatcctcccaccttagcctcctgagtagctgggactacaggcgtgtgccaacactctcagctaatttttttatttttattttttgtaaagatgaggggaatctcactatattggccaggccggtcttgaattcctgagctgaggcgatcctcccactttagcctcctgagtagctgggacaacaggcgtgtgccaacactctcggctaattttttaaaaattttttgtaaagtcagagggatctcactatattggccaggctgttcttgaactcctgagctcacgtgatcctcctgcctttacctcccaaagtgctgggatggcaggcatgagccaccatgcccagctgcctgccgggtttcaatccttcctttcccagcacacatgtaattttaaaaaggtcttgtaactaactctccaataaagttgtcccaggcatataaatgtcttgacgttttcttcaaatgcctccctaggaaaattggcacacacctattcccggcaacagggaggagagaaaggtttactctgaatgcacccatgacaaagcttacctgctgccaagctctccatggcttcctggagaccaacacacacaggaacagaagcccggcaacccccgggggaagatgcctcctccgggtttaaaaacagagctacccttttgcccggggatcatgagggttgccttgtgacttagtgccttatactctgctttcggagcaccaattctcagtggaacgggagaaacaggcgggtgaggaggggtggggtgatttatggggcagagaatggtgcaacacctacccttgtttgtgttgggagaccgaggcctcctccatgccctaaacatgctgtttaaacatccctgcaatttcgccaacgtctctttctctctggctgcctcaacccttttctatctctgccaaatccatgctccactgtctccggccctcctggctccagctacccctccccaacaccctcaaatctcagaaatgcaagcagtgcctctcaagcctgcgcattaggaactcctggaggcctggttcacatagcggggttggaggaagccccgagacgcagggttctgatttcagagttcggatgcctaagaatgtgcatgacacagtttcccaggtgacgctgatgctgccggactaggactgagcctgcacatctcaccctgaattcaaaatcaaaagatggggtgagggttctcggcaaaacgcagcctgagattctattttggagacccctgttccagagagaagagcagtgctcctgacacttggtgggtggggcccagggacgctgctcaacaccctgcagtgcacaggacgccccccacagtcattcaacttaaatgttattagtgataaagttgagaaagactctatctattgtctatctatgtatccatctatccacccattcatctatcatcatttatctattacctatgtatcatttatctattatgtctatacatctagccatccatcatccatcatcattatttattatctatcatttatctaatatctgtcttcctgtctatcttcatcatcatcatcatcatcatcatcaatctcttatctatttatcatctatctccatatatgtatgtatctatgtatctctatatctatgtatcatctatttatcacctatctatctctctatcctatctatcatctatctgtccattcatcctatctcatctatcatctacctatgtatcatctatcatgcatctactgatctatttatctatccattatctatctatttatttatcatctatctaaacagtggcttacagcctaagaatgattctgcccctgctcctaccaggggacactgtgcaatgtttgaggtcagttttaattgtcactactggaaagtgtgccaatggcacccggcagatggagcccagggatactgctcaacaccctacagtgcacaggatgggcccacctcagagaatccagccctgaatgccacaaacgccttggtgaaaaactccagtagtaacttccatctaaccttgggaaagggatcaggttgacagtcacatcattctgaacagtccaggaggcaggagctgtctgagtcttttgtaaatgcccctcttgttagaacactcataagaccctttcccgtaggaggatcctcccttacccagagcaagagcacagcactccacggtttccctgctggagcaatgagaagccaacacaggccccatggaacgagttggcagcacaaggctgtgcagacatctggcgactattggagccaacaaggagaaagcatagaagctgggagagtctccccttccttgcacaagaactgagacttccttggaggggccagcttcatcctggcatttctcttctttggggctggcatccagaggatagaaaactgaggtcgtactggcaaagggggctccgccggggcacttcttggctcctaaggatttccccaatgcctcaggggctggacggatttgaaagtggaccccctatggaaaatgatacagagatttctcaaagaactaaaattttatctaccagttgatctaacaattccactacaaggtattcacccaaaggaaaacaagtcattatatcaaaaacacacctgcactcatatgtttattacagcaccattcacaatagcaaagatacggagtcaacccaggtgctcatcgacaggtgattggatacagaaaatgtgatttatgtgtacaatggaatcatattcagccatgcaaaagaatgaaattctatcttttgcagcaacatggatgaaactggaggccattatcttaagtcaaataactgagaaaaagaacgtcaattaccacgtgttctcactcataagtgggagctaaataatatgtccacatggacatagagagtggattaatagacactggagatacaaaagggtgagagagtgggaggatggtggagaatgagaaattacttaataggtaccatgtacactattcaggtgatgcttaccctggaaacccagacttcaccacaactcagtatatctatgtaacaaaattgcactttaccccataaatttacacaaataaaataaaataaatcagtaaaattggatatgtcaacctgtttaaaacaaacgaatgcagaaaaaaaacatgttgtaataacatataaaaataaataaagatggcttcttgatgtttaatatgccctgcagatatcttacaaagccccagtagtcacgagttaaattcttgcctgtagcctgctggaggtcagagatagcctccactgtttatgtacagctctggccccatctatgaagtagagctaaaaacaccaccgatacctgtccccaaggctgagctgatgcaggaacagccctcagcacagtgcctggtatccacagaccatcgatcatcctaggtattcatctagatcaggaaggcctgactgtagcttgcgttgattgccattgacagtttcggcaagaatctgggttcctttgctgtctctttcggatggacacgtgaaggctcttctccaagtaagttcactcattcgactcatgcactcatacatgcatgcactcacaccatcatcactcattcaactcatacatgcatgccctcacacagtcatcactcattcaactcatacatgcatgccctcacacagtcatcactcattcaactcatacatgcatgccctcacacagtcatcactcattcaactcatacatgcatgcactcacacagtcatcactcattcaactcatacatgcatgcactcacagtcatcactcattcaactcatgaactcatacatgcttgcattcacacattcattgattcattcacttaattcactcatgcatgcatgcatgcattcacactttcacttattcattcatgcatccattaacttgtccatgcattcaattcattcattcactcatacataatacattaattcctgaagtgtatgcagtcttcactcattcactcgtgtgtgtgcattaacacacatgctagtttgttcagctcattcctgtactcatacatatttattcactcagtcattcggccacgtattcacttgtcatgtattctcttcattcactcacacacacatccattcctgtataaatgcatgccttcacgtgctcaatcaatcctgcatgcatgaattcactcactcatgcaggcatgaactcacttgttcactcactcattcatgcactcactcatgcttgtacgaattcgcttatttactcattcatacactcatgcaggcatgaactcacttgttcactcattcgtgcactcatgcatgcatgaattcacttgtttactcactcatacatgcacttatacatgcatgaattcacttcttaagtcattcatgcactcaatcacgtatgaattcgcttgttcactcattcatgcactcactcatgcaggcatgaattcgcttgtttattcactcatgcagtcactcatgcatgcataagttcacttgttcacttattcatgcactcactcatgtatgcatgaattcacctttcacccattcatgcactatgcatgcatgaattcacttgttcactcaatcattcatgcattcaactcattcattcactcattcatagattcatgccttcacgcatgcatgcatgcattcacctatattttccacacagtcacacctccattcacgcatctatctctaaattcattcatacatgcattggctcgttcatgccttcaactcatgcattcatgtgtgaatgcattcattccctccttggcgcaaacattgattcaatggttcattcatttcctggcctgctcattcatgagtagttgtttgttcattcacgcctcacatgcattcacgcatacatgcactcacgcatacatgcactcaccgcgtgcgtacagccactcgctcgctatgcattcaacagctgaagcctgaaaccctcatttattctttctttcgtgcactcattcattcattcagtttatgcgtgtaagtacgcgcacgtgcatttttcatgcattcgacaagatcgcgtataagccctgccttctccctctgggaggcttccagagcggcctccactcttgctgcgcgctggccttgggcccagggccttaagtcatcgcaaacgtttactttggggctggctgattaaaggttaaatgtccaaacctagaaaccgccgactgccgaaggggccgcggcgggcgaggggcggggcgcgggcgtggatcgcagcccccggcggttcccgggtctctcttcccggcagccggggctgggcaccaggcggcgcgcgggcttgcgggcaggggctgcagggaggaggagaggacccgcgcccgcgggggctggcggaggcggggccgggcttccggacagaggccaatcgctgccctcggggcctccagcgccggctctgggccgaggcagccagagcgcggaagaggtgcggggggctgtagggggctgcaggggaccgtgggcagtggaggaggcctgggcgcggcggggggccggggggcgcagaggctgcccgaacgcctaggaggtctcgagggtgggtggcgtacagcggggcgggggcgcaacccagaggccgaggctgggggctgggggaggggcgccggactggagtgcaaaggaggggcgaggggcgcagggggctggaggtcagaggttgcccaagcgcgaaggaggggaggggtgcggggcgcgggagtaggccaggagcgcttaggggtgagtgcgccgagccagggcaccgagtgctggggaatacaggccgtccaggcgcggcggggcgcggggagacggaggctgccggagtacggaggacagacggggcgcgggcgtagggctgggaggcttggggaggggggcgcgggcccaaggcagaggctgcgggagcgcggggcaagggagaggtgcagagcgtggagggggctcgggggcgcttggggaggatgggcggcaggccgggtcggggaggaggggcggcgagaggcgcaggggtaggccggggggctgcactggagtgacgagggagggggcacctggccggggggcgcgggcagaggcagcccaagctcggaggaggtgcagatactggcgtccgggagcgcaggggtggtccagggagtggagaggggtgaccggggggcgccagctggggtggaggaagaggatgcccagaactccaagcaggtgcgcggggcggcggggcagctgctgacaccgctgaggtcgggtggtgtcccgggggcgttgtcgttgctgggcgcatgggtgttaagacgcagcggggtcgcaggtgactgtggggaggacagggggtcaaggggcccctggccagagggcacgaggctgacctggagcgccaaggaggaagtgcggggcgtggaggtcgcaggggcatcgggggaggcaggggccccgtggggcgcaggtgacatggagtgggtaggaggccgggggtgacactggcggggcctgcagccgagggtgtcgagactgccacgctgtcgcccccaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcgggtgagtagctcaagctgcttcagttcagcctgcctgttcctactggcttgggtgacagattggtctgcactggggagaaccccactttgaccgcaggattgccccaaaccccgagtctcccccttactgcctcgcccaggtctctctggggctggagggaatggagataccagcctcagctgctgggagggggtgatttacagcaagtgaagggggccttgggatttcaccagtttccttttgtaaaatatagtcctgaaactttcaatgggcttgtttcttgggaatagcattgaactgcctgagactgtcactgcctggaaggccgatgggaagaagtctgttctcctgaaatggccctaaagctctgggaagaggctgccttgagttcttagaactcagaccacggttttaatttctgtttccagtacagatacagggatggcccggcttggtggctcaggcctgtaatcccagcactttgggaagctgaggcgggaggattgcttgaggccaggagtttgagaccatcctgggcaacatagggagaccacatctctaggaaaaaaatttaaaaatcagctgggcattgcggcacctgcctgtagtcccagctactagggaagctgaggtgggagggtcctgagcccaggagttccaggctgcagtgagctatgagtgcaccactgcactccagcttgggtgacagagtgagaccctgtctctaaaaaacaacaacaaaataagaatccaggttaatcctcctgcaggcagagggctggctggcaagaatggcaggaaaggcctgcccccgccaaggaccggtgagccccatctccctgcccttgggttttgtggacatcagatagactggttgacttaagaggcctagatatgtgaacagagtgtaacctcttcccataagaaagatgctggttctattttctatcattaaatcattaagacacctccttcttgtaccagaccacactggatcattctatgagtgcattttatgtatttatttttaaatgtatattttttaaattttgtagagacagggtcttgctatgttgcccaggctggtcttgaacttctaggctcaagcagtcctcctcctttggcctctcaaagtgctgggattacaggcacgagccaccacgcctggccatgagtgcaatttaaaacacacaaacagaacagatgacttttttattcagaggagagatttggtaaatcacagagctgcttctctcctgtttgttcccactctggacttagagatgaaaattgtcggggcagggatcttaagggctgttttcatgaggtgtactggaagagtctgttccaaggaatggcagaaaagattctctgttctagggacgcgtttggagctctctaaagtgaaagccacacatttccccaagcctgctagggtctgtataatagcagcattcaagacggacattcgcatacatcttggtcagcctcgtgccagaagagaagactcaactctttgcagaaaacaaaaaccacctttgagtagaaaagggctgagaaggaagctgctaaggttattttggggggtgatcagaagattccttgagtgcaggggggcaggcaaggggtagaaagaaactgttgtcacagattcataaaattctcagccactgtaatctccagactggacttgattttgtgacaatgtctcctttttgtgggctgtggtgcagtgacaggttttcttgctgtttttccactccatgccgttgctgaaagtgtccgccgcagtggcacttggagtggaaactccctctttgaatgcagtagcattggataattgtggatgttctctggcgtctggcgccgcaccaggacttgatcaccagttgtttcttcaaggcaaggcgatgtggaagctaagccctgtcaatcaatgtttcatcttctgttctatttcaatctgctggtctgtctttgcactttagatgggttttacagtgtcctggatgggaagcggctaaccttcaggaggtgcacatttttgttccaaagcaaaagtctgagtctcggatcccttgttgctggagagagctcgtgtgccaactggtgttgtcttgtcattgtgtgactgtggtcaatattccctccactctaaaccaaagagagaaacagggtatccagtagttccataaaactctcactctaaatgcagccctgtctgcattctcttttgtgtttgagatcaaggtgggtgtgggcagggctggttcctcctgaggcctctctcctgggcttggtcctcacagggtcttccctttgtgtgtgtctgtgtcctaatcgcctctttttttttgagatggaattttgctcttgtcgcccaggctggagtgcgatggtgcaatatcggctcactgcagcttccgcctcttgggttcaagcgattctcctgcctcagcctcctgagtagctgggattacaggtgcccgcccccatgcccggctcacttttgtatttttagtacagatggggtttctccatgttggtcaggctggttttgaactcctgacctcaggtgatccacctgccttggcctcccaaagtgttgggattacaggcgtgagccaccacgcttggcctaatctcctttcttataaggacaccaatcctattggatcagagcccaccctagtgacttaattttatcttaatctcttctttaaagaccccatctccaaatacagtcacattctgaggtcctgcaggttatgatattcatatatgaattttggaggtgcacaagtcagcccataataggataactcatttatttgaatactactgtgtttttctgctggggctgccataacaaagtcccacagactgggcggcttaaacaacacacatttactctcccacagtcttggaggctggaaatctgagatcagggtgtgggcagggctgtttcctcctgacgcctctctccttggcttgtagatgttgtctttctctgtatctccacaaggtcatccttctgtgtgtgtgtgtgtctgtgtcctcatctcctcttgtagtgaggccagcagtgctactgtattagggcccaccctagtgacctcattttaccataatcacctctttaaagaccccatcttcaaatgcagacacattcagaggttctgtggggtagggtttcatcctaggcgtttcaggatgggttatcatccgtctataacacccattaatcctcatgttttccctgaggtccccatgaagagctataaagccagcgcatgtggttatcaatcaatgatcactctgccatttctcttagttgtcactgagatcctcatgaagagattaaaaaaaccagcgcacatcgttatcaatcattgatcactttgccagttcgcatagttgtcactcacgtcctgatgaagagataaaaagcccatgcgcatggttatcaatcattgatcactctgtcatttctttcagttgtcactgagatcctcatgaaggggtaaaaaaccagagcctgtggttatcagtcactgattgctttgccatttctcttagttgtcactgatgccctcatgaagaactataaaaccagcacaggtggcgatcaatcactgatcactttgccattcctgtgtgttgtcctctgcaccttgctttgggccaattcacttgcatcatccttttctctagacagccagagggccctccctggcaatggagatgagaccttcttacaggttttggaaccctcaaatagctcctcataagcctcaggataatagaaaaggctgcatatcacctttgtaatccgggccctctgaccccatctcttcctgtgggtccttgttctccagctgctgttgctacgctgtgaggaatgcaggatgcagcatgcaacctatcatctccacctctggccttggctggtggattttttctgcctcttccttctttgccttattatttttggttcagtttcttattggaggcaggagacagtagctattttgagggcttttgttggtgttggagtcagaggtgacctcggacatttaattactcgttgaagccccggtttacttgtttttgaagcacatgtctgtgttggaaagggaattaatgagagcgcagaggtatgccctatctacacactcctggagggatgggagccatattcattcttgtttgttgctccactgatttcttgatggataagttcttcctggccatttatccctgagcttggatggtgccctttcaaaaactgctgccagccataggacttgccttgcagtatcgaaacacccatttcttagggctaatgtttctcatggagctgtgggtgtctgaggacagagcttgtaccttgtcagctgctgggcccagcacctagcagattctcgtgcctgggaattgcctgggacgtgaacccacagtgaacgtgtaatgcactgagagcacgtcattaggcccacacagacatcttctgccccttcaccttctttgtcttctgcctccagcttcaatccttcactctttctctaagcagatgcccttatgtgtgcagcttatggcatagcactgtggactgggataagcagtgtcccccataaaactcatgtccccccagaagctgtgaatgggacctgtgaacccaaaagtatctgagacaggtctcaatccatttagaaagtttattttgccaaggttaaggacatgcccgtgacacagcttcaggaggtcccgacaacatgggccaaaggtggtcggggtacagcttgcttttacacatttcagagacatgagacatcagtcaatacatgtaagatacacattgctttgatctgaaagggtgggactacttgaagcaagggggttgcggggggtggtgccaggtcataggtagatttttaaatgttctgattagtcgaaagagttattatcaatagaagagaatgtctgggttatgataagaggttgtagagaccaaggttttatcacgcagatgaaacttccaggtagcaggcttcagagagaatagattgtaaaggtttctcatcagacttgaggtctgtgtggatgtttatggtggtcagcttttcctgaattccaaaatggaggaggttatgatgaggcatgtctgaccctctcctcattatggcctgaactcgtttttcaggttaactttggaatgcccttggccaattaggtagttgcgaggcctagaattttagtttaggtttacagaccttattgggaaatagggtctttgcagatgtaattagttaagcatctcaagataagattatcctggaatatttgggtgggccctaaatccaatggcaggtgtccttctaagagatagaagaagagacacagacacagaggaggccatgtggagttggaggcagagattggagtaatgtggccacaagcccagggacatctggagccaccaggagctggaagaggcaggaaggacccttctctagagtttggttttggaatcctggccttcagaactgcaagagagtaaatgtgtgttgtttaagtctcccagcgtgtggtactttctcacagcagccccaggaagctcattcatgggtttgctagggaaaggagtcagcgatgagcccaccagtaagcaaaatgagcacagcaggtaagatggcacaagagatgaagggtcctgtgtcataggaggtgagggactgtgatgagaagggtcgtcttggggagcagggtttgcaggaagatctctgagggatgggtggttttttccatggccaccatgtgctgggaggagagcaagttccaggtgagttaagggagtggtagtagccccatggtagtagcacacatcataggatgtgcttgaagacccagaggggttgagctggacgtggggactgagtgtgggggatgagatgaccagcagtctggacccagcttacatttgcagacaatgagaaaaccattggcgttgggttggctttcagggcagctgatggctttcactgtgtgttgggggagaaaatgtggtttttaaggaccgaggagacagataacagggaccagaatctacagggtggagcagagaatgcaaaggagggaagctgtggctcagggtggttgatgcagagacccattttaaatgttttctagtctggtgcggtggctggctcacacctgtaatcctagcactttgggaggccaggacgggaggattgcttgaggccaggagtttgagaccagcctgggtgacagagcaagagaccccatctctacagaaaagttaaaaataaattagccaggtgtggtgagcatctgtagtcccagctactcaggaggccaaggcaggaggatagcttgagcccaggagttccgggcttcagtgagctgtgatgctgctgctgcactccagccctggtggcagacagagcaagaccctgtcaaaaaaaaaaaaaaaaaaaagccaggcacagaaggacacctgtagtcccagcactttgggaggctgaggcgggtagattgcctgagcccaggagttcgagaccagcttgggcaacataacctgtctctaccaaaaatataaaaaatagctggatgtagtggtgtgcacttgcggtccctgctactcaggaggctgaggtgggaggattgcttgctctcaggaagtcgaggctgcagtgagctgaaatcatatcactgcgctccagcctgagcaacagacggagaccttctctcaaaaaccaccaccaccacaacgtaatgaacaaccccaacattttctgttgtgcctctcggttaagatctcaggttagttatgcaagagtagaatgtgggattggaggcaagtggacttctccttaccccagaattcatgtcataaatgctctgcacagacgaggcttctgggactcttggggagacctaggaggtgggtaatagggatctgaatctacacggtggagctcatgacccaggtcagatgatgccaagtttcattttatacattctctgttcttcttctctgctccttaagagcgcaggtcagtaagtggggttggaaacagtggactcttccttactggggtataggagttggcacgctaaatattctgcaaagcttgctcttgcaggaccaagcatctaaatagtaaggtctaacctcagtcatctgtttctggaggaaaatcccaaagcatggcctttggagtgtgatttagccctcattctcagattcagtggtgaagttcagaggggagccaatccctctgagcatctcgaaggtggacagaacagtcagctcaggaggaaatctcaaaacaacgcccctcctcgggagttctcttacctttgtcattgtagttcctaaaggatgcactccttttcctttctattctttaattcacagggtccttaaacatggttcctcagatttcaataatctatacattggagatcacaaagaaatcttaatactgccaatgaaaggctaaaaattgtaaatggcactttattttcagtttgacattactttgctgatgattcttttcataatatatatgatttgatttaccttattttttactttgccatctgctttgcaattaaatacacacacacacacacacacacacacacacatacacacacacacacgttttctttttaaagacagggctctgctctgtaacccaagctggagtgcagtggcacaattatatctcactgcagcctccaacttctgggtcaaacaatcctgccgtctcagcttcccaagtagctgggactacaggcatgtgccaaaaaaaaaaaaattaaattaaatgaatgcaagtccattctcagtatgaaacacatactgaaataactgcctgagaaatggtacgtggtagataaatgtgcagcagatgtgctaattggcctgggtatagaaatttagctatttggtctgggtatacaattttaggttgaggaccattgcactcagagtttagatatggtggtttgttttagtgtccactattcatgataagaagtctcagtctcatccttaataggattgacctgtatttttattttactttcattttcttggcattttcacaatgttctccttagccttggtgtttttaaattccaggaatatattgtcaggaaaaggactgctgattttctttctttctttctctctctcccctcctctcctctcccctcccctcccctcccctcccttcctctctctctttctttcttttttctttttctttctcttttgttgcatactctctgggctttttaaatctaaagactgactttctgctgttgagaacatttcctgtttaatttctttgaaaacttttcttctctctattttttttttctattctcttattctgaaactcatgttggtgaaccttctgaatcactcctgtaggcttctagctttctgaaattttccatttgtccctttattctactttctgagagatttcctcaatgatgttttccaaaccttctgttatttcgttttcatttcagcaaatcatatttttaacttctaataactatttcttatccttggagtgatcttttctatagcatttgattcttggtttatagatgtatccctctccccctgatcttttgaaagaatactaattggtgcagtcagaatttttatgtctgcctgtctgttccttgaacttctattccatgaaatgtctggtatttctggggttcttcccattccaccccataacttttcagttttctcttttgtggtgaaggtgtttttcaaatatctggtaatggtttatatctatatgtataaaaatgaggaatgtcggttgagctgtacccacttgccgactcgtctgaatttgtcaagcttatgctataggttgggaattccacttctgtgtgatggtaattatttttttcttgggctttttgtttcctttagaatagatcctatcatctgattttgcccctggtgatgggtatatttggcctctgagaattctgcagaatttcagtgacttctccagtttctcttattggctgatggttttctcctgcctctttgttggcttggggttcacacttgccttccttagcacactttttagtctgttctccttttatctcagaaagaaggaaagagaaactaggagctccacatccaccatctttgcttggaagattcctggtttacacttttaattacgtgattgaattgatgaaaatggatggaccttgaaaacatcatgctgatggaaagaagtcagacacaaaaggccatatgatgcttaattccatttacatgaaatatgcagaacaggcaaatccacagagataaaaagtgattggtggttgtcacaagctagggaagggagaaaggggagatactccttaatgagtgcagggtctctttttggggtgatgaaatgtcccaggattagatagaggtggtggatgtgcaacattgtgatgaattgtgttctttacaatggcgaattttatgtcatgtgaaatttactgtgataaataaaaaggaaatatgaaattattccattttcaaaaggctacatagtgtttgattccatttataggaaatatccaaaataggaatgtagagacagaaagcggactcatggttgccagaatggggagtgactgcgtaatgggtacagggcctccttttggagtggtgagaatgtcctcggattgcctggagttagtggttgcacaacattgcgcatggactaaatgcgagtcacttgtgcactttaaaatggtttgttttatgttatgttaatttcccgttaattttttgagagtttgcatggaaaggtgaagctctaagcaggtcgtatgtttaggtgtggggatacccattatgctgcttagaaatatgttcacacttagggctcagcactgggggttctacttggtaattctttctgcttccacactctttcaagatatgggtcagagaaaccctggtgaggacggggtaggggattggatctctggctctgttttgggcattgtgtgattttcgaggtctgtgggtgaagctcacacagtacctttaccttggccagctctgggctttgcagatgccagtcccgaatgcctgcttcctctcccaactctgtcctctgcttagagacaaaagaagccttacagacagctgaatgggtccatgacagctacgcctgttcttgggaagtaattttgatcagagctcaggcctttggaaatgtctaaagaagtagtaatcaccattattatcattttaaagctagtaactaagaaaactatagatagattatagataatggtagagataatttataatctatagactgtaggtagataggtagatgattgaaagattgatagatataaataagtagatacatagaggacatatatatgataggtagatggtaggtatagatagatggatggctaatagaaagatgataggtagagagatgatggagatagatggatgatagatgatagatatatagatgatagataaatagatatagatgatatatgataaatagatgatagagatacatggattagatagctagatagataatagagatacatgatagtaagatagataataaataatagatgtgaagaggattggtagatgataggtggatagatggatggatagatgataggtagatggatagatagatgatggatggatggatagatagatatatgatagatagatgaatagatgatatagatagatagatagaaggatggatagatagatgataaagatagatcgattatagtaagatagataatagatgtacagagaattggtagatgatggatggatggatgaatagatggatagatagatgatagatggatggatgtatagatgatagatagggatagatagacaatggatggatggatatatgacagatagatggatagatggatggatggatagatagagatagatgatagtaagatagataataaataatagatgtgcagagaattggtagatcataggtagatggatggatgaatggatggatagatagatgatagataggtagatggataatatagatattatccaatgatagatagatgatggatggatggatagatagatgatagataaatagatgaatggatggatggacggatggatggatggatggatgatgggtagatggatagatatggactgatgaaaggtatcttttgttctacagaattaagttgtaaagtttgctgtctgtaattctcactcccaatggagatgtcaggaattctcgttctttcttcgttcaagggtggggaggaggagtctacaggagcagctgtaacaggcacattttggaatttaccccattggaatgtaaaggtcaaggaggcagccctgtaccacacgtctgggacgcttgtgtttgttatatttagtgcgaattgtgggttggctttgcttggagtgctgcttccgggaaaggcgctgtggtcgcctacatgctgagcattttaatttccatagacagtacactgggctgcacactgcatgggacttctcggcattgctggctgccctcctgactgttgtctttctcctggcaacaggggcttgggtgcccaagaatcaagtggtttaaaagtcattaccaaagttcacatcagtcttgtgcacagagaattaaaactgctgtaaattatatctgctgtgagagctccttcctctcatactgaggcattaggaaattgaatccattctacctaatgaaacaatgtacttttccttatgttgtctctaccgcctcatacatccctgagttgaacttgaagtctttgtaagaaatggtctgtccagaatttaaataacatgtttggctgcttctttatggagcacgattcttttctttcctttctttcttttttcttttttctttttttcagagacagggactcactctgttgcccaggctggagttcagtagtgtgatcatggctctttgcagccttgacctcctgtgctcaagcgatccgcctgcctcagcctctcaagtagctaggactacgggcatgcaccacctcgcctggctaatttttttttttttccagtacagatgaggtcttgctgtgtttcccaggctggtttcaaactcctgggctcaaatgatcccccttcttcgaccctagcactgggattacaggcatgagccactgcacctagcccaaagcacagttcttttgagtgagttgggttacatctttgctgtaactcaggtcatcaagccatcacttccactttttgccttttgttttcacctaagatctaaacactttgggtgagttttcaagagtcaaacacaacataaaataagggatagtagctatgagtttccatggcattgcagcatcaggaaatgggcatagcagttgggttgactttgtcccttgtttaaggttccttcatactcctcctgtgttttgttttgtttagaatgaaaggaagcatgtatgcgaattagaatactgaatattcactgcaagtcgtgattttttttttttttttgagacagggtctcactctgtcatccaggctggagtacagtggtgcaatcacggctcactgcagcctcaaactcccaggctcaagtatcctcccacctcagcctctccgagtagctgtaactgcaggcctgccaccacgcccagctaatttttgtatttttcgtagagacagagtttcaccatggtgcccaggctggtctcgaactcctgaggtcaagcaattcacccacctcagcctcccaaagtgctggaatgacaggtgtgaaccatcacgtctggcccaagccatgaatcttgggagaggagaggaggtgactatggccccgtcacccctgctgtccctcaggagtgtaactctggtgtttctgttgattttcacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcaggtaaggctcagagatgcggcttgtgcccagctgggtcctatagaaggagggtcacctctcccctaagaggtcctaggagttattctgacgactgactgcccttcttcataggcctggatggccggcagtcatgatgggcatctgacgtttgtaaggaaccttcgaatcatgtgaaaatataggcgtgtgatcggcttcacaatactttaaaaaacaatactgggtttggttacagttcattctcccaaccatggaaactgaaaattcaattcttttttgtttgtttgttttttgagacagggtctcgctctgtcgcccaggctggagtacagtggtaccatcttggctcaccgcaacctctccctcccaggctcaagcgatcttccctcctcagccttctaagtagctgggaccacaagtatgtgcccccatgctcggctatttttatttttatgttttgtatttttggtagagacagggtttcgccacgttgcctaggctgatcttgaactcctggactcactcagtccacccaggttggcctcccaaagtgctgggattacaggcatgaaccatggcacccagccaaggagtcttttcttataatttccttttataattctctttgtctttaattctcaaataaagcaaatacataaataaatgcgtctaatgaataaagcataaggcttctcttaaatgtcatacattatgtaagcaataatctttttctttcatcaaccatggaccacttaaaaaaattgattttatacgaatgggacgaggaggcatttaatatggtagatgtagcaggaattgaatgtcatattctttgacaatgaaataataaatccagacattaatagctaaactaaaaagagaacaaataaaaaaccaaccagtgtgtcctcagacgtttgaaactggaagttttaaatgaaataactcaatccgggtacaaatgaaagcttgaattatgtactatttcagaaaatcactgcaatgtgagtgctacctatacaaagcaaagacagcaactacagtggtacaagacagaaaatttaaatcagtgaagaaattatccagttcaaatatatatgtatatacacacacgtatgcatatatatgtgtatatgcacgcgtgtgcgtatatatgtgtatacgcacacgcatgcgtatatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgtatgtgtatatgtacacgtatgcatatatatatacatgtatgtgtatatatttatatatacgtatgtgtatatgtacatgtatgtgtatatatttatatgtacaggtatgcgtatatacacatgtatgtgtttatatttatatacatgtatgtatacctgtatgtatatatgttcaactatatatttttatatacatgtatgtatatatttatatatacatgtattatatatgttcaaatatatttatatacacatgtgtatgtatatttatatacacatgtgtatgtatatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatacacatgtgtatatatacacatgtgtatgtacatatatttatatacgcatgtgtatttacatacatttatatacgcatgtgtatgtacatacatttatatatgcatgtgtatgtacatacatttatttatgcatgtgtatgtacatatatttatgcatgtgtacgtatatttatttatgcatgtgtatgtatatatatgcatgtgtatgtatatatatacatgtgtatgtgtatatatatgttcaaatgtatatgtatatacatataaaatatatatatttgaactggatttcactgatttaaatttaaaatatatatacacacatatttgaactggataatttcaaatatatatatttcatatatatatttgacttggataatttcttcactgatttaaatttaaaaaaatatatacatatatgtatatatatacatatatatacacacacacatatatatacacatatatatatatatatatatttttttttttttttttttttttttttttgagacagagtctcactctgtcgtccaagctggagtgccatggcgcgatcttggctcagtgcaacctccatctcctgggttccagtgattctcctgcctcagccttccaagtagctgggattacaggcatccaacatcacgcccggctaatttttgtatttttagtaaagacaaggtttcaccactttgcccaggctggtctcgaacgcctgacctcaagtgatctgcccgcctccgcctcccaaagtgccaaagtgctgggattacaggtgtgactcaccgtgcccagccccaaatatttttaaaataataatattaaaaaagcaaacagcagtaaaaaattcataaagataaaatgacaaaactaataattgggaacaagaaacaaattcaaggattaggttaacaaatcttcagggaggccaaggtgggaggattgcatgaggccaggagtttgacaagacaggctgggtgacatagcaagaccctatctctacaaaaaataaaaagagttagccaggtgtggtggtgcgcacctatagtcccagctagtcaggaggctgagatgggaggattgtttgagcccagaggttcgaggctgtagtgagttatgatcacaccactgcactccagactgggcaacagagtgagctcctctctctaaaaataaaaataacaaataaaaatgaatcttttattcgagaaaacataaatgtacaaaattgaaattagaaagaagtcatttggaggcagttttaaaagcaaatagtatatagaaccctttacagtagtgacactgggagtattgaagaagtgcttgatccttctagggaaatcggtgagatgttggttgttgtcatcagaagaaatagaaaccttttgtttgacaataactatgagaaaaactgaaaatgttaccaaaggcttatcttgtagaaaggccctggtttgggcaattttaagggaagttctgttaaattgctcatgatgaattaatttccctgctgcataaactgtcacagagcctagcaaaagatgaatatgttcacttattttaagaaactgttataatcttgacacccaaacttgatttacaggtttgattgtgtttacatttggattgagaaagccctcaaatacaggatgttaataaggcaactctagccctgtagtaaagaaataaatagtgcttacactaagaaagcaaagataggttattattttaaaacctattaatatcattcaacacattaatatgttagagaaagtcaatgataagatccttttaaaataaaaactaaacatataacaaaaagaattccaggccggccacggtggctcatgcctgtaatcccaacactttgggaggctgaagcaggtggatcacttgaggtcaggagttcgagaccagcctggccaacatggtgaaccctgtctctactaaaagtacaaaaaaaaaaaaaaaaaaaaattagctgggtgtggtggcaggcacctgtaatcccagctactcggtgaggctgaggcaggagaatcacttgagctcgggaggttaaggttgcaatgagccgagatggcaccactgtgctccagcctgggtgacagagcaggactctgtcaaaataaataaataaataaataaataaataaataaataaataaataaaaatccacatagattataaatatagaggtaaacatttaaaacatagagaaatcttagaagaaagtagatgaaagtttctcagcactgctgctatctgggactggagggttccatgtggtggggtgtcctgtgtactgcagggtgttgagcagcgtccctgggctccgcccaccagatgccggcaggagttggcagttgtgacaactaaaaatatctccacatgttgatgaaggtggatgttttgttcatctgaaagctggaaatgctggtgtaaattaaacaagatggaagaggacaccagaactgctgtgtgtcagagatattatgtgttaaagataaaacaaactgagggccacatttaaaatattataatggagaggttcttattgtccatcacgtacaaagaactctgaaaacactttaggggtttgcacgggctcgtctctagcacgccagaagcaaagatagacagacaaatacaaaaataggtattaaacacgagcaactggctgggtgtggtacctcacgcctgtaatcccagcactttgggagactgaggtggacggatcacttgaggtcaggagttcgagaccagcctgaccaacatggtgaaaccccgtctttactaaaaatacaaaaaacattaaccaggcgtggtggcgcctgtaattccagctactcgggaggctgaggcaggagaatcgcttgaacctgggaggcagaggttgcagtgagcccagatcgcgccacctgcactccagcctggtgacagagcgagactctgtcaaaaaagaagggaaaaaaaaaaaacctgactatattaaggtccaaaaatgcaccagtgagtggaaaggtacacatagcacatccagcaggttccgtgttttattttaaaagccggcgggggcgacggggtagaaaaatgctgttaaagagtgtaattgagttgcttgtaacacaaaggataaatgcttgaggggatggatactgcattttccatcatgtgattattacttattcctgcctgtgtcaaagtagacttaaggttcactcaagaggaactttaaaatattcagaaacaacatggcagaaatcgtgggaaggttcagtgttgcaagtcgggttgaggttttgtgggaccttttattatatgtttcgtagtcatggggagaattgagggatggcgctctgcggtggtcagggcagtggaagacgagcagtgagcaatgaccgtaaatgaccaggggtgtgggtggtgggagatcgcccctcccccaggctgtgtggtacaagcgtgttatggagtgatcttgcagggaaacctgctttaaactaattgtattcatgaaacataattctgcttccaggagtttattttagggaaatgagcagagctgaacaaaaagatgtaaggacataaatggcagtgccatttgtagtgaggtggagtgctgtttctcttgccctccccccagcccggatctttacgcaactgtggtgaagatgccataaattccataaataactgggccaaaagcagagggagatttgctgaaggaagggtactttttcagagaaatagttaccttaaatacagagcagtgaaatcttacaaataaatgtcgagtccaagagaaatgctaagagatagaaaaggtccgagagcttcaatatctgtcaaataggagagaaagaaaaagaaagaaagaaagaagtaactcctattatatttcagctctgagacaaagtttagattgaaagtgttccagatattgagcagagtggatgaagaaagctcaaatgtagacaccaagtggtaaaatttcagagcagcaaaaatgaagaaaaatcctaaatgcctttctgtatcaatctggttgtgacaattgatgtctcaaaattctggtgcaagataactttgaaatgaaagttctgtattcagctttagtaccgtaatttgaaagcaaaacaaagacttttcaaatttgcaaacgttaaaaatgttatccctcaaagatctttgaggaaaaagttagttgattgactcctgcaaaatggaatgtaatccaagaaaggcgagagtagccaagcacagtggctcatgcctgtaaccacagcattttgggaggctgaagtgggaggatcgcttgagttcaggagttcaagaccagcctggacaacatagtggggtctcatctctactaaaaaatttttaaaaattgctgagtgcagtggcacatgcctgtagtcccagttactcaggaggctgaggcgggaggatcactggagcctaggacattgaagctgcagtgagctatgattacaccactgcactccagcctgggtgacagagcaagaccctgtctcaaaataataataataatgataatgataatgataataataaatagaagagagcacacaggaagcagtgctgaataaataaatgtataaaacagagttaagtctgaatgtgttagtgcacagttacgaaaataatctggaattaacatttcacatgggaggtaattgaaagagcagagaagaaagaatgagcatatgttcatgtttttgtttcgtctgggaagaagacataggtaatgactatatttgatagaaaatataagcttaaatacgtgtgctgacagttgaaaggtggttaccaccagaaaactagaaaagatgtgtacaagtttcagagccttaatgggaaatgcgtggattgaagaaaacctgattcatgcaatcagaggtgggtgggaaagaattacactgatgtcaggcctctgagcccaagctaagccgtcatatcccctgtgacctgcatgtacacatccagatggccggttcctgccttaactgatgacattccaccacaaaagaagtgaaaatggcctgttcctgccttaactaatgacattatcttgtgaaattccttctcctggctcatcctggctcaaaagctcccctactgagcacctttcgacccccactcctgcccaccagagaacaacccccctttgactgtaattttccttgacctacccaaatcttataaaacggccccacccctatctcccttcgctgactctcttttcggactcagcccacctgcacctaggtgaaataaacagccttgttgctcacacaaagcctgtttggtggtctcttcacacggacgggagtgaaaactgaagaaatagaaaatctgatatatgtaaaaaagggaaaataatataaaatgaaactgcaggactcaatccaaatataaccgtgatcataataaacatgaatagattaaaattcctttttaaaaagataggctttctgaatgggaaaataaacataaaatccggacatacagtagtgtaggaggcagcttaattaaaaacaaacaaaatgttgaaaataaatggatgcatttgatatgattctgttccactatccaatctaagtaatggtcaattgttttatagattgttcttcagttgtttgttgttgttgttgttgttttgagacagagcctcgctctgtcgcccaggccggagtgcagtggcacgatctcagctcattgcaacctctgcctcccaggttcaagcaattctcatgcctcagcctccagagtagctgggattagtttcccgccaccgcacccggctagtttttgtatttttagtagagacggggtttcaccttgttggccaggctggtctcgaactcctgatgtcaggtgatccacctgcctaggcctcccaaggtgctggaattacaggcatgagcccctgtgcccagccttcagtttggttttgtccagtgttttctcatgattagactgaggttatgcatttttggcaaaaaaatcatcagaattgatgtaagttttcagtgtgtcatgctatggagtgcatgatgtctgtatgtcctgacctggtgatgttaaatttcatcacctggattaagtggtgtctgttggaattctccactgtgaaattattatgtttttcttttagtaatggaaaatatcttggcatagacattatacaaacagcctgtttcttctctaaaaatcagtgagtcttgtctgcaacagttgttactatagtgtttgcctaatcgtggttttctacttccctcattccttctatttcaattacttggaattatcttctaaattaaacctgccctttctttctcacatatttgtttattcaatagttatattaggtcaggcgtggtggctcatgcctgtaatcccagcactttgtgagactgaggcaggcagattgcttgagcccagaagtttgagacaagcttcataaacattgtgaaaccccatttctaccaaaaaatacaaaaaattagccgggcatggtggcatgcacttgtagtcccagttacttgggaggctgaggcaggcggaccacttgagcccaggagttcgaggctgcaatgagctatgattgcaccactgaactctagcctgggtgacagagtgagaccctgtatcaaaaagaaaacttatattagtgtaggctcatgaatatttatttcatattttgggcttgttgttttttgttattgattacattatttcagctttggcaattgggtgcttcccctagctggccccctgtattctttcaatatgcccccatccttttctagcacttgcttaatttttctgtcatcccaatatgttccagactatgatgaagtgggatttaagcaaaaataaataaataaatggaacagagcaaatttcactttgataaaatggacagtctttcaagcttcgagtctcaaacttgtatgcaactaacaatgtaagctttgaatacagaaagtaaaaattgatagagattgttatggacatctgttagtttctaccagctcagcatttacatttctctgcctctgcagcttacagagggaaactgtcttcctaagagctggcccaagtgcatgcatcttaagacagttctgttcaatttgtcacatttttcaagtatgcatgcatttctttttcataatattaatatttattactatatatgaatactagattgaaagcccaagcattcagtttacacacagaaattatgcaattatatatcgcttcacaaaggcagtgaacacattacattctacaaaatctacttcacagaaatttaaaaattctaaatatcaaaaggtacagctgaagaaacaggtataaatttggcagccagtaattttgacagggaagttgcagcttgcatgactttatttttttgtttgttttttgagacagagtcccactctgtcgcccaggctggagggcagtggtgccatctcggctcactgcaacctctgcctcctgggttcaagtgattctcctgcctcagcctcttgagtagcaggaattacaggcgcccaccagcacgcctggctaatttaaattttttgtttgtttgtttttgtttttttgcttgtttgttttgagatagagtctcgctctgttgcccaggttggagtgcagtggtgcgatctcaggtcagtgcaatctccgcctcccgggttcaagcgattctcctgcttcggcctcctgagtagctgggactacaggcgccaccacacctggctaatttttgtatttttagtagagaaggggtttcaccatgctggccaggctgatcttgaactcctgacctcaagtgatccggctgcctcggcctcccaaagtgctgggattgcaggcataagccaccgcgccaggccttgcatgactttaaatatatgaatatgaaaatattgaacttagagtaatcattgtgctttgtgttgattgaaaaatataacaatggctatcaaagaagcatgttcaaagatgcttaattcacttcaaaatgtcatacaaattgtggtggtttctatgcacctctaaagcttccgtcatttagctcaggtacattactaaagtaatatattaattctaccggtacagtggggtttcacaccattggcatttgcattcaagcatgcagaggcttttgggcacaagtggacggtgtgcacagctctaagccatccgtggaaatgtgctctgaacatggagaccgcagtgagggctgtggggattctctttgcattccacgtttgtgagcagcaaaacagcaccctcttgaaggaggaggtggttctgtgctgaatattcacccgctgtcccactatttggcacatgtctgttccagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgagtgaagactctctgcttgataggaaaccctccaagaccacatctctatccttaagcaggctgtcaacttttttttgtgtgtgtgtgacacagtcgctctgtcacccaagctggagtgcaatggcacgatctcggctcactgcaacctccgcctcctgagttcaagtgattctcccacctcagcctcccgagtggctgctattacaggcacccgccttcatgcccggttaatttttgtatttctgtacagactgggtttcgccatgctggccgggctgtcacctcttactggtagattcctgtgaggccatgtgcatttctatttctaacacagatgttcagtctattataatcaggcataacatacccccgagcactgtgctagaccctgctgaagagaacaggggattggaagacatgttcctaccccaggaatgaattataaccacagtattttacacgcacaaaatagaatcatgagggaaaaaacttgtgactgggcacagtggctcatgcctgtaatctcagcactttgggagcttgagatgggtggatcacttgaggccaggagtttgagaccagcctggccaacacggtgaaaccgtttttactaaaaatacaaaaattagccaggcatggtaacaggtgcctgtaatcccagctactcaagaggctgaggtggggggatcgcttgaacccgggaggcggaggccgcagtgagccgagactgaagcactgcactccagcctgggcgacagagcaagactctgtctcaaaaacagaagcattggtaaaagaagcattgcggcgggttctgcgtgttttgcttcaccaggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggtaagtcagggcagcccggacgcttagggtctctgttgcacacactcaactctgcagatgtaacacgaagtcagccgttgaccatacagtcacacctcgctcagcgacagggatgcggtctgagaaatgtgttgttaagtgattttgtcattgtatgaacgtcccagagtgtatctgcacacacctggatgatgtagcctactgtatacctaggctggagggtacagcctattccttctaggctacaaacccatatagcatgggagtgcactgaatgttgtaggcaactgtaacataatgggaggtatctgtgttctaaacatacctaaacatcacaaaggtccagtgaaaatacagtataaaatcttatgggaccaccgtcagatgtatggtctgtctttgaccgaagcacttttatgtgttgcatgactgtacttggcattgaacatgggctggccgtggtggctcatgcctgtaatcccagcactttgggaggccagggcggacagattgcttgaggcgaggagttcaagaccggggtgggcagatggcttgagaccaggagttcaagaccagcctaggcaacgtggcaagaccccatctctacaaaaaatacaaaaataagctggatgtgatgctggcacctgtagtccccaagccctgggaggctgagttgggagcagcagctgagctcaggagctcaagcctacagtgagctatgattgcaccactgcactccagtcaggttgacagagtgagaccctgtctcagagaaaaagaaaagagcatggctgtgttccaataaaactttatttataaaaacatgcacagtgtgtagttgcttgacccatggtagaatatagggagaattaaaaggaggcaacctgaagccgagtatttgttgaaatgggcgtcagtagagaggaaatgtgctggaatttttgtaaagtaaaagaaaatactggagcagtgaagaattgcctctaggtaaaggggaagttaatgaaactggcaaaaatgatgggaaaagcattgtcactaccagggagaattcattaggggaccagtggaatgctttggactccatatgcaattttagcattcattctggggactcctggtggagaattttggagggaatatgcacttatttttatcaatggcttgggttatcagtcttttctgagaaccaagagaatgtgtgcagctggcagacagaagaaatggaattagtaaccctgaaggcaagtgtttatgttgagagcttcaggcacatctcgcattcttggagtgaaccaagccatactttgctaacctgcttttgtgtttgctcattatgtaggggcagaccaaggcttactgaatagtttcttcaggaactggtcgaccacagacatccacaagcacctgccgttcatctataacttgagtagtaacacgatgtacacttacagccctgccttcaagcagtaagttctccaccctggcgaatcctgccagatctgccactaccgatccaccttccctcctggaagacataccagctgtcggcatatttaaaaactctatctatctatctatcatctatctatctatgtatctatctatctatctatctatctatctatctatcatctatctatcatctatctatctatcacctctatctaggtagatctaaatatctatttatctgtatagatagatacctatgtctatgtgtctgtgtatctagatctctatgtctatctatatagatatatatctgtctatatagttatctacctatataggcctagacatctgtttatctatctatctatctatctatctatctatctatctatctatctatccatatctatctatttagatctggatatctatctgtatacatagatctatatatctatatctatatatgtatctatatctagatctagatatctatatacattgatctatctaatctctatatctatgtagatatttatctatctatctagacctagatgtctatctatctagacctagatatctatctatctagacctagatatctgtctatctgtctaatctatcatctatcatatgtatctattcagatagatctggatatctatctataaacatcttatctatctatctatctagatctacatcactatatagatacctatatctatctatctagaactagatatctatgtatctagatatccatctagatttagatcttcatccatatagatatctatatctatctatctagatccagatatctatctatatacatagatctatatatctatatctgtatatctatctagatctatctagatatctatgtatatacatggatctatatatctctctatgtatctagatctagatctctctctatatagatctatgtatctagatctagatctctatataggcatctatccatctatgtagatctagacatctatctatatattaatacatagatgtatctatctatatacgtctttatatatgtatatacacacacagaaacacacacacacatctcgtttcctgcttgcttgttgctgtaaatgatagctagccaaggctctacgacaatgatccccaaagtgtggcccaaggaaccctgaccccacaactctttcaagtgtcttcaaagtcataactactttaaaaaaagaatttgaagatgtgatttttttccctttttgctgccattttctcatgcatctatgctgagagtttacagacactacatggcatgtgataaggtaataccctgaacacagatggagctaggaagaaccagctgtcgcctcttgggaaaatggatggcactcttctcacaatgattttttttaatatagaaatttttttaatgaaaaattatgaaatttatgttactgcataatggtttgattttttttaaagggattgataaatatgctttctaatttctcagttttaatatcgattattctaaatatggagagagagaatccacagggacatggccgagcacagtggctcacgcctgtcattccagccctttgggggccgaggtgggcggatcacttgagctcaggagtttgagaccagcctgcgcaacatgatgaaaccctgtctctacgaaaaaataaaacaaaacattagccgaatgtggtgtcgcacaccgctagtctcagctactcgggaggctgcggagggaggctcacttgaacctgggaagtggagtttgcagtgagccgagatcgtgccactgcactccagcctgggtaacagagcaagcctcagctcaggagaaaaaaaaaagaaagaatccacacggacaaagctctttgggttcctaaaagggtcaagggtgaggggaccagaggctgtgaaattcactgctccagaagatatggctataaatgaaaatagagaatctgagaatcaccttgggaatgaataattctagagtctgcattctctacagaggacacggtgtccctaaggaagagaaattgattcttgggagtgaaatcttgttattttttactgtataatcacagatgtaatgtacagaacatagatatgtcatgtgacttttgtgttcatatttcatgaggaggtgatccacgaaaaaaaagtttaaaaaggctcctggaggatggtgatgatgaacaacaaaaaagttggcaaggggaacatttagaatcctgtaaaagagaaaaaaagccaattgccttgccgcttgcattagccactgtaaaagctatttttttttgcccctgtcgttttaaggatatgatgatttgggctgctgtacttcacgtttttacaaaactgatttatttttcccgttttgggaaaaaatgtcaatggattacgattatgttttttgatatatagaaaataaaataactgcaaaaactgtgatttaaaaaatatatctttatgcaaaataactgcaaatgaaactactactactatgctgatagcagtggagtagtattattgatgatatattgattactatcttgatagtagtggtatgctagtattgctcagatattgattactgcattgatagtactagtatattattattgattatatattgattactatagtagtgatagtattttgttattattgatcacacattgattactgaattgatagtagtagtatgttactattggttatatattgattactatgctagtagtagtatattgttgactatatattgattactacattgatagtggtagattattattgattatatattgagtactatgttgataatagtagcatagtattgattacataacgattactacattgatagtaatatattgttattgatcatatattgattacatgcattgatagtagtagtgtattattattgattatatattgatgactatgttgatagtagtaatcttattatgggtcatatattgattactgcattggaagtagtagtgtattattattgattatatattggttactatgctgatagtagtagtatcatcagtaataataatcaataatggaaacccattgggacaagtccttcagaggctgtctttgaggagccccatggtaggtggatgctttctgggtgtcttttatcacatctgagtggaaatcagaatcccttctgtttccttctcagattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacagtaagtgggggattcccttaaaacccgtagctgaggacgaggagaacatccttgtcaccaaggtctggcgtggtttttttttgaaatgccccttttttgtctaaatactgtatttcatggaaaagaatactgagaagcaagcacctgttaaaaaaatttttaagttttagctcaaaatagagaatgcctaatgactggagatcctgttttgatgtgtaggcctggtgcagaaataggttattgaaattagccatcctcatcagagtaagagacactcatggacaagtggttcacaatgactgattacgacgtcattcgggtcaacactttccacttgaaaccatcatttgagatagcagttggaggaagtgtctgaagaggattttgtaaagttttgattgacaccaatttgattgcaaagaatataatgacagcccctcggtgtgctaaatggtggagtatctgcagtgtgctgaatgtaggctgcatctgccttgcagaagacctcttgcaattaggactcaggaaacttcttattcctaatggcttttttcactaaagtaaaaaaaaacttgagcttttttttttttttttttttaactagagcatttgtactagagtaccagagtattttttaactagagtaaagaaaactagagttttgtttgtttgtttgttttttgagacagagtctcactctgttacccaggctggagtgcagtgacatgatctcggctcactgcaacctccgccttctgggttcaagcaattctcctgcctcagcctcccaaggagctgggattacaggtgcctaccaccacgcccagctaatttttgtgcttttagtggagacggggttttgccacgttggccaggctggtcttgaagctctgacctcaagtcatccacccgcctcagcctcccaaagtgctgggattacaggcgtgagccaccaagcccggcctttttttttttttaactagagcatttgctagtacaacagagtctgctatcagcacatgcattgcctgggaaattgaaaagaatccctattttaatttttagtatggttttttatttgggtggatctaggctgctttttaaggactgctgaaaatttctctcaccgagtgacactagcaatggacgtttatttgtattcacttcacaaacattgacttgtcacatatttcctgctgggcgttttgctaagtactggattattaagtactggattactaagtactggattactaagtactggattgcataggagggaattttaaggcttagtgtcaaacggtcctgagaaagaaaacatttaggacaattatttaatgattggcagatgggagctgggagccctggctacacagggccccacccgccccccaggacagcaggtgaattgaggagacatagggaagactcactccacgtgtgtgtttttgtgcagctttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtaagtacctgcattcctcacaggtgtgatagtcagacgctggctcgcagtgagagagcagagagagccggcttccctggctccctggggaggggagatggaggggaagggctggtctttggcttgctgtggcattcaaggctctgcatttatttttgcattacggcacaccgaatcaagctcacctgctgaaagatgtctatgccccaatccctaggacctgtgaatgtcaccttgtgtggcaaaagggcgtttgcagttgtgattaaatgagggaccctgagctggggaggtatggtcttggattctgggagtgggctcttagtcatcacaaacctcccttcaaagaagaaggtggaagtgtgaaggtcagagaaggagtgtgaagctggaagcagaggccagagagagaggggattggaagacgctgggctgctggctttgaagatggaagaggaggccacgagcgagggaatatggtggcctccagaagctggagaaggcaggaaatggattctcccctaggtccccaagaaggaaccaaccctgccgacaacttgattttaatccactggacttctggcccccagaactatcagatggtcagtctgccttggtgtaaaccacccagtttgtggctgtttcttacatagcagcctcaaaaatctgatgccacaaggagacagatgctcagtctctcgcagtttacagattctgggggagccagagctctttcaggttcaaaaagggaggcttccgtcagtgccccctcaacccaactgcctggccgtgcatcctgagaggtttcagccgaacccctgacttgaacagtggttgaagtgaagatgaattcctgccggggttcaatgttcaaatgaatgttgacctgcacagtggtgtctgctgaggccgagtctgcagcactttgtccccatcgaagaaaaatgaaaatacaccttacttgcaaaacaaataatggaggccgtcatttctccagctccaatttctaggtgaatactttggaataatatcttgtgtttaaagatttcctggggccaggcacggtgactcaacacctgtaatcctaacactttggaaggctgaggtgggaggattgcttgagcccaggagtacgagaccagccggcaacacactgagacctcatctctacaaaaaaaagtcaagaaattagccaggcatggatgtgtgcacctgtagtcccagctacttgggaggctgaggcaggaggaatgcttgagccttggaggtcaaggctgtagtgagctataatctcaccactgcactcccgcctgggtgacagagcgagacactgtctcaaagaaaaaaaaaaagaaatcttttttttttttgaggcggagtctctctctgtcacccaggctggaatgcagtagcccaatcttggctcactgcaagctctgcctcccgggttcacgccgttctcctgcctcagcctcccgagtagctgggactgcaggtgcccgccaccgcgcccggctaattttttgtatttttagtagagacggggtttcactgtgtcagccaggatggtctcgaactcctgaccttgtgatccgcctgcttcggcctcccaaagtgctgggattacaggcgtgaaccaccacgcccggcaagatttcttgttttaaatctttaccactgatcctaacaagtttctcaacagaattattttgagatcatacttagggaaggatctggggactgggctgaaggaaagtgattcttttctgtatacttcagatagctccgggagagccgtttcttgttgcttataaacaagtgacctttagattttgcacacattgctctggaagacaccacacgcttcactgtactctggcgtaaattatgctctggcaactttatgcatgaagaatgtcggagtggtgatttcacattgacccaaacacattgaaaagatgtttaggttcagatggtgaagactgaggaggtgtaaaatgcgcttttctggtttttcattcctcatggtgtgccctgagcataccatagcctgggcctggccccaggacgtgcctcatgcgagtcaagtcaagagcctctgcttgttcctgctggaatgtgaagaattccatcagtggagcccttacatgatgtgcaaaacggctgcaattgtgctgagccatgctcgtttcaggatgtctaaggaaaaatcgcatttacattaaatgtttagtaggcaaccaagtttagactgtaaaccaaagagtatccaagaatgctgtggcattcaaggctcatgcttttatgtgcattacagcaccttaaggccaataaaggggaactcccatcccctgttgatgtgtattgaaaataattgaatgctcaaactcctagcctaaaaaagaaatattatcgaatgcttcgaaaacataaatttaggaagtgtattttgccaaggttaaggacacacccgtgacacagcctcaggaggtcctgacgacatgtgcccacggtggtcggggcacagcttgcttttatacaatttagagaggatgaggtatcaatatgcgtaagaagtacattggttcagtccggcaaggcgggacaactcaaagtggggcgggggcttccaggtcataagtagatagaggcaaatggttgcatttttttttttttttagtttctgattggtctttccaaaggaggcaatcagatatgcatttatctcagtgagcagaggggggactgaatagaatgggaggcagaggccctaagcagctccgctcccagctggacttttccctgcttactgatattggggttccaagatttactttcttcacaagactctattgagtcctcagaaaacggttttcaaaccatctttctgatttccggttgcgtaattttaatcttattccgtcactgaatcttgtacattagtggttttgcaaactatggcctgaggtctctctgaataaggatcattttaaaggattgtgtttttgcagatgatcttagaagcattcttctttttctttctttttttttttttgagatggagtctcactcgatcgcccaggctgaagtgcaatggcgcgatctcagcagctcactgcaacctccaccgcccgagtccaagcaattctcctgcctcagcctcctgagtaggtggacaggcatgagccaccacacctggctaatttttgtatttttagtaaagaccgggtttcaccatgttggccaggctgttcttgaactcctggcttcaagtgatccacctgcctcagcctcccaaagttctgggattacaagtgtgagccaccatgcctggctattaaaaacattcttaacagtttattctgaaccacagtgagcactccctcattcgtaagggcagccaccctctttcagaagcaagtgtgtattctccacccttcagcccctggagggatttccacggattgtcacagcccctgaaaacaagcttcccagggcaaacagtggttttccagagactccaaaagggaaaacagtcaggacgctccagtcccagctccagcccaagttgtagccacaccaatctctgcaaaaacagaaccatttccagagtgacagcacttagcactctggtttctctaaaacagcgcccgtcatgttcaattcatattaatctcgatggaattgttgccgtggatttttcttgacataagtcacttctacttttactttggattcataattgtcgatgaggtggcaacttaaacaatagatatgtagcttcgtgtttgtccgtccgtgagccacctttcaatcagagccagtcaagccaaacctaggagagactttcccgtggagggattggggcttctgaggaaagctcatggagagaatcgtgatgacagaattgaggatcatcctgccttgatgcccaaggaggtaagcaaggacacaaaagcacgctcatttcaccccagttaggtggtgtctattatcaaaaagacaaaaaatatccactgctggtgaagatgtggagaaaggggaactcttttccactgttgatggggattaaaaataagcacagccaggatggagaagagtatgaaggttcctcaaaaaactacaaatagaactaccacatgatccagccatcaccactgggcatttatccgaaggagaggaaattagtatattgaagggacatctgccccccgtccatgtttttgcagtttattcacaacaggcaagatacagattcaacccaagtgtttgccaaaggatgaatgggtaaagaaaatgccatgtatagatataccatggaatactattcaaccataaaaaagaaggaaatccatcatttgcagcaacatggatggaaatagaggacattatggtaggtgaaataagccagaaacagaaagttaaacaccacatgttctcactcatctgtgggagctaaagaaatttaacctcacagaagtgaaaagtaaggccaggcacagtggctcactcctgtaatccctgcactttgggaggctgaggcaggatgattgcttgagatcaggagtttgagaccagcctgagcaacatagcaaaaccctgtctctgcaaaaaaatacaaaaattagctgggtgtgcggtacttgccggtggtcccagctactcgcaaggctgaggtgggaggatcgcttgaacctgggaggtcgaggctgcggtgagccgagatcacgctgctgcactccagcctgggcagcagaacaagaccctgtctcagtagaagagagtgtactagagactaggaaaggtgggggaaggagaagatagggagagatttgttaaaggatacaaaattacagctagacaagaggaatatgttgtcatgttctatagccctgtaggatgactatagccaacagtaatctatagtttcaaatagctggacggaggatattgtatgttcccaaaagaaagaaatggtacatatttgacatgagggatatgctaattaccctgaccggatcactgaatattgtaggtattgaaccatccctgtgtaccccatgaatatgtacaattattatgtgtcaatttttaaaaagtaaattttttttttttaaaaaaaagtatgttcaacagccagcagccacgagaaggtcatcagctggtttcatccacagcaagagattgctggctccaaatccccaccccatcctcaaggggcaatattgcagaaaggaggagggtgggaaaaaaatctcaagaattggagaatcgccggtttccagggcccagaacaagacccaggaggagatgaagatcacccttgcaggtagaagctgtccctgtctgggtagtgctggggacagtaggtggcccttctgctgtctgtctgagcatgagctcaaggccaagggtaagatgaggggaaatgacccccagctgggctgagcgtactttgtttagggtatttaagcagttctcaaaagtgattgcagaacctgtatctcccatctcagggactctgcccagcctcacccctccctccaccccactgtcatgcccacgcttaggcttcaaaacatcaatggaagatgatagtgcagtgcccaactgcaggcccttacatgaataaactgtacatcacagagggggcggcaagggaggggaaaacagacagatccagctcagatggaatttgatctgaaggaaagtgataaagtgaagaagggatctgtcagccctgcaagcggccccaggcacagcgtgaaggggaggcagggagaggtcatgctggcctcagacttggacgctgaaatgtttagttacagccggaggggggacgcctgcataggtcctagggaaaggaggggacacccaggcattggagacccactgtgtagacgactgcgagacatgcttaaatatttagcagaaaggaagagaaattcgaatagagagattcaggaatgggaggaagggatggaggtgaaatcaaagctgtttaaatacagatgctcttcgatttacaattggtttacatcccaacaaacccatcgtaaactgaaatatcttaagtcaaaaatgcatttagaccaggtgcagtggctcacgtctgtaatcccaacactttgggaggccaagtgttggcagatcacttgagctcaggagttcaagaccagcctggccaacacggtgaaaccctgtctctactaaaaatacaaaagttagccaggcttggtggcgtgcgcctgtaatcccagctactcgggaggccgaagcaggaaaatggcttgaacctgggaggcggaggttgcagtgagctgagatcacaccactgcactccagcctgggtgacagagcaaaactcagtcccaaaaaaagaaaaagaaatagaaatataagcataaacttaaataactggggagcgttatgttggctgactgcaacacagatacgaaaaaccctgacagaataaaaagaattctaaccaaaaaggtattttgggccgggcacggtggctcacacctgtaatcctagcatgttggtaggctgaggcaggcagttcacttgagctcaggagtttgagaccagcctggccaacacggtgaaaccctgtctctgctagaaatacaaaaattagccggaaatcgcttgaacccgggaggtggaggttgcagtgagctgagatcgtgccagtgcattccagcctgggcaacagagtgagactccgtctcaaaaaaaaaaaaaaaaaaaaaggtattttggagttcctgtgtccacataatttcatccttcgatctcaccccctattctccccacctctccatcctaaggtcggtgaatactgcgtcggggaaattgacctaaaaaaatttgttatggtctatatattctctgatgagggtatttttctaaaagcaatgaagtcttcaggcttttaaaaggaagggattggggggcgaggggagggagagcatcaggacaaatagctaatgcatgcggggcttaaaagctaggtgacgggttgataggtgcagcgaaccaccatggcacacgtatacccgtgtaacaaacctgcacatcctgcacacgtatcccagaatttaaagtaaaagcaaaacaaaacaaaactctttttaacaaaaggtatgttgattgattggagattattatattacggtcacattttccaagataatatttgataacactgaacaaggagttgaaaatttgagctgttttgtatactagttatgtgactttggataaatcaataaatatttctgaacatcttaaaaaaaaaaaaaagagggatgctgtccatacggtatctgatatatagctcaccctccgcatctatgggttccatatctgtggattcaaccaaccttggatcgaaaatattggggaaacaaaattgcatctgcactcaacatgcacagacttttttctcttgttattattccctaaacaatacgacatagcaggtatcaacatagcatgtgcattgtaataggtatggtaattaacctagagatgatttaaagtctatgggaggatgtgcattgcttatatgcaaagacagttccatcttgtatcagagacttgagcatccgtggattttggtataaccaggaggtcctggaaccaatcctccatggatatcaggagaaattccatttcattaattcgtactcccggtggtctttgaaatgagtcgtgcaacatcactgtcacctgctgtccatttagtgagttactctgggttttttatttaggggagctgaaacacagatttttaaaaaaagtttattttcataaatcgcaataatgtcataaaagctgagtgtgcgtctggggctctttagtccagtagctactttggtatatataatgatggcaaggttgacgtgttttggttttgttgttgttgttgtttttgagacagggtctcgctctgttgcccaggctggagtgcagtggcacaatctcggctcactgcagccttgacctcctggactcaagtgatcctcccacctcctcccaggtagctgggactacaggaggtgccaccacacctggctgatattttgtattttttgtagagatgggtttcaccatgtttcccaggctactcttgaattcctgggctctagcgatctgctcatcttggcctcccaaagtgttgaaattacaggcgtgggccaccgtgcctgccccagatctgtgttttttaaagtaaagctgaatattaattttttccacatacattaatgtattaaggaaaaagttgcaattagtatcttctccagcgttttgtcttctagtatttggggtagggaaatgtagttaattaaaagattacagatgtccttcagtttttttttttttaagctatcaagtttttttactctttttgtagtgcatcttattttattcataatacacctttttgttgaagtatgtcttacttttttatttatttatttatttttttgagacagagacttgctctgtcgtccaggctagagtgcactggtgcgatctcggctcactgaagcctccgcctcctgggttcaagcgattctcctgcctcagcctcccaactagctgggactacaggcatccgccactacacctggctaattttttgtatttatagtagagccgggttttcagcatgttggccaggctggtctcgaactcctgacctcaggtgatccacctgcctgagcctcccaaagtgctggcattacaggcatgagccaccacgcccggcctctactaacattagtagaaccgttgactgtgtcccatatatctatgacacagttatctgcattttctgtcaatctttctccccatacttcagtctactgacctattttctagttaactgatctctttggctatgtctaatctgttgttaaacccacattctagcttcagttattatgtttttagttcaaattaacatcagatttttagttcaaataacatcaatgtagtttcaatactaccttgaaaatttttatctttttccccatcttatttaaagtatttctcacatttaattatagtccatgtctgataaattacatatctgggtttcaggtgggtttggttttgttgtttaattttgcttgctcttgattttcactcatttggtcttttcttgttgtatgatagttaattttttaattgacagccagacatggtaaatgaaaaagaattgcaaagacaatttgtagctctgaatcatattatcataacccaaagaggatttttttttttaattcatgtgatttgatgtgatttgtccataccctgaggtagtttgcccagaccctatctggggctgagctggagggaaattgggcttcagtgtttgtgatgaccagtctatttctggttctcctctcagtgaggtcacaaaagaaagcttgtggtgtgtaccagggtccctcattggtcctgattattaatatttatggacccctcagcctcctagcactgctggcaactctactcagtttctcagcttcccagcctcttatttgccctgagtggaagtaaggtaccaaatgtgacatttacctcttctgtttgtctctggtatcttcactcttaattttgtgctgccttagtagctctctgatgcacttaaaaaaaaaaaaaattctaggccaggtgtggtggctcacacgtgtaatgccagcactttgtgaggccaaggcaggcagatcacctgaggtcaggagtttgagaccagcctggccaacatggtgagacccccatctctactaaaaatacaaaaactagctaggcatggtggcacgtgcctgtaatcccagctactcgggaggctgagacaggagaatcacttgaacctgggagggagatgttgcagtgagccgagatggtgccactgcactccagcctgggcaacagaacgagactccgtctcaaataaataaataaataaataaataaataaataaataaataaataaaattctatatacattatttgtgcagcctttttaggtatttttggcagaagacttagtgtgaaacaacagcttcaccatttgctgaaagtggaaaaaatctcatttcagttcctgagctgatacatatatatttgtatttttagcattcaccacctccagcagtaataactttcacaaatttatagcccataatgcaaaggagtgcttccttttttgctgtaaatgttatctccttggattgtgtactggaacattctgtgtctgctgtctatctgttccctgcctcgtctgcctttacgatgtcctctctcagctttcatcttcccacacagagcattttgttttaagcatctctgcatatctcagcctctttccaatgacctgagaattcttctctggcctgcctccagtttcagagtcccttctttcaaggtgaccccatcttcagtcaggcttttaggggatacatcagtagaatagttattacctaaggataaaaagaaatgcagtttgtaaaagtcacattttatattcatgcattcacaagcttgccaaaaatgttcttaagagcggactttgagattgctgcattctcatcttaaaatttctctctgcatgatatgcaagggggaagtgtctactttttactagtaaaaataatggccatatttattcataaaagttggtttatgtttcggctgttaatattacttgttaagtaagcctctgggtcttgattagaaacattagcaagggctgactgaacttctcttcctcgtttaaattcgtaagattaacacatctgcagaaggcaagctgagaacttgcatcattatttcatcctctgtaatcaaacatataaccccgagttaaatcccttccgaggaaggattatacttcatgatcggccccgtggaacttatttatgtgtttatcgttgggagaaattagatgacagaaacagattgacattttccctaatccatttccaggaatggttttttgagcacttattctttgcctgtctggctgcttcatttatccatcacaataagtgtctgtgtgacatctcactgaaagccccatgactcagagagtcatttctgcaggtccttttccttgatgggtcagtattcaaatccaggacatccctctaccagccctggttgaagaaggaaattattcatttttatgggattcatatggtttatgataatgcagttattgcattcgtcattttttcccaagactcattttggtgttttgcaaggcgcatacccaaatcccgctctctcacttgctagttctcgtatgttgggcagtatctctgtctgcagattaaactttgcagcagtaagagggaaggctcaacctgtctgcctcatagggctgtcgcgattaaaaggaatcagggctgagaagtttatgagtgtcactcagcagccagccatgagcagccactaaaaaaggagtcctgttatcatggttgtctgatatctttgacaacttataattttgtgttacaccataattcttagaacttaattttatatttggattttacatacatagctgagatctgaaagaagaagcccatattttatttaatgttaatttttaaaaatttctctccagctgtattgaggtaccactgacaaataaaaattggtgtgtatttaaggagtacaatttgatgctttgctgtatgtatacattgtgaaacaatcattgtatcaaggtaattaacattttcatcacctcgcataaatgctgttttctcctcctcctcctcctcttcctcctctttctcctcctcctcctcctgctgctgttcttggtaatgagaacacataagatctactctcatagcaaattttaagtacacaatcctatattgttaactgtggtcaccatgctgtatgttagatccccagaacttatttatcttgtgtaactaaaacttcatattcattccttcaccaacatgtcttcattctaagcaccccgcccccagcccctggcaactactgttccactctattcttctgtgagttatttaaagtgcactttcggaggctgggcatggtgactcacctgtaattccagtactttgggaggctgaggcaggcagatcacttgaggtcaggagttcaagaccagcctggccaagatggtgaaaccccatctctacgaaaaaatacacaaaaaaaattagctgggtttggtgatgcatgcctgtaatcccagctactcaagaggctgagataggagaatcacttgaacccaggaggcagaaggttcagtgagccaagatcatgccactgcactccagcctgggtgactctgtctcaaaaataaaataaaataaataaataaataaaatcaattgcactttcgtgattatgagttagaatagtcaaattaaaaaaaaggttcatgattacagtgttctcttttacatcttaaagtttcagtaaatctcactaataatgacttttgggggtgttcagtttttatagataccttttttctatttctttctgtgctcctgttcctctgccttagggcattgcacatgctgatctgctttcacgtgcatttttcagcatgttcttcttcttacttcatttccagtcgttctacatcattggcttctactcagccttcaggcttcattttagatattacttccctaggagtgtctccccctttagaccaggtgaggtctcttgataacattttctttcctagaattgataaccattttctttcctagaattgataaccattttctttcctagaatttctcatggcttgccattttgtatttgttatttgttgattttctgtcttctttgacagtaagcttcatgaaggtgcagatcatatctgtgtaggccactgtttaatcttcactacctacctctccataaacacctgtgaaatgcatacattcatgcctcgattaggagaatgaactggacattctcctaaaagggaatgctaggatcagaaatttgggagctgagtatccgagtgactgatctccaccccagctgacatcactcaaaatctctgggatcatggcctgcgggtctgcatttgaaggattacaattctctgaagttggcctggtgcaggcaagaggggctcatgttgaggctcaaccccatccacccccaagaattccacagtgtgttttcagtgaggatgtcagtgttctcttatctctgttgctcacactcattaagctaactgctttgtgacctgacctgatgggggccccagtgtttggacacaggtttgcttcttgaccctgtatttgtcaaggtaggctagctgctataacaaacagcccccaaataagtaaaagtttatttctcatttgtatcacagccagctggggtggccaaggtatcctctaccccatgcagcctttcagggatccaggatgctcctattgttgtgcaccaccttctagggcagctcttctcaagtgagactccttgggaggattaggcgctgttgctgacggcagccactgtacgtaatgcattaagtaatctcctccccatctagcatggtgttagatatggaccatccttgggagagttgagaaaagagtcacctgatttgttctctgtttggttttattttcttatggaggcccagttcagagagggtggagggatcttgtttttcacctggctggtggtagaagagaggataggaatatcttattcctctcgttgcccagcccagaggtgactcacatcacctcctcacattcactcacatcacctcctcacattcactcaatctgcttgtgggaatcacttccatggtcctgtccaggtgcaaggaggtcacaaaatgcacttagacattagcccgagaagaagaagaaacaaacacaggtattggtgagcatatcaccttgccccagtcctatcccatatcaagttgtatttgcaccatagaggcagaaaaaaatggagtgggtattttcaattaagttgcatttatttgcacgaaggtttgacttaacttgcctttgctctttctttataacagatgatagcttgtcctgaaactgagactcctgccgtgataacgtgtgacccactgtcccagccttcccctcagcctgcagacttcacagagactgaaaccatcttggtattcctcatctatatgacctacacatggccagctctcttattgcttgttattttctcacagggtctatccccattacataccagtgggggcgccataggcttttaaaaattcctcccttttttttttttttttttttttttttttgagtggtttctcccacctggaataagttgtgttataattagtctatttctctattatccaggtggataaggaatctggctgtctgttcgaacttattgtggggttttctttttcgtcattttgttattctcttccactttgcttaaaaaaattaataagaaaaagatacagcgtctatatagcatctatgtctccattaatttttttaaacttttgataggacttgcaccatgtctaaaatcaatattccatgactatggattttattttaattctttttttctctaagtttacccttatgaatctgggcttttattgccacatatcatcagaaaactggctttatggacacccccctgtttttaaactctcaaagagactatcttagtaaaatgcttctgtaggcatttggtataaacaagtcaaatctctctctgaaaatttaacttccatgaattgcataagaacttgtagcatctcctcttgtctgagacttggtggatggctcagaaaaagtgaggggagagaagctgagctatttttagcattcccagaaaagaagatcgagtacagtccatcagtttttttaaaaaagttaattatagtgccggccgcggtggctcacgcctgtaatcccagcactttgggaggccgaggcgggcggatcatgaggtcaggagatcgagaccatcctggctaacacggtgaaacccccgtctctactaaaaatacaaaaaattagctgggcgtggtggtgggcgcctgtagtcccagctactccggaggctgaggcaggagaatggcgtgaacccgggaggtggagcttgcagtgagccgagatcacgtcactgcactccagcctgggcgacagagtgagactccgtctcaaaaaaaaagttataataaagatgaggtcttgctattttgccgaggctggtctcgaactcctgggctcaggcaatcctcctgccttggcctcctaaaatgctgggattacaggcatgagccaccgcgcctggcctcaacccaataatttgattttattttaccccaggataaagagttctccatcatttaggttagggctacagttccctgcagcccaccgcagactaatgatggaatggttatgttttagcagccagcaaataaagtcgaaagtgtctcatccgaggaaaccttcgaaccaagccaggaactccctgctgaggctctcagggaccccagtctgcaggatgcactggaggtggtatccaaattcttccccttgcccaaggctcccggtgggggccatccaccgtcactgaggtcaactgcatgcacacaacagctgttaatttttcagcctcatttaacaaaaaataagaatcggcttccctcttcccctgcctctgattcttctgtcttctctctggcatttgcctggggtgatcggccgactctcttttgccatcttcaagtctgatcatcacgctttttctctctttaaaagctgttctgcagaagggatcaggagggaagttgagggactgtggaaattaatgcgtagcaatccattttctgaaatgaagagattaaaagctgaaaattggagggagtggggcatgctaatgttcgaatccaaatggggcatgcaaataatttcttctttcaggatgaaatgagagatgcatgctttctgttccttcctcttagagatgttttcatcttcaactacgttctctccattgatgcatttaatgaaagcaattgctaacgttttctcttgctctttaagcatgatctaataatgccatttggtctttaagtaacaatcaatacagctctagagctaggtttaggtctagactgaaagttggtattgaacgcatgtttagagtgtgacctactgtgttggctaaatgccttccctggacagtcacccttggagaaaatgtgaacttgtttttctcattcttacttggttactgttcaaatgcagcattttgaacttaatttctagagctgttggttgaggtccaggtttcttataaacatgtgaatgtatcccttcagcatgttccatccttgtggtcatcatttgaggctctgtgaattgaatctgtagttattagtgagtgacagggcatcagtgtgaggttgggtaagacctacgttggacagctcagccatgtggtaggtttgggatcctggatgagttcattactttttctttttaaaaattattattattattattattatttagggacagggtcttgctgtgtagcccaggctggagtgcagtggcatgatcatagctaagcagtcttcctgcctcagccttccaaggaaatggaactacaggcatgggccactgcaaccagctaattttttatttttattttttgtggagttggggtttcactatgctgtccaggctggtctcgaacacctggcctcaagtgatcctccttttttggcctctcgaaatgctgggattacaggcatgagccaccgcgcccagcctgagttcattactttgcttcagtgttcatgaggtggagactgggttgcccacctcacagaattggaaggaggggtattaaaaaggagagtggtatagggaaagccctagttagtgcttggctcataaagatgaggaagatttcggtcattgatttgctaaaccggggcactttgacctcctgtgtgtccacactgtcctctaggggaactttatttagtatcttgtataataccctaattcataacattggagcagcttgttgttttcttggatactcatctcttgttagcagaaatgtcacaatcactgtgctgttttgtcttgaaaactagtataaggttgggtgctgtaggtcctgttaattccagaaacatttcattctcaggaactgaatggatctaaatgcaagtgctcttagaggggagaaatgctgcagtatcctgaagtggactttttaatttatttgttaactcttgctatcaccttaatcaataggatggctgtctttaaataaaatataatatatgggaatgagtgtagaaggcagaatcttatatgtaaaaaccttctaaaaacactgcggcaagtaattagagaagaaagtagtatatgcctatggtgtaaaaactcaaatttatctttctatatatctatctctatacatatcatgtatctatctatctacctcttatctattttctttttttttttttttttgatggagtctcactctgtcacccagtctggagtgcagtggcgtgatctcggctcactgcaacctccgcctcccgggttcaagtgattctcctgactcagcctcccgggtagctgggactacagtcacccacgaccaagcccggctaatttttgtatttttagtagagatggggtttcaccatgttggccgggctggtctcgaactcccgacctcaagtgatccacctgcctcggcctcccaaagtgggattacaggcataaaccaccacacccggctatctatctattttctatcatctatctcatctatatatccattcatcctcacatctagataatagatacatagatatagaagagataaaacataggtagtagatagagatgatagataaatgaatgatagagtgatagatgatagataggtagataggtagagagatattttagataaatagataaatgatagagtatagaacggatggatggatggatggataaatggatagatagattgatagaaagtagataggtaggtagagatcatagatagataaataggtagatagatgatggagtgatagatgacagatgatttattgataaatagaatggatggacagatggatggatggatggatggatgagtggatagatagaacataggtagatagatgagatagatgatagataatagatggttggtagatgagatagatgataaatagatgatagatagatagatagaaagatgtgtgtgtgtctattattgttaccatctttaaatttttaagagtctttttctagttcttggtaagaagtgtttaaagcaaatgtatttgttctttttgttgactcatctgaatgccaaacaaaatgtgtgtgtgtgtgtgtgtgtgtgtgttgttacacacttgcattttcatctgttttttcacatgacccttaagaaggcaggaactctgccattgaaaaaactatctgaattattatttaaattcctttgccaagcagtccaaattcttataggctttacttacaggaggtgagttgttttttcatttaacgtagtttggttattcactgtcatacaaaacagaagttttggtgggtgagagtattaaattagtgtgtgtgtgtgtgtgtgtgtgtgcacatgcgcatgtgtgcatgtgtgtgtttaaaatggtttagtggctagaaatgaaaacaattcttcagaaaaagagaacatatacaattacattttataaaatttcaaaacacttaagcaaaaaaaattatcttctaagcatattatactaaatctagtgtatatttagctcaaaagaaaagtgctgctgggtgtggaggctcacacctgcaatcccagctcactgggaggccaaggcaagaggattgcttgagcccgggaattcaagaccacactgggcaacataatgagaccccatctgtgcaaaaaatacaaaaatcagctgggcatggtgatgtgccctgtagtcccagctactgaggaggcagatgtgggaggatctcttgagcccaggaggtcaaggctgcagtgagctgtgactgcaccactgcactccagcctggacgacagagaccctgtctcattaaaaacaaagtgctagtgattcgcaatctctttttgagaactgagatgcatctttctgcgggaccctacactggatgggttttagcagtctttccctcgataatggacagctgcaaaaaccatctcccactgactgtcttccctaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatggttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgaggctcgtaggatatttcaggtgagtcagggttggatggtcatcggctttcagaaggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacagccatgtggcctccttccagtgtgtgtttgcctatttcctgcgatatcaggcttatattttatattaaaccaagggtagggcctttctattttattttcggccttttctattgtattttgtttttaaaatagtaagcatcgggctgggcgtggtggctcactcctgtaatgccagcactttgggaggctgaaacaggtggatcacgtgaggccaggagttcaagaccagcctgggcaacatggtgaggccccgtctctaccaaaaacacaaaaatattagccgggcatggtggcacacgtctgcaatcccagctactggggaggctgaggcacaagagttgcttgagctggggaggcagaggttgcagagagctgagatcacaccaccatactccagccagggcgacagagtgaggatctgtctcaaaaaaataaataaataaaatataataataataataataagcattatttgagctggaattgcaaggtaaaattttaacagtaaacaataaacatactttattttatttttgatttaaaatgttttttaactgtcatgtaataattgtacatatttatggggcatgtagtaaagttgcagtacacgtcatgtctactgatcaggtcacgggaattagcatatccatcatctccaacctgtaccattttttgtgttgggaacattcagtattctccttctatatatatatttgaaactatataatatatgattttgagctgtagtcatcctatagtgctatataccagtgatccccaacctttttggcaccagggaccagtttcatggaagacaatttttccagaaaccaggctggggggatggttttgggatgattcaggtgcatgacacttattgtgcactttatttctgttatgattacattgtaacatgcaatgaaataattatacaactcagcatcatgtagaatcagtgggagccctgagcttgttttcctgcaactggacagtcccatccaggggtgacaggagacagatcatcaggcattcgattctcataaggagcacgcaacctagatcccctcacatgcacagttcacggtaaggtttgcactgctatgggaatcttacgcggccgccgatctgcaggaggcagagctcgggtggtaatgggagcgatggcgagcggctatcaatacagatgaagctttgctcactcgccgctactcacctcctgctgtgcggcccagttcctaataggccatggaccagcactggtctgcagcccaggggttggggacccctgctatagaacactagaactaccttaaaaaaaaaaaacccaaaactggatctcatagaagtaagaactagaacagaggataccagaggtcaggaagggtagggagaaggggtgatggggagagatttgttaaagggtacaaaattacagctagataggaggagtcagttccaacaataaatttaaattatcagatggatttttcagaattgctggtcacagtgaaatgcatagaactgtttacttctaactttttgcgatcttgcaggatctctttaggaaaggtacccattttctgaactttgctttgtcagtttcattcattcattcgtcatatgcttattgagtgctctctttatacccagctgtgtgacatgggacaaatcaatacaccataagtttgggaatatacacttttttccacgagaaatcctcattgtcagaagtatcttcattcaatgggcacaatatgctgtgtatctcactgggtggctgtcaggggccaccgagagtgtcgttaaaaatgggcatgttgattgacgtctcatgtctccctagaatatataaaaccaaactgtgctttggccaccttgggcacatgtcgccaggacctcccgaggccgtgtcgcaggtgtgtgtcctcaaccttggcaaaagaaactttctaaactaactgagacctgtctcagattttcagggttcacaggtacagtgctgagtacgtgggtgggggtacctcactaccatagaaaataccctagtgacaaaccggcacgtgtaccccttagacctaacataaaagttgaaattatttaaaaataaataaataaatattatgagattattatcttgtggcaagtggaaatgatgtgggaaggaaaggatttctagatctgtcgaattggcagggtggattgatgcctacagatccacaggaataagttatagtatttttgttcctcaaagccacttggtcgaatcctgccaaaacctttggctgatgcttggaagcacgaaacaggtcctagtgttaacgcgttttggggtggaactgtagtttgaagcagaaaggggtttctttctgaccaccacccttgaattaggaaaagcagagcaattctttctggtttcataggcctctgctctttagtgtacagtaccattttaaaaattatttatttatgtatctttggccgattacagtgactcacacctgtacctggtactttgggaggccaaggcgggcagatcgcctgaggtcaggagttcaagaccagcctggccaacatggtgaaaccccgtctctaccaagaatacaaaaatttgtcaggcatggttgtgcatgcctgtaatcccagctactcaggaggctgaggcaggagaatcacttgaacccaggaggtggaggttgcagtgagctgagatcacaccactgcactccagcctagacaacagagtgagactctgtctcaaaaaaaaaaaaaaaaagaaagaaaaataaaataattaaatcatctattttaattattttattattttttatttttatttttttgacacggagtctcactcttgtccaagctggagtgcagtggcccgatcaccgcttcctgcagcctccaactccagggctcaggtgatcctcccacctcagcctctcaagtaactgggattacaggcatgtgccaccacacccagctaatttttttaaactttgtagaggcagggtctcataggagtctcactatgtggcccaggctggtctccaactcctggcctcaagcattcctcctgctttggcctcccaaagtactgaggattacaggcatgaaccactgtgcctggcccccattttttttaatagatcaaatgagttgcataggtttacaaacttgatgtcttctatccctgctctatccatcatcctaagaaacaaaatgaagtttttattggcacagacaatatctgttggaagcacattcgtgcaaatccagctatacctagtatgtgacatgtactgtgcaagaatatactttacacgggattgtagcatgccttgaggatgcttgtctggattccattgcatagttgctaaatgctgatgctctgtgagtctgtcattattgcagcattcatggcccaacactcagctgcacaaaagagcttttctgtttctctttccctcc

SEQ ID NO: 510 - DNA, 193759 bp, Homo sapiens
tttatttaagcctccttattatcccctttcagtgtaaaaatttctccagccttagtcaggatttgaaaagcttaaaactagaaggcaacctctgaaaccacggtgaattttcacgtcagtttgtccagtacgtctgggttgatagagccaccttttagacaccctctagcccaaatctgatcatagtcatgtgtccccacctcttagggcctccgtggcggaaggtgttggttacctgaagggagatggtgatgggatgggaaatcaacaggagggaatcctgtgttggcagagttagagttccaacttcgtccagccagcacagttcatttataaattactttgtttctctctctctctctccctctctttccacccctgactcttgctctcatcttttactctttgtgtctgagagaagagtgatgtgaaaatgatcaggaattcactttttcttatgaggtcctggtcacagtgatacttagaaaacacttaagaacttaggcctgtggtgttttctccatctgcttccaggtcatttcttcctcatttctctcagaactttggtgttaacagcctgtttcccttctttaggggatgactttgatttcacagatgtttcttcatggtgaacgaaacagtgagtaactctttaaagtctcctctgttgccgaattgcttatagtttgtttgtgtttttggagtgctgtaggaagagcagtgatgaaggtttgaggcttctagatgcttccatattagttgcctggggctcaggcaggggcacacatgtggacccctggggggacatgacagttgagctaacagctgaggaatgaggatgacttatatcccaaggagtgggtcaaagggtgttttgtgtagcaagtgtggcatgtgcaaagggcctgtggtcagtggaactgagggtgcctgtggggctcagtgagggggaaaagaggaagtcaggcatggcatgggatggaggggaacagagtgaggctacagtcagtgcccagtcttgaaaatgtcccttcgagtgtccctaggggccatccttgttttcagtgcttattacccctgctcccctctgcttgctcccagagagctgtctcctgcctcccagctctgcgtctcagatcctggctctgatcccacgctgctgttgcttacactcatgtacccattgctaatgtcatcattcccttcggcagctaagtgcaaagttaatttcccatttgaaaagcagtctgtactaataacaatcaactgggagacccaaaagagtgcagttaaagagaaaaaaaaaaatcaaactttccctcaaaagaaaccagtgataccatttgggtccacctccctgaggtttgaaagcctctccgttagtgttagttgcttttaggcctcttcttgctgcattagcaaggtgtatctttctctttatatgcagacagtgccctcttctggtgggaggctctcagtgtctgtctacaaatccatgacccaagaggtagaggggtcccaacggtcccacttaacttctgccaaagtggtgcccttgggaatccccaacttcctgtgcccacctgttctagctacttggttcactttgacccagctcttcaggggtgataccctccctcatcaggctcccagatcccatcaggtgttgaaaccccatgtgataggtgaaatactggtccccagagatgcccacatcctaaccccttgatcatgtaaatgtgtgaccttatgcaacacatgggactttgcaaatgggattacattaaggatcttgacatgggacgattatttaggatgagctgtgtaattacagtggaatcacaggttccttagagaggcctgcatcagaggatgaaggagttgttcacatgtggaaagagacagaaataaaagtggagaggaccattgaaaaaaaaagtcattgaaagactttggcacccaggttgccatggctgcccccagcccttcaaattctcctaaagccccaaatgatctttccctggaagatgcaccagcccattggatagcttagatgcagctgttggagggtggatctagcctgtgaggacccagtaacctggacccaatacatgacaacaaggattgaatgagtggtcgtttactgctgagtaattgctggttttcctggctacctgggccctgggtcacatggatgagagggctggaaaaaatgattatcagcacagagtcccagaatctctgtgacttctggtcacagatattttgagtgtatgtatagaaaaaagcagttgttcctacacattcagtgtcagaagtgaaggatgagaggggagaggggtgtgcatgtcaaaggaaaaaacagcttttcccccctgtacgtgaggtcacagcaaatttgcaagattcagtgcatggtgagagaagcaggcagccgctgacatccaggggctggcctggctcccgctacctggcttggggtttcctgttggacctaagaaatgtcacagacaggacatttttaaagtcaataagaaatgtcagacaagagcactgtgatgaagtcaagagaccgtgggttgtgctttggctggttcttgatttatttctgctcaaggcaatcagtatgccaaggtggcatatttcagagtgtcacgtaatgatctacattcttattcagggtggggtgtcctgtaccccatcaactggaaggttgtagcacttcctgctttctagacatggtaaatgaactccctgggtcactgggaaagttgtagcacttcctgcttcctggagatggtaaataaactttctgtgtcacatgggaggttgtagcacttcctgctgcccagagatggtcaatgaacttcctgagtcactgggaaggttgtagtacttcctgcttcctggagatggtaaataaacgtcctgggtcactgaggaggttgtagcacttcctgctttcctagagatggtcagtgaacatcctgggtcactggggaggttgtagcacttcctgcttcctagagatggtcaatgaacttcctggagatgttaaataaacttcctgggtcactagcgaagtttgtagcacttcctgtttcctggggatggtaagagaacttcctgggtcactggggaggttgtagcacttcctgcttcctagacatgataaatgaacttcctgggtcattggaaggttgcagcactttctagtttagagggacattataacacttcctggtttatctggagattgtaatgctttctgattcatagggacattgtaaaactttctggctcacattgttacatttcctggttcaaatggataatagtagcacttcctggttcacagggacattgtgacacttcctggttcttatgggtaattgtagcatttcctggttcacagggacattgcaacgctttttggttcatacacataattgttagcacttcctgattcccagggacattgcaacacttcctggttcatagggataattgtagcacttcctgtttcatagggacattgtaatactttctggttcatacgaataactctagtacttcctggttcatatagataatagtagcaattcctggttcacatggacattgcaacacttcctgtttcacagagacattgcaacacttcctggttcattctgataattgtataacttcctggtttgcagggacattgtaacactttctggttcatatggataatagcacttcctggttcatagggacatagtaacatttccgggttcatacatacggataattgtagcacttcctggttcatacggataattgtagcacttcctggtttgcagggacattgcaatacttcctggttcatatggataattgtagcacttcttagtttttaggatcattgtgacacttcctggttcatagtgacactgccacactttctggttcatatggataattgtagaacttcctggttcataaagacatttggaaccgtctggttcatagggataattgtagcacttcctggttcatagggacattgccacacttcctggttcatctggataattgtagcacttcctggttcatagggaaattgtgacactttctggttcatagtgacattgccacacttcctggtccatgtggataatagtagcacttcctggttcgtagggaccttaccacacttcctggttcatccagataattgtagcacttcctggttcatagggatattgccacactttctggttcatatggataattgtagcacttcctggttcatatggataatagtagcacttcctggttcacaggtacattacaacacttcctggttcattcagataattgtaaaacttcctagtttgcagggacattgtaacactttctggttcatatggataattgtagcacttcctggttcatagggaaattgtgacactttctggtttatagtgacattgccacacttcccggtccgtgtggataatagcacttcctggttcgtagggacattgccacacttcctggttcatccagataattgtagcacttcctggttcatcggtaaattgtgacactttctggttcatagtgatattgccacacttcctggttcatagtgacattgccacacttcctggtccatgtggataatagtagcacttcctggttcatagggacattgccacacttcctggttcatccagataattgtagcacttcctggttcatagggatagtgccacacttcctggttcataaggataatagtagcacttcctggttcacaggtacattacaacacttcctggttcattcagataattgtagaacttcctagtttgcagggacattgtaacactttctggttcatatggataattgtagcacttcctggttcatagggaaattgtgacactttctggttcatagtgacattgccacacttcctggtccgtgtggataatagcacttcctggttcatagggacattgccacacttcctggttcatccagataattgtagcacttcctggttcatagggatattgccacactttctgggtcatatggataattgtagcacttcctggttcatatggaaaatagcacttcctggttcacagggacattacaacacttcctggttcattcagataattgtagaacttcctaatttgcagggacattgtaacactttctggttcatgtggagaattgtagcacttcctggttcatagggaaattgtgacactttctggttcatagtgacattgccacacttcccggtccatgtggataatagtagcacttcctggttcatagggacattgccacacttcctggttcatccagataattgtagcacttcctggttcatagggatattgccacgctttctggttcatatcgataattgtagcacttcctggttcatatggataatagtagcacttcctggttcacaggtacattacaacacttcctggttcattcagataattgtagaacttcctagtttgcagggacattgtaacactttctggttcatatggataattgtagcacttcctggttcatagggaaattttgacactttctggttcatagtgacattgccacacttcccggtccgtgtggataatagtagcacttcctggttcatagggacattgccacacttcctggttcatccagataattgtagcacttcctggttcatagggatattgccacactttctggttcatatggataattgtagcacttcctggttcacagggacattacacacttcctggttcattcaaataattgtagaacttcctagtttgcagggacattgtaacactttctggttcatatggagaattgtagcacttcctggttcatagggacattgtaacacttcctggttcatagggacattgtaacatttccaggttcatatggataattgtagcacttcttagtttttaggatcattgtgacacttcctggttcatctggattattgtagcacttcccggtttatagggaaattgtgacactttctggttcatagtgacattgccacacttcctgattgatatggataatagcacttcctggttcatagggacattgccacacttgctggttcatccagataattgtagcacttcctggttcatatggataatagcacttcctggttcacagggacattgtaacacttcctctttcattccgataattgtagaacttcctaatttgcagggacattgtaacactttctggttcatacggataattgtagcacttcctggttcatagggacattgtaacatttccaggttcatacagataattgtagcacttcctggttcatagggacattgtgacacttcctggttcatatggataattgtagcacttcctggtttgcagggacattgcaatacttcctggttcatagggataattgtagcacttcttagtttgagggacattgtgacacttcctggttcatagtgacactgcaacactttttggttcatatggaaaattgtagtatttcctggttcataacgacatttggaaccgtctagttcatagggataattgtagcacttcctggttcgtagggacattgccacacttcctggttcatctggataattgtagcacttcctggttcataaggatagttgcaacactccctgggtcatcacccccatcctgccatctgctccagccctatgcagccactcagaaatctacttcctatcccatggatttgcctatcaggggcatttcaaacggcctcccatgtggttttgtgcctggcttctttcactcagcataatattttcgaggtccatcgattttgtaccatgcatcagaatttcattccttttgatggcagaatgacattccattgtatgggtagaccacattttgtttatccatacacttgttgttgggcattgggttatttccactgtgtaactaccatgaataatgcttagcacttagcatacggttaagacttctatgtacatacttgtctgagtaactgtcttcaattttttgggtaaatacccaggaggggaatggctgggtcatatgataactctatgtttaaccattgaaggatccgccaggctgcttttcaaagcaaccgcaccattgcaccatcccacaaacaatataagagtgctccagtttctgcacatctgagccaacacttgtcactgtccatatttgtcattagagccatcctagtgtgtatgatgggctatctcattgtggttttgatttgcatttccctgatgaccagataggttggctttcaagttttcatgttctttcttcttctctgtcaagtagatgagtaatacttaaataaatatttcttactcagcattttgatgtatttattcatagccttattaatgcttgactttatttgtttatctctcagatatgggtctctaaatgtcagtttcaagaaggaactgtgttttgttcaactccaaaatccccagatctatctaggacactgcctgaaacacagaaggggttaaaaaaatatggatgaaatataatagcaaatgcatgtcctattttaaaatatcgacagttattctatttgcagaacaataaattcaatgtgaagactaagatactgttgattatttatgtgtgtatgctcgtatatgtatatatacatacatatgtgtgtatacctctacatgtatgtataggtatgtataggtatacatatgtatatgtacagacatatgtataggtatacatatgtatatgtacagacatatgtataggtatatacacatatacaagcatatatatatacatatgcaagcatacccacattatgtacatatatgtaatatatatatatatacacactcacatatacatacacacacacatatatttacacatatctttataaaacacagacctaggatattttccctagaatcaggtccaaggcagatagttgaaaaatgtctgatttctaatttgtggttgaaataaaactaagaacatttcattattttcatcatgatttattttgctgacttgttgaacatatgcaggcttgttacctgggtggactgtgtgatgctgaggtttggggtatgaccgatcccatcacccgggtagtgagcatggcacccaataggtagttcttcagttcttaccctatccctccctccaccctctaggagcccccagtgtctgttcctctctttgtgtccatgagtacccaatatgtagatccacttataaatgagaatgtgcaatatttggttttctgtttctggattagtttgattacaataagaacctccagctccatccacgttactgtaaaggacgtggttttgttcttttctgtggctgtgtagtatcccacagcgtctatggaccacattttctttatccagttcacccttgatgggcatttaggttgattccatgtctttgctatggggaatagtactgtgatcaacatgcttgtgcaggagtctttttggtaggataatttattttccattatgtatgtatccaggaatgggattgctgaactaaatggtagttctctttttagttctttgagaaatctgggagatatgtcttggaatgaacttcatatagctttttactgcctcccttttaaaatgcttccagaaggctgtcccttatttggtgcacagaaactggctaaaaaataaatgtgaccagctgggagtggtggctcacgtctgtaatctcagcactttgggagactgaggcaggtggatcacctgaggtcaggagatcaagaccatcctggccaacatggtgaaaccccgtctctagtaaaaatacaaaaaattaactgggcgtggtggcgggcgcctgtaatcccagctactcaggaggccaaggcaggagaattgctcgaacttgggagccagaggttgcagtgagctgagatggctccactgcactccagcctgggcgacagaacgagattccgtctcaaaaacaaacaaacaaacaaaaattagccaggcatggtggcacacacctatagtcccagctactcaggaggctgaggcaggggaatcacttgaacccgggaggcggaggttgcagtgagctgagatctcaccattgcactccagcctgggcgacagagcaagactcggtctcaaaaaaataaataaatataaatacaattaaaacaaataatataaaaacgtgacctgcagccacctctccaaggggcctggataccaatggaaggaagtgaaaaggaggagatgaaaaatttacaccttgaaagctgaaagtgttctaatattaccaatgctgtggagtcagacacatcgaaagtgactctaatacctcctgacatccttatgttatgaatatgtagacaatagcaaattattctccgcttttttccagctcattgaaacatgttagggaggaacatttctgcattgacaacagctttaaatatttcattagtgcttggaagaaacacaagaatctgtgacgcagaagggaaatgaaaaggaaagcttagtctccatttagttatgttcctcataaatatttcccagaggcaaagatgttctctttcatattaaaaatacaaataaacacttctcattagcccaagaaaatattgtagagattttcattatccaaaaaaggcacactttcaagacacacggaacagagacggcacattgccttagcttgcttctggctagcatgtctggctattgaccggattttatttttaaatgactaaaataatatattaactaaatggtaaaattcatattcagcattggcttgagggcatcggagggttttggctggcccagtcatctctaccagtgaagaaagcaaggaaataggtcatttcactcagggacagcttgaaaacagagatttcatggagcttcctcattccgtcagcctagagtgggattttggctgtcacccttcaaggatgaaaaggtgcagaggacattgggctgcagacagggcgctcgtttaaatgatttaaaagttttggtcagtcgtggtggctcatgcctgtaatcccagcactttggggcgccgaggcgggtggatcacctgaggccaggagttcgagaccagcctgactaacatggagaaaccccatctctactaaaaatacaaaattagtcgggcgtgatgccacatgcctgtaatcccaactactctggaggctgaggcaggagaattgcttgagcctgggaggcggaggttgcggtgagccgagatcgtgctattgcactccagcctgggccacaagagcaaaactccatctcaaaaaaaaaaaaaaaagtttccatctggctggacacggtggcttacgcctgcagtcccagcactttgggaggctgaagcaggtcaatcacttgaggtcaggagttcaagaccagcctggccaacatggagaaaccccatctgtactaaaaatacaaaaattagccaggcgtggtggcgggtacctgtaatcccagctactctgtaggctgaggcaggaaaatcacttgaaccctggaggcagaggttgcagtgagctgagattgcaccactgcactccagcctgggcgacagagcaagactccgtctcaaaaaaaaaaaaaaaaaaaaagtttccatctaagcgagctctgttggttctcccacctctgaccttatgagttttcttctttaacctgcaccttgttctctgagtcactttgcacttgaaggtacagctacagcttccccatcagacttgttggtcgtttatcaaaggatgaaaaagttcttcctcctttgggtctttaaccctgtttcctggtgtaagacagcttttatgtttgctacctgctggaatcaacttgaaattttctcccagaaaatttgtgaatttatcttgttcaagttacttgtggtcaataagttaataaagataggtagacagacagacaaatacattgatacagatagatagattcatgatagatgattgatagatagatattacacagatacatagatacatatcttagacctgatatatacagggtgggtggatagataaatgaataaatagatagatagatattacatagatagatagatacatagattagacctgatatatacagggtgggtggatagataaatgaataaatggcttgattgatggattgatgattgatggattgatggattggtagataaatgaataaatggctagatacatgattgattgattggtaggtaaatgaataaatggctagatacatgattgattgatagatgatagagattagatagatatatagatacatagattagacctgatagatatatggatatatatacaggatgggtggataaatgaataaatggctagatacatgatatagatagagccaatacatacataggtacatagacagggtaggtgggtagatagatgaagacatggatagataaatatacacagagatagatcaatgatagaaatgggtatatagatatatgaatgatagaagatattttgagagagagatgattaataggcaattgattgacatattagatgacagataaaaagtgggtaaaatgcaagtaaactgtaagccaaacgtccacgtggaatagcgtgggaagcattgagaagacgctttttggtgctacctgtttaaacattgaaaaactgagctaataccctccacagtacgatagaggggagggcactgggaatttatacctcccaggaaaaataaatcatggtaaacaggcagagatctttccagattccagttcttgggggtaaaaggtccccaagatgcccagtttgtgacaacctgttttgaactattcagctcaaggtttccattttttctcccaggggagttgcctcgattctgatgtgtttgcttcggtgctctgtgtattgtattcatcccactcttcaattcataaactctggagattcttcaattcactgggcaaaccatatgcctaagtctatcctctgatggaggctcgtacatgcaaaatccaatagcaacctgggaagatttcagtcaagacccaagaggaggctggcatcaggctctcggtcaccgatcttcacattcaggtttcctgatgcactttgcgactctttgggcaacctctggactccttgttcccagggtccacatttagttttatctttactgcattgcttttatgaaaaagaataaaattggatgaaacagatacagagtattggtgtcaacctaagtattggtgtcaacaaagagatggtttggatctggttccccaccacatcttaggttgagttggaatccccggtttggaggtggcgcctggtgggaggtgactgcattatgcgggtggtttccattgaatggtttaccactgtcccccatggtgctgttgtggcggaagtgagttatcatccaatctggttgtttaaagggtgcaacaacttccccaccccgtcctgctcctgctgtggccatgtaagatgtgcctgtttcccctctgccttccgccatgattgtaaatttcctgaggcctccccagccgtgcttcctgtactgcctgtggaaccgtgagccaatttaaacctctttttctttataaaattaccctgtctcaggtatttctttatagcagcgtaaggactgactaatacactctgtaatagaaaagatgtttatttgggagtatagtagtgcgctgagaatagatgtgccatattaaactgtgttcatattcagggaggtaaaggggaaaaaaggattttaaaggaaataatgaagaggattccataattcttttcaaatgattatccttggctaaaaagatcaataacatggtgacaccagtctgagtttggacagccagtttttgggcagatgtcctcgtggaagtatttttctttgcaagggtgagatttttgcagtctcttacgatagtttttgttatcaggcatataagcataaaaaccattaatatacactagagatgcattgaagagcttataaaattgttaaggttttcttctttggtcagtgtctaaaatatgagtcagatatttccttggttatctttgagatttatgtggtcccaggtttctcctgggtgggtagaaattactgcagcatgtacaaaactgtccttcatgccatatttcttcctaccattatacgatgaaaactaacaaaagagagttttataaaatgttcttcctctttctctctggtaccaataggaagcacaattgtttccccatggttcttcacaaaggttctattgcactaagttttaaagccttgtgtatacacaatcacattcacatataccacacatacacgtgcatatacacagttacatccgtacagatacatacatgcacatgtatacacagataaacacatacatgcacaaatatagacacatacacagacacacattcacatgtatgcggacacacacacatagacacatatacctatgcacagaaaccatacagatatacacatacataacatacatgcacaggtatacatacaaacatacacagatatgtgcatacacatatacacacataacacatgcatgcacacatatccacaagcctgcagatatacacacgtacacacagatatgcatattcatacataccaaacatacattcatacttacacctatacacacacatacacaaacacatacagagatatacacacatgcacacaaatacatacacacatacatacacagatacacatgtacatacataccaaacatacatgcatacttacacctacacacatacacaaacacatatacacaaacacacatacacagggatatgcacatgcacacagatacccacatacacacgtacatactcacatagagttacacacacacacgtgcacacgcaactttggcataatggaaatttgatgattggtcattggagtcaaccatacagcccctgtcagaaacaaaggaccaaagtcgaaggggacatggatgcacaaacatctcaacatctacggaaccacgtaacttggagaaacatgcaaccaactaaggacagaagattcgagtgactgcaactctgttttttttttttttttgagatggagtttcgctcttgtcacccaggctggagtgcaatggtgtgatctcggctcaccgcaacccccgcctcctgggttcaagcgattctcccacttcagcctcctgaatagctgggattacaggcatgcaccaccatgcccagctaatttcatatttttagtagagatggggtttctccgtgttggtcaggctggtctcgaactcccaacctcaggtgatccgcctccctcggcctcccaaagtgctgcgattacatgcgtgagccaccgtgcccgtcctaactgcagctcttactttggaattcaggcagctacggagccaagattcctggagcccacaggcgtgtggctaatacatttcccttcctttccatagaattgggttggttttgttgcactgggtgtctggtagctccggagagaacaaatataaatgtgaaaatgcataccttggtcatcagtgtttctcaacaattctccatcccacttaacaaggcctctgctagaactctggggtccgttccaagaggaaaaacatccctgcctagaagaagcaaatggaagaatgtactctatgctgccatgtgtgttctcatcaggccttatctaagtttctcaccaggagatgttgaaaaatattgcttgatggacgaagggtaacgtactgcagttgtttattgagaaatgccagccgtcatctcttgctcgttagctgctctgaatgctcttagaaggcaccattcatgccgctgtattcgggactgctgaattgtgccacattccttggtgttacgcgtgtctcttgttgatgaagttctaaccacagtgccattgtgaggctggaaatgtccttgggtgaaaaagcggcccctgggtcacctttcccatgattcaggtgcatgtgaacccctctagtgctttactgccagggtccaggagagagggaaagaatgtcactgtcccagcatcctctaatttacttgacaacacaattgttctagtgtcaagagttttgttttgttttgtttttgagatagagactcgctctgtccctcagactggagtgcagtggcacgatctcggctcactgtaacctctgcctcccgggttcaagtgattctcctgcctcagcctcctgaatagctgagattacaggcacctgccatcatgcctgactaattatatttttgtagagacggggcttcaccgtgtcggccaggctggtcttgaaccactgacctcaggtgatccgcctgcctcagcctccaaaagtgctgggattacaggcctgagccaccatgcccagccaggtatttttttttttttcttcagctcaagaatgaagtttttcttagtatcctgtagctaaaatgatgcttctccaattttatttattaaaaacgcctaacgctggccgggtgcagtagctcacgcctgtaatcctagcactttgggaggccaaggcaggtggatcacggggtcaggagattgagaccatcctggccaacatggcaaaatcccgtctctactaaaaaaaaatagaaaaaattagccgagtgtggtggcgggcgcctgtagtcccagctactcaggaggttgaagcagaagaagcgcttgaacctaggaggtggaggttgcagtgaaccgagctcgcgccgctgtactccagcatggcaacagagtgagactgtttcagaaaaacaaacaacaaaaaaaaacaactaatagtaatgatcacatttttgggctcaaacatcttaattctggaaagaggagatgccacaatggataccacactaaagagatgctctggagaattttgcaagggaagaaattgtcatcttagggagggcacactggggaagcttttcagacactggtcattcaccggtatgattagaagaaatgccacacagacctcaggataccttgacccagacggggtcactctgatgccttctgaagtgagaaattgatcacgttaccacagctagtcaccactcactgggtgacttcagacaaagaaaattgacgttgtcaccgttccaaagaccagaagtctgagatctaggcgtgagcagggctgcgctaccctggaggctctaggggaggatccttcctgcctctcccagctcctgggggttccaggtgttcctgggcttgtggccacatcactccaatccctgcctccatctccacgtggccgcctcctctgtgtctccaaatctctatctccttgtaaggacactagtaattggatttagggcccaccctaaatctgggatgatctcatctcaagatccttcacttaagtatgtctgcaaggaacctatttctaaataagatcctgtttctacattttgagggtgaggacatgcacatcttttttttctttttttgagacagactctcactctgtcacccaggctggagtgcaatggcacgatttcagctcactgaaacctccacctcctgggttcaagcgattctcttgcctcagcctcctgagtagttgggattacaggcgtccaccaccacacctggctaatttttgtatttttagcagagacagggttttgccatgttgctcaggctggtctcgaactcctgaccttgtgatccgcccgcctcagcctcgcaaagtggtgggattacagacgtgagccactgtgcctgccgcacatatctttttatgactcacaacaatatgcaactctggcatgcaatcatgctagtggtttacttgggcagaccctccaggcctgcgtggcaagggagtgggggttcacgccacagcaaagaggaggaaggaaaacccctgtgcttcagctttttcggatcacaggaaagagcaaacccagcaattcaagggcagcggtcaaagactgcaggtatagagcatgagaagcagtgagcacagggctggaggggggcacagaaatggtagcaaaggtcagggatatgaggggatagcttgaggtggggccgaccttcatgggagggatggcagaaggcgaagatgattcaaagggaggatggggcaccggtaacatcagctccaggagctcaggaaagtgtagaagggagctccttctccatccaagactgaccccgtgtctctcacgctttggtgcaaggatgcatggatgctgagactcataggaagggtgtgtgaggcatgaagcatgtgggaagtggaaaaagggaaagaggaggagaagggctgtggggaaataagtgagtagaattgaggaaacagaccattgacttaattcttgaaaggattcaaaggccaggtgcagtggcttatgtcagcaaccccagttactcaagaggctgagagaggaggatcacctgagaccaggagtttgagatcagcctgggcaacatggtgaaactccgtctctactaaaaatacaaaaattggctgggcaggctggtgggcacctgtaatcctagctacttgggaggctgaagcaggaaaattgcttgaaccaggaggcataggttgcagtgagctgaggtcgtgccattgcactccagcctgggcgatagaatgagactctgtctcaaaaacaaaaaaacaaaacaaaaaagatacgggttgagcacagttgctcatccctgtaatcctagcactttgggaggttaatgcaggaggattgcttgagaccaggaattcaagtccagcctgggcaacatagtgagaccccatctctaaaaaaacaacaagaaaaacacaaaaatatacatcatgacacctgtattcacactcctcatatactgcagacaaatgccattttgaagagagggagctttattcctgagtgggcggaggaagaaggatgaattgaggaagtgtgttcattacttgtcagctgccaacactgaaaacaacacatgtttattttcttacatttctgtaggtcaggagtctgaaatggatttcactattttaaaatcaaggtgttgggaggcttgcagtctctccagaatctctaggagagaattcatttcttactttttctagtttttacaagccacctgccatccttggctcattagccgttaccccatcttcaaagcacatgactccgacctctgcttccatcctcacatcccttttttctgcggttaaatatctcccttcctctccttataaaagccctgggaccccactgtgattccatagatcattcaaaaaatgtccccatcttaagaaccttacctgaatcctatctgcaaattcctctttgtcctaaaagttcacaagttctaagaattaggatgtgggcatctctggggaccaggattgtacctgccacatagggtttgaacacctgatgggatctgggagcctgatgagggagggtgtcacccctgaggggctgggtcaaagtgaaccaagtagctagaacaggtggtcacaagaagttggtgattcccaagggcaccagcttgggagaagtaagtggggcagctggggacccctccacctctagggtcatggatttggagccaggcactgagagcctcccaccaggagagggcaccgtctacatataaagagaaagataggccgggcacagtggctcctgcctgtaatcccagcactttgggaggccgaggtgggtggatcatctgaggtcaggagttcgagaccagcctggccaacatagtgaaaccccgtctctaccaaaaatacaaaaattagccgggtgtggtggcgggtgcctgtaatcccagttactcgggaagctgagacaggagaattgcttgaacccagaaggtggaggttacagtgagccaagatcacaccactgcactccagcccgggctggagtgagactcagtcttaaaacaacaactagctgggcgtggtggcacacacctgtaatcccagctacttgggaggctgaggcacgagaatcgcttaaacttgggaggcggaagttgcagtgagccgagatcacgccactgcactccagcctggctgacagagcgagactccatctcaaaaaagaaaaaaaaaaaaaaaaagagagagagaaagatacacattgtatatgcagcaggaccaggcctaaaagcaactaacactaacagagaagttttcaaacctcaggaagatggacccaagccatatcactggcttcttttcaagggaaaatttgatttttttttcccttaactgaactcttttgggccaccctgttgactgtaatgagcacagactgcgtttatcgtgggaaatgaactttgcaatgaattactccaagaaatgatgccgttagcaatgggtacatgagtggaagcaacagcagcgtgggatcagagccaggatctgagagatgcagagctgggaggcaggagaaagctgtctgggagcaagcagagggtgctagacccaatgaacatggcaagcaaggctagaccctgaggacagtcaaagggccattttcaaggttgaggactgactgtggcctcactgtgttcccctccatggcacgccatacctgagctcctctttccctcctcactgagccccacaggatcctcggttccatcgaccacaggccctttgcacgtaccacacttgctacacaaaactttctgcctctaccttgtgctgtcttcatacttcaattgtcagctccactgttagctccatggtcacttgcccttaaaagttcacatctgtggccgggtgcagtggctcactcctgtaatcccagcactttgcgaggccgaggcgggcggatcacggggtcaggagattgagaccatcctggctagcacggtgaaaccccatctctactaaaaatacaaaaaaaatagctgaatgtggtggcatgtgcctgtggtcccagctactcaggaggctgaggcaggagaatcacttgaacctgggaggcggaggttgcagtgaatggagattgcgccactgcactccagcctaggcgacagagcgagactctgtctcaaaaaaatttaaaaaaaaataaaaaagttcatatatctgtgtccctgcctgacccaagctgaccatgttataagcatctagaagcctcacctccttactgcggctctgaccacggcactacttttatatcctgtgggcaattttgtttaaatatccgctttcctcgttagacgctaagcaacatgggagtgagtgtctggccatggtttgctcatctgtgcatctccaggactggctgggttcctgggtatgaagaagcagcggtccacacacatgggtgaacctgtgcttcttctcaccactacactgcttggcttccttatttccttcctgtcacctggaatgcctaccctgtacttctctccagctccaacaccatcatttaccacctcgttcagctcccaggcatcctagaagcctttcctgaccacaggggtgcatcgtggtgcacaattccttcagctgccactatggtgcaagatgagtctagaagaacagttttgctgtgcggtcacccttactcactattgtgattttgcctttaacatattgaaaaagacacagaaaacacacaccatccgatcagttagttgcagacacatcgcccgatgctaagaatgtgctgtgttttaaattgacgtctgttggctcttcagcttctgctctgggcttcttatgtccccactcggccctgaatcccattcccccaaatctcagtaactttggtggcttttgcaccagccaaaatcagatcctaggtcttgagcaaaaccaagagcaaggaaaaaaatcccacatgggaatctgagacctcactctaatgacttcagttgctgttgacttgatttccttcaactgccgaaggaggttagaacagtttcctcttgcttctaggacaaagcatcacagactttgcagcttaaaacaatgcacatttctttgcttacagttctggaggtaagaagtctgaaattagtttcctggggctcccatcaaggtgtcagcagggctggcttccttctggaggctctaggagagaaacggtttgcttgacatttccagcttctagaggctgcctacacgccttattatgtagctgctccctccatcttcaaagccagcagtgtagcatcttccaatctctctctaactctgaccctcttgcttccctctttccatgataaagacccatgtgataacattggtcctacctgggtaatccagtaatgtcttctcatctcaagctcagctgatcagcaactttcattccatctgcaaccttcatttcccttgcacaggttctgggaatcaggacatggatatctttggagcctgctattgcttctacctacaactggtgttacaagacttggcccacttaatcttgcaaattctttctgcccctctcctgtgcttaatgagatctgttctctatgaatgttcaggacctcaggagtagggaccccaaaggctgggggcaaagtagatgtgacaggtgccaagcataggatgtgtgaccagattcggtcatgtgattacattgtgaagtgacccaggcattttcattaagaaggaaagtggttgtaggaggaggaaattgaacacaacccacacatgggtggttggaaaatctgagacctctcgtgggcatgctcatccatttcactcaccggtacaggggaaattcttagacctgtcagtgcaactatttgaaataaacatccaagaaaggcagcaaacttcaggtaggatgaagtcagaagtccaccctgaagcacagtaaaagccacaagacagaagtgactgatcccatcccagggatcctaaagaagattatcatcagacttctcattggaaactttggaagtcggaaggcagtaggctgataaattcaaaatgctaaaaaagaaaaccaatgaaaacatgctaaccaagaaaaaaaaatgctacatggctgaagaaatcatgcagaaatcttagcaacattttaaatgatccaacaaggtctgttgtttctgcgcaaatatgggcaaacatgagctggtatagcttatttttatgggtgcagggagcatgcagttatctccactagcatgtttttgtttgtttgctttgagatggattctcactctgtcgcccaggctggagtgcagtggcacaatcttggctcactgcaacctccgtctcccgggttcaagcagttccctgcctcagcctcctgagtagctaggattacaggtgcccaccaccatgcccagctaatttttgtatttttagtagagatggggtttcagcatcttggccaaggctggtcttgaactcctgaccttgtgatccactcacatcagcctcccaaagtgctgggattacaggtgtgagccaccgcatccagcctgtttttcttttcaactcatgcataggttcagaatttagttccaggtatgtgagagctccttgtagatgtttttcatgatgaggcacctggcttaccagactttatctgacttcttgctttatcttcccaacagttcagcaccgtggtgcggtacagggtcccattagcaggtctcatttcccaccactgactgaacatcagcaggctcaatccacaagtcaggggctggggatgtcttgtcaagaattccctctttaggggcaggaatgaaatttataacaacatccatactgtttgatggagccctctctacatggcaggtgctttgcaagcactttcagaaaatctgcaccaaaccttatagtaagaatgatcgctgtcattctacaagtcagaaacttgaagatcagattggtgacatgttcagctaatgcactgctaataaacagcagaagtgaaattcaaatatcaagacatttgtcctcaaagtctatgcttgtaactagattatggccctgatatcctaggggtgaatcagtttcagtttcccttcctggacccccagcaagtagtacatgggaattattctagtccggtatagcggggagcagtgtaaacagataaacaaggttttccggggccctggtttaggcaaataaatcttacaacttatctggctctttcaagtcgacttcagacttcgccttgctttctagactgttttgcctaatggaaaatagtgtttgtatctttagaaaatgtaatacgtgattttcccctctcaatattttgcaggtcagagatattgctttgatctattttcacataataattattatttgaggtctcaagaccagcatcttcatctgtgtggggctctgagttaagggctttccagagactcactcctgccgtttcttctaactcccttgagcagaggccagcagtagagaaacttgataaataacacaagtgctataatccctgagtcctctaagaaatgagacacaaaggaaagatccagggacattttcacagatgtgcccaattccagtggccccaggtttcccaccctgctgttgatattctgccacccatagtcgtgatcatctggctacaaaacagcaggcaaggctgtgcatgagtgatgttacaggtgggctcatggctacatggatgtctagacatgtctaggtgtccatatgcaggacctgagggaaagtgagaaggagggagggatgggtgaatagatggatagataaatggatggaaaggtggacgaatggatagatgcatgaatggatggtgaattggtgggtaaaatggagggatggatgggtgtttggatggatatttggatggatggatggatggatggatggatggatggatggatgagtgaatggctgagtggatgggtagacaggtggatggatggagagatggataagtgtttgatggatgaatagacacatacatggatggacaggtgtttgggtggatgtgtaggtggaaaggtggatagatagatagatgggtggatggatagagggactgatggatcactgaatacatgtgtcaatgaatgggggatgtatcattggagggatgggtgagtggtatggtggatgagtagatgaatgagtgggtggatagatggatggatggatggatggatggttggatggatggtaaggtggatgagtagatgggtggatgggtggatggatggatggatagatggataggtagataagtagatgattggatggatggatgcatgagtaaacaggttcatggatgggtggatgagtggatagatggatgggtggatgtgggtggctggatagatatgtagatagatgcaaaggtgaatgcaaagagaaggatagatttatgaggatgcaagtgagaatttttctccttaggtcatcaggggaaaattaaatccttacccacggagacatctttcatttgagtcaggcagaggccctctttttctctctcctggtgaccaggacaaagagaaatgcaggtgtagagagctctgatcagggagccctgcctgcctcctgtcctgggtgacctttaccaaatcctctcctgcgttgggtctccctaaccttgattttcaaatggtggcttcagggctttgccttttctgtgtctgtggttctctgtcatctatcaagtctcccagggagccccttcttgcctcccctctgtccctttggcccccactccagaccccagactgggttcagggttcctctctagaagtcactgatgggagcccacaccctgaaaatgcctttagtcttcattccagcctctcctctctgccaagtgagctgcccttgctggcagcagtcacttcctcacacagggggatgcttgttccagcacactgagtaagtgctgtctcctgagtgggaattggcttggcacaggcgaccgtatgactgtttcaaaaagtcattcaaattctttgtcttgtacatcctgtctggaagcacgtatatacattcccgcctccccactgggcacgctcttacccttgcgctgccattctggtgctaggagctgtttgtgctgtccactgggtggacagagacgtcttccccatgaaaagaggaatcagggttttcatgtatctcttagaagccgggcatttggcaccggggctcatgaacagctgatttttgaagtggtcccagggaaagctcagttggtgactgataagaagaaggtctgggctgggtgcaggtctcacgcctgtaatcccagtacttttggaggccgaggcaggcagatcagtcaggagattgagaccatcctggccaacatggtgaaaccccgtctctactaaaaatacaaaaattagctggccatggtggtgcacgcctgtaatcccaggtactcgggaggctgaggcaggagattcgcttgaatcccggaggtggaggttgcagtgagctgagatcatgccactgcactccagcctgggcgacagagcaagactacgtctcaaacaaaaaaaaaaaaaaaaaaaaaaagaagaaaggaagaagaagaagaagaagaagaacatctgaagaattgggatactgaggcatcatcttccttgcccagtggatctgtggtttcataccctgggtctcctgaagctttggggtttttctcattttttttttctttgagatggagtcttttttctttataaattatccagtcttagttatttctttatagcaatgtgagaacaaactaatggtgctggtctcctcaaggaaactcctgccacaccccctccctcatcttctttctctctgtctttttgttttgaggtggagtctaactctctcgcccaggctggagtgcagtggtgcgatcttggctcactgccacctccgcctcccgggttcaggtcattctcctgcctcagcctcccgagtagctgggattacaggcgcccgccaccatgcccggctaatttttgtatttttagtagagatggggtttcaccatgtgggccaggctggtcttgaactcctgacttcaagcgatccacctgcctcagcctcccaaagttctggggtgacaggcgtgagccaccgcacctggctggggatcctttttcatctctggtggacaacaaggtgtattttcctcttgctggtccagggggcagcagagggagaaggagactacagtgtttgggggtccgtgtgtgtgttcttttcccccctggtgcctgctgtgggaggtcacataatgcagatggataatgatggcacagacatatcctcgctgttggcctctcccactttacttcatttgtgatggatgcaccacccattgagttgattataaaaggctgataaggctgggcacggtggctcacacctgtaatcccagcactttgggaggccaaggcaggcggatcacctgaggtcgggagttcgagaccagcctgaccaacatggagaaaccccatctctactaaaaatacaaaattagctgggcgtggtggtacatgcctgtaatcccagctactcaggaggctgagacaggagaatcgcttgaaccagggaggcagaggttgcggtgagcagagatcgtaccattgcactccagcctgggcaacaagagggcaactccatctcaaaaaaataaataaataaaataaatgaatacataaataaaaggcataataagcaaattgctaactgtggggtctgtgactatggactctttcttgtgttcaaaatagcttttctgcagagttaactgtgcaaacccaggacagcagattctgtttgtgcccttcaagtggtttagatttcagattaccaagatagaaaaatatgtttgactacctgtccacagttctgtattttcagttcttataatgggactacaaataagacaacctgagcctttgtttcccatacccctgaatgcacagaaccagagttctgaacgatgtttttgtttgtttgcttttgagatggagtttcactcttgtcgcccaggctgggtgcaatggtgcgatcttggctcattgcaacctccgcctccgaggttcaagtgattctcccacctcagcctcccaagtagctgggattacaggcatgtgacaccacactcgggtaattttttgtgtttttagtagagacggggtttcacatgttggccagggtggtcttgaactcctgacctcaggtgatccacccatgcggcctcccaaagttgttgggattacaggcgtgagccactgtgccaggcctgagcaatgtttaaatcctcaaagcatcactagaattctgataactgtttttacaaagaaggaaaggaatcattattggcaaggatgtggaaacattagaattctcctactttgctggtgggaagttaaagtggtgtagccactatggaaggcagttttatggctcttcagaaaattaaacacagaattaccaagtgatgtagcaatcctacttctacctaatacctaaagatactgaaaacaaatgtgtaaacagaaatttgtacacaaatgtatgtagcaatatccaaaatgccaaaaggtgaaaacagtccgatgtccatctaatactaaatggataaaccccatgtgttccatccatacaatggaatattattcagccacgaaaaggaatgaaacagtcacatgctacaacatgaatgaaccttgaagacgttatgctaagtgcagaaagagagacacaaaaggtcacatattgtaggagtccatttatataaaatgtccagaatagttaaagccatcaagacagaaattgaactcatggttgcttagggctgggggcagggaaaatgaacagtgattacttgataggtacgaagtttcctttggcggtgatggcagggttctggaactagatagcagtgatggtggcataacactgtggatgtagtcaatgcgcctgaattgttcacttaaaaatggtaaaaacgggccgggcgcggcggctcacgcctgtaatcccagcactttgggaggccgaggcaggcggatcatgaggtcaggagttcgagaccagtctggccaacatggtgaaaccccgtctctactaaaaatacaaaaattagttggctctggtggcgcatgcctgtattgctagctactcaggaggctgaggcagaagaatcgcttgaacccgggaggcgaaggttgcagtgagctgagattgcgccactgcactccagcctgggcgacagaatgagactccgtttcaaaaagaaaaaaaaaaaaaaaaaagatgaaaacaggctgggtgcagtggctcacaccttttaatctcaactctttgcgaggccaaggtgggaggattgcttgagcctaggagttgaagaccagagtgggcaacacagatccagtctctaccaaaaaattttaaaaaatcagctgggcacggtggcgtgtgcttgtagtcccgtctcctctggaggctgaggtgggaggatcacttgagcccaggaggtcaaggctgcagtgagaggtgtttctgtcactgcactgcagcctgggtgacagagggagacccccatctctaaaacaaataaatacatatgtacacaaatgaaaaggttaaatgatgaaattaatgttatgggtatttttccacaacaacatgcttccccacagaaatctcagtggagaagacaggagtgtggcagaccaacatgcttctggagctccacaaagctgtccctttaattggcagcacgcctggtgaaggctgtttgctttgtggacgttgacctccacctgctggcccagtgactcctgctatcttcattttgtccagttcacctctcagtccccagagccgtacaaccatctataggttcttgcttctcccttttcccctagaagcatctcctgggaatcacccctgaccaaaagccccaggcacctctccaagaccccctacagaagcctaaacagcccttacattcattgcctttggacctacccgaagtcaacaagttccaaactcgtcagaaactgggagaagtctcagccccaaatcaatagcagccgttgtcagctcctcccagctcaaagtcccccagagatcggttccctggtctgagtcaggaacgagagactgaaaagcatggggatctggtgctttttcttcatagggttagtcgctttccccaccaaaaaacctaccaactgaaagatcactgattggatgggtcaaccagcctcagctaccagatgtctttgagatggggagccagccccctaaagctgagtctctgtgtgtggcttccaaatacctggtcccctgggtgcagacagaagagaggacgcagaggctggacatctcccagaggagggggagactggctggtcaccagataatcttgcttccctctctgatgtcataggaacatgaacagacttggagatgctgattgaaagtacatgtcacctgaaggagacattggttccagagccattaattcctaacctcctaccatactctctgcatggtggaagatgccagaacattctcagagcttgagaaaaaagaggaattgagagaagggacgggggtcaagagatagagaaggtgagaggaatgtgagagaagcaggggacggaggagaagagaggaaggataactcagaagctcaggtctaacttcaccccactccccttaggacccccccactctaactgttgtttctgagagttcctgggggccacccataaacaatgaggttaaatgtaaatggaagggcaggactctgttgaagtctgcagaaggtaccctgttggctgcatagtcaccagctctcatgacccaaagaggagagtgagcaggtgactggatcatcagtgagggtaaatctggaagacagaattggagccaggtgcagtggctcacaactgtaaccccagcacctttggaggccaaggtagaaggagcacttgagcctcaggagtttgagaccagcctgggcaacatagccagaccctgtctctacaaataatttttaaaaattcattgaaggatttctaaagaccacttgagtggtttatgtctcctggagtcagaacccagggaggatttttgctgaaataccaaagccgcagggagcatgaatagagatgttcagacagaaattaagtttgaagaaatagactttggcagagaggcacgtggccacagacaagaactcatcatgcattcattctttcactcactcagcaaacattaaatggactctgtctaactgcatttccctctcttgacaagagggatacatcggagagagacaggctgaaggaatgtagagttgatattggacctgggagctttccaaaggcactgtgctctcctgtgcccttcttcgcatcccagtctctacgatgttgaccgtgttcgtgggtttcacattgctgttgacataccagaaagaatatgcatgaaccacagtgacaaatgtcattcataatcattttcagcacagaataacctacagaaatgtcttctgtgtaccttcccctgcaatattttgtgattctgatgcaactggagacaaaacatctcttatccatggcctctcttgaatcaattttatctccaatctgccttttcatgggtactctaacaagaaagcaaacaaggaaagttcagctggtctagcagttctgagacagcaaattatctcactgttgatgtggacaaagagcctcttgcagaaagactatacttaactctgagaatctgggtcccagcttttttttttttaatccagagagacgtaaatctgaaagaatctgagtcccagccgagctgagagaggagtaaaatcacggaggcatgcctccactcagaacacatcattatcgtgcttttatatggaaggcacagccattcactcattgtccgatagacgtttccattgaacgttggatctcttcaaaccaagtgtctgcaaacatgatgggttttgcactgatgctgaggatgaatccaacaggaaagatacagagaaacatcacattgcaccccagagacatatgcaattattgtttattgattaaaaatataatgaaaattaggaggctgaggcaggtggatcatgaggtcaggagttcgagaccagcctggccaatatggtgaaaccccgtctctactaaaaatacaaaaattagccgggtgtggtggcacgcacctgtagtcccagctactcgggaggctgagacaggagaatcgcttgaacccgagaggtggaggttgcagtgggccgagatggtgccacagcactccagtctgggtgacagagcaagactctgtctcaataataataataatgaaaaataaaagaggaacaagggaaaccaaaagtaagcgtatagaagagcagtttaacatgcaatttcattttatttatttctgctttaagtttattatttaaatggtatctcaaacgaagaaggctggccactcgttccctcttctgttaccctatcattggaggttttgttctttgccttggtatgttgagagaacccagaggtctgtgagtaaaattccggggttttgtcaactcagatgggacaaagtctacatctctgggttcactcacttgtaactgaaattcagcattgcctgtggacataggcaacatcccacaacaatgttagtcttgcctgtagatttctcaccaaccattatcacaaatactttcctatccctgtacaggagttgcagatgaaatatcctttatgctcatgaccacttcagcgttactgtgcatcttggacctgcctcaaattattttaatcttatgaatatctaatgcattactgtgtttccattgcacaaaataaaacaatgacttagcagttgcccaggcgaggggaaccacttccaacaggtgggactaatcattcagggttttcgaaagttctctgtgtagttggattttaagctcctgagttaatctgatagaactttctcatctggttttaagaagtgtggttaatggggatctcttgactgtagaatcagttttaaaacaccacatttacttctgacagtaggtaaattttaccttgggcagaattgtatggccttggtggtagttagtataaattagtatgaattaacttgggcatatgtgaaaattactatagcataaattaatgaaggcctatgtgaaattttgcaattattttctgtattcacctaaaatggcattgcactggaaatatagtatgcttcttttgtgatttctacatatctctgtttttttctcatatcagattctactttacccctcagtgacagtcattttacacccctctctgtctcaatgtcctaggcaccctgggaccatcctggctggaaggcatagtgacattgctggcctgagctgaagtgccgattaaaataaattgaaagctgaattaccttatgaacagctgctttacccaggaacaaatgtggagaggaactccttgaaactgtgttctcaagtagaccacttttgagaaattatacatttatcataacatctcaagtcctgctctacatagaatgaccattattatcaagaaaagttctccattccctgtaattcataaggcaatgcaggcctaaccagaaaacaggaactgcgacaaccttgcatcagacacattcgatctctctattcatagttgcattctctttttttttgtttacaaagccaatcaccaataactcggaaaacaaaaacaaaaaaaaaaaaatgaacacattgttgagctcgcttctgagaaagattctgcattgtgaatgtcaggattccacatttctgaagcacctttgctcctccagaaagcatatctctagtttcatggtgatacgagagagaaatgacaattgtctgtattatcaggatggcccattgtgctctgtggatctcaatcaatgtggacatcagccatgatcaagctctttcttttctctctctctccttccttccttcccccttcccctcccctccccctttccctttcctttaccttgtttcttgcttcccttccccctccccttcccttccctcctctctcctcctccctccccccttccccctccccttcccttccccctccccttcccttccccctccccttcccttccccctccccttccttccccttcccttccccctccccttcccttccccctccccttccttccccttcccttccccctccccttcccttccctcccctctccccttcccttccctcccctctccccttcccttccccctccccttccttccccttcccttccccctccccttcccttccctcctctctcctcctccctcccccctttcccctccccttcccttccccctccccttcccttccccctccccttccttccccttcccttccccctccccttcccttccccctccccttccttccccttcccttccccctccccttcccttccctcccctctccccttcccttccctcccctctccccttcccttccctcccctctccccttcccttccctcccctctccccttcccttccctcccctctccccttccctcccctctccccttccctcccccctccccttccccctccccttccccctccccttccctcccattcctcctctctccccctcccctaccccctccccttccctccacttctgtcccccttcccttttcttttcgcttcttttcttttcttgagacaggatctcactctgttgcccagactggagtacagtgaagtgatcatgggtcactgcagcttcgacctcctgggctcaagccgtgctctctcctcagcctcctgagtagctgggactacacacgcacaccaccatgactgcctaattttttaaatttttatattttttggagacagcgtttcatgcaggttttcatgcccaagctggagtgcagtggtacagtctcttggctcactgcaacgtctgcctcctgggcgaaagcagtattcctaccttggcctcccacgtagctgcagccacaggcactagccaccacgctcggctatttttttttattttttagacacaagacttcaccatgttgtccaggctggtctcgaactcctgagctcaagtgatacacccgccttagcctcccaaagtgctgggatcacaggcatgaaccaccatgcccagcctggttaatgtttaaatgtttcctggagatggggcttcactatgtagtgcaggctggtcttgaactcctgggctcaagtgatccacctcagcctcctaaagtgctgggatgacagatatgcacccccacactcagagatattattttcttttctttttttttttctttttatttttttgagaggggtcttgctcttgtcccccaggcttgagtgcagtggctcgttctcagctcactgcaacctccaccacccgggatcaaacaattctcctgcctctgcctcccaagtagctgggattacaggcacctgccaccacgcctggctgatttttgtattttttagtagagatggtgtttcattatgttacccaggctggtctcaaactcctgacctcaggtgatctgcccgccttggcctcccaaagtgctgggatgacaggcgtgagtcaccgcgcctggctgaccatgctttcacacaaatgtcccagaccctggggacgacagctgaccagagagtgattgaactatgcagagtcccagcctcacctcccacatcccttctctctcatttgcccacctattacccctaccttaaaaaaacaccctgtagaaatacccactagggccagacgcattatgtgaggcttttcattttttattcttttttttttttttgagatggagtctcactgtgttgcccaggctggagcgcagtggcatgatcttggctcactgcaacctctgtccccccggattcaagcaattctcctgcctcagtctcctgagtagctgggattacaggtgtgcaccaccacgcctggctaatttttgtatttctagtagagacggggtttcgccatcttggccaggctggtctcaaactcctgacctcaggtgatccacctggctcggcctcccaaagtgctgggattaacaggcgtgagcctccgcgcctggccaaccatgtttctatacaagcgtcccagaccctggagatgacagcagaccagagagtgattgaactatgcagagtcccagtcccacctcccaaatcccttctcctctctcctttgcccacctactaccccccaccttaaaaaacaccctgtatcaatacccggtagggccagaggcattatttgaggctcttcattattttctgagacatcaatagactacgtgttggcagaataattgactttgcaatttacattggtgatataggagggacagatcctgcttctcggaaacctccatgatttgcacatgtgcctgcctcctcctttgcaggtgcggtgtttgggaaggagcagtgagccacagggggatgggagcccaaggtgtggccctgcagggagggtccaatggcccatgagtgtgggtgattcaagaatgtcagactggctgggcacggtggctcactcctgtaatctcagcactttgggaggccaaggcgggcagattacctgaggtcgggagttggagaccatcctggccaagatggtgaaaccctgtctcgactaaaaatacaaaaattagctaagtgtagtagcaggtgcctgtaatcctagctacttgggaggctgaggcagggaagtgcttgaacccaggaggtggaggttgcagtgagccaagatcatgctactgcactccagcctgggcaacagggtgagactccaactcaaaaaaaaaaaaaaaaaaaaaagagcatctgtcatttgcaacaacacgggtgaatttgaaggatattgtgttcagtgaaataagccaggcacggaaagacaagtaccacatgatctcattcctatgtaaaagtctagaaaccttggtctcacagaagcagagagcacagtggtggttaccaggggatgggcatgggtggggcatgggaagatgttggtcagagtattacaggccactagacaggcatgggcgggcaggagagggctcttccacccaccagcaatgccaggtgctggttcagcgatgatcgcattgcctctctaaaaaatgataaattggcggctgggcacggtggcccacacctgtcatcccagcactttggaaggccgaggcaggtggatcacgaggtcaggagttcaagaccagcctggccaagatggtgaaaccccatctttactaaaaatacaaaattagccagacatgatggtgcatgcctgtaatcccatgcttgaaactgggaggcggaggttgttgcagtgagctgagatcgtgccactgcactccagcctgggcgatagagtgagactcagtgtcaaaaaaaaaaaaaaattggcagcctgtggcagggagagaccatttcctgatgttccacacctgtcacactcaattgttcattgagtgcaagtgccgtggaaacacaacttcctaagcatgcacattaggagaaaacatggcggaatatgaccttctgaggtcactccactggaaacaggaagaaagcctcagatatgggcacgctacaacttcctaaacctcatgctcacctcccaagcataaggagggcactgtgcatgcgggcagctcaccctaggggaagaatcatgggaaagggatacaagatgctagaagtggaccagcctataaggtcctgtaaagttaaacaccacacttgttcttcagggcgcctgcttgggtctctttcaagtgtacttccgttcttttctgttctgaagcttttaaaataaacttccactcggctgggcgcagtggctcatgcctgtaatcccagcactttgggaggctgaggtgggtggatcagaaggtcagaagttcgagaccagcctagccaatacggtgaaaccccgtctctactaaaaatacaaaaattagccctgcatggtggcgcacacctgtaatcccagctactcaggagattgaggcaggagaatcgcttgaacccggaaggtggaggttgcaatgagccgagatcgcactgctgcactccagcctgggtggcaagagcgagactctgtctcaaaacaaaaacaaaaacaaaagccttccactcctgctctgaaacttgcccgggtctctctctctgccttatggccctcagtcaaattctttcttctgaggatgcaagaattccagtggctgcaggcctgtatggattcatcactggtaactcagataccttccaccacattataataaaagggcagaacatttcagttagacctaaggaataagttcaagagatatattgcacaatgtggtgattgtagttaatatcaatgtactgcatacttgaaaaccactaagacagtagattttaactgttttcaccacattaaaaaaataagtatgggctgggaatggtggctcacgcctgtaatcccagcactttgggagggtgaggggggtggatcacgaggacaggagattgaaaccatcctggctaacacagtggaaccccacctctactaaaaatacaaaaatttagccaggcgtggtggcaggcacctatagtcccagctacttgggaggctgaggcaggagaattgcttgaacccaggaggcagaggttgcagtcagccgagattacaccactgcactccagcctgcatgacagagccagactccatctaaaaaaaaaaaaaaagtatttatggtaatatgttaattagttttagttacccatcccataatggatacatatttcagtatatgaatggaatgttatgttgtatatcagaagcatatctaatttttgtttgtcaatgacaaaaagaaaatagtcctcatcattgtgactggctcaggctaaacacatacactatttttatttctgcagttactcttctatttctgtgctacgtcttaaaattatccattgcaaatggcatgtagctttgaaaatataaacttgccacctgatccaaaacttttcagttctgtcatagttttgtgttttttttttttttttgagatggagtctcattctgttgcccaggctggagtgcagtggcatgatttcagctcactgcaacctccacctcctgggttcaagcgattctcctgcctcagcctcccgggtagctgggactacaggcgcatgctgccacgcccggctaattttttgtattttagtagagacagggtttcaccgttgttgcccaggctggtctcgaactcctgagctcaggcaatccgcctgcctcagcctcccaaagtgctaggattacaggcgtgagccacggtgccagcctccgtcatagtttctaaaacacccacaccacaacagtaatcttgactcaacttcagctcctcatcctgtgtctaagccaagtttagccgaagaaaacatctgccgagaaagtaaaaacaaaaacatctgccaaaggcaagaacccggtgggaagccccctgagcccagtggcctgcagagtctgttctagtgacaaagcaggcaactggaagagatcagggctgcgagacagcgtgggtgggtttttatctgctgcttctgtaaattcattgcatgatacgtctgtttttcagaggtcccaaagcaaagaaacaaagccccacagagttcacccagagggaaggccttcactggatcaggctataagagaaggactctcccctgagaaagataaatacttattttggggccgtgtttagagaaaaaggaagaacgatggctttcccatagaaacatttacttattttgtgatttgaaaatggacttttatgttttaggaattatgtggatgggatgttttcttgggtgatcgatttgaaattgcagaggggagcaggtgccatgtgctggcaatggccggccttccttccttccttccttccttccttccttccttccttccttccttccttcctccattcctcctaccccccgtttcttccttctttctctctctttctttccttttctctttttctttctttttctttcttttctttctttctttctctctctctctttctctctctctctctttcattttgtttgttttaatgagtgagagtaaagagaaagaaaagaactgtttttattttttgtctacctttattgtaaggagagagtgaggataccatgccacacatgcagggtcctgagcagagggctgcaccctgcttagttctaaagacacctagactttatcctgaaagccactgagaggcccatattttgaaacactcagcctctcagaagaggatagaatgggttgccagtgtaatagggagagaaatcgaacatagctgactccatgttgcttctgactcctcaagctaactgcttttaggcacttctgcacacgggccaagttaatcatggaaagaacttagattacagtttaactggaaagcaaggatgataagcgttcctttccaaaactaacctctgaggagataagaagggcatgcacacaagtaacaatgttatattgaagacttgtaggagcgctgtgacctgagcaaggacaaagttttgcaatctccttgggcccctgctgatgcccaagtgtctgtggtcaccagccacccccctcacctcagtctcctccttgttccccttcagtgtaccccttcaatgtacaaagaagcttgagattcatgcctttaaagatggttcgttaggacatgggtccagtatcttcctgacttgctggctctccaaataaagatgcttttcttgctctaactttttgtctcgtgaatcattggctgttatgcagtgagcctcaggaactttggactccacagcaccaggacaactctcaggactcccagtctctattgggtgcaggaatcactggggagtctggctgaagtgcagactctgattgaggaggcctgggacacgaggcctgagattctgcatctccagtaagcaccaaggggatgttgatgctgctgatccagggaccacaccttggagagcaatgctgagaagctggtggaagagcccaggctcatgaagatctgaacatggtccatagcagggaggttggggaaatgagataaaaatgttaaaaatggcagttaccttcctggagaagaaatggcttttccattccttattaggctcatgtctttggaactagcccccactggtctccttcctgttatatacctgcagttaccatgttcttgttaaggaagaatggcaaatgcaaaaaaaaaaaaaaaaaaagaggaagttgatcatgtttggttgcttttggtcatcacaataaataaataaaatctgaaatttccccctgactttgcaaatgttttcttccaaggagagcaacagacatgtgtcagccttattggatttctttggttcccgaacagcctgccatgaggtatgaaggacacatgaccttttatgtaattggtgagacccaatgtcttccagatgttgggtgtctcatcccagtgtgaggatttttttttattatttttttgagatggagtcttgctctgttgccctggctagagtgcaatggtgcaatgttggctcactgcaacctccacctctcaggttcaagcgattttcctgtctcagcctcccgagtagctgggattacaggtgcgtgccactacacccagctaattttttgcattttagtagagacgggatttcactgtgttgcccaggctggtcttgaactcctgagctcaggaaatccacgcccctcggcctcccaaagtgctgggattacaggcatgagccaccgcgactggccgaggattaagtttttaaaacttaatttccctttagaaaagagaatttaacctagatgttggttcttaatttatcttgagtaaaagttgtctttgctaatatgaatttttaaagtcatcaattggttcatacagttttgtgtgattcacctccaaatgttttcagcagagggagtaacaagaaagaaaaggtaatttttttttttttttttttttgagatggagtctcgctctgtcgcccaggctggagtgcagtggtgcaacctcgtctcactgcaacctctgcctcccaggttcaggctattcccctgcctcagcctctcgagtagctgggactataggcgcccgccaccacacctggctaattttttgtattgttagtatagatgggatttcacggtgttagccaggatggtctcgatctcctgacctcgtgattcgcccaccttggcctcacaaagtgctgggattataggcgtgagccaccacgcctggcccagaaaaggtgattttaaaggcaaagaagcgagatgacttgagtaacggtgttccccatgcatggttattaacaaatgtttcctgactgcttacctgtcaaaaacattgaacaggtagaatgtgtggtcccaggaggtgacaaacttcctattttaaatgaaatatttcaaaacagattagacctccaagtcaaaggggtgataaggaatttcatgggagttcaatgatcttttaaaaaaaaatgattgtaagcctattaggaattagcatataaagtttgctatggtccgaatgttgatatctccccaaaatttctattttgatgtcctcacctccaagctgatggtgttcggacatggggcctttgggaggtgatgaggtcgtgaaggtggggcctcatggatgggatgagtgcccttataaaaggggccccagagagctccctcgccccttccagcatgtgaggacacagccagaaggcgccatctaggaaccaggaagtgggtccccaccagacactgaatctgccacgtctttgccttggacctccagcctccaggactgtgagcgataaattctccagcgttgttagagggcttgctccttgatcacaataaactgcatgcttgtttttcccctaaatttctgtgccgcaaagtgatggtgctaggaggtggggtctttagaaggtggtgtgatcatgagggtggaacctcatgaaggggatcagtgcccttacaaaagggaccccaggggctgggcacggtggctcacacctgtaatccccagcactttgggaggcccaggccggtggtcacctgagatcaggagttggagaccagcctgaccaacatggcaaaacccagtctctactaaaaatagaaaaattagccgggcatggtggcgggcacttgtaatcccagctactcgggaggctgaagcaggagaatcgcttgaacccgggaggcagatgttgcagtgagctgagatcgcaccattgcactccagcctgggcgataagagtgagactccgtctcaaaaaaaataaaaaagaacatcgactcagacttgctttgctggaaagtatattagaatgtgtctcatcccccttgtatccatttcccagggctgctgtagcaagccatcacacaccaggtggcttacaactgggattcattctgtcgcagttttggaagcagaagtctgaaatcaaggtgtgggcagggtgggttccttctggaggctctagtggtggatccgttccttaccgcagccccgagcctattcccatggcctcaggggcttcccatacagtgcataggatggcctcacctcagaaagtgatccagacccgaatgtccacagtgctgaggctgagaaaccctgtcttagcttcaaacgcacacatacactctctctctgttttgctcgctggctctctttctctctgtctcatatattgatctagctgtctatctatttctccgtaggtatctacctatatccatctgtctatctgtcatctacttctttttctttttcgttagagacaaggtcttgccctttcgccccagccagactgccgtggcgtgatcatagctcactgcagcatcaaattcctgggctcaagcaatcctcctacgtcagcctcccaagtagttgtgactataggggtgcaccaccatttcctgctagtttttaaattttttgtagagatggggtcttgctatgttgtccaggctagtttcaaattcctgggctcaagcaattcattcgccttggcctcccaatatgctgagattacaggtctgagccatagcacttggcctctcatgtatttgtatctctatctgtctctctctctctttctctctctctctgtctctctattatctatgtatccattcatccatctatccatatctatctatatatctatccatatctatctatatgtctatctgcctatgcatttatctatctatatcatctatatatccatttatccatctatattatctatccatatctatcatctatatatctacctattctttctatctatatatctatccattcatccatttatccatatctatcatctatatatctatccataactatgtatctacctatctatccattcatctatctctatccatctatctatctacctacctgtctgcctattcatccatgtatctacctctatccatcatttatccatgaatctacttctttctatcaatatatccatacatgtatctatatctatttagcaatcatctatccatgtatctatttggatctctatcaatccatgtattgatatttacctatctatgcattaatgtatctatatccatttatccatgtatctctatgtatctctacatttcatatacatttgcacttcttatatatgctatgtctcaaacacgtgcccactcacatttgcatgtgtgtctgaatgtatacacacatacacacacatttagtgaaggggcaccctgacttgatttgtacatatctcagtggtgacagtcatcagcaagaagcagccccaggacctgggctgattgcacccttctcaggccccagcctgagtcccaagcatcactgcggaggctcacagaagagtccacccagccaaggccacccctgggacctctcctcactggaggagcctcatgcctttggcttccatttctcttcaaacggcataatgaacacccacactcctggtgtgcccttgggatataaaattagagccagattaagcatgcttgctggccctgtggtgaccactacaaatgaggtgttttccacttcccatcatttccatgcagtggtatttaaaaaggaaatggtttccattgcaaaacattttctgtgacttttggctgcaatattttgctgcttatgctttttttctcatattttccttcccctgcatatattttctttacattaaaatttttctttaaaaatattcctttctttttttttttttttttttttttgagacagtctcgctttgccacccaggctggaatacagtggcgcaatctcagctcactgcaacctccgcctctgggttcaagtgattcttctgcctcagtctcctgagtagctggaattacaggcgtgcaccaccatgcccagataatttttgtatttttagtagagacagggtttcatcatgttggccaggctggtcttgaactcctgacctgaagtgatctgcccgcctcggcctcccaaattgctgggatgacaggcgtgagccaccgtgcccgtccttgccttggcatctaaaaaggaaatggtttccatcgcaaaacattttctgtgacttttggctgcaatattttgcttcttatgctcttttttttcctcatacttttcctcccctgactacattttctttaagttttttctgtacattaaaaatattatttatatgttaagtataaagaatatttcaaccactcttctgtaaattaaacaaaaaagaagctgaattttccaacagtgacatgcagtacaacagcatctccgcaggcagacgagaaaaaaagtgatctctcccaacaaaaaaatgctgacagtaagaaattaagccccatgtttttatgtgaaaactcccggttcaaaaccatacaaacattgaaacctcatgtgaagaaaattgtccgccaaattcatctctatattttatttgctcttcttgaggataatttggaatacaatcagtcctctgccagaataatgtttattactccatttattccaaaaagcatgttaggaggctttcagacaaaatggctttaatttgacttttaaaacagaacggcaacattctaggaatcagagccagaagtcaatgccttttatagttatctattttcaagagttgaattttcctggcacaacagtactagaagatagaaccccagttgaatgggcttttcattcttagtcctatgactttctttttttttttttttgagatggagtcttgctctgtcacccaggctggagtgtagtggcatgatctcggcttactgcaacctccacctcccaggttcaagcggttctcatgcctcagcctcctgagtagctgggattacaggctcatgccaccatgcctggctaatttttgtatttttagtagagacagggtttcaccatattggccaggctggtctcgaactcctgatcttgtgatccacccgcctcggcctcccaaagtgctgggattacaggtgtaagccactgttcccggccctgtcctgtgactttcaaggggggacagcccttgacatgtaatttttgtgcttaatctatatccctggactatagtcctcttttcacccttctatgtccactttctgccctgggagttgatttttagagactgtatcagaaggactcagccctgtgagtttctaaatagtgttggccgatctaggggactgaaatttgacagtaaaacctgtactggggtgaacagtggcccttccaaagtcctgtctcccagggacttcagaatgagaccttatgtggaaatagggcctttgcagatgcatttgttaagatgaatgagagtgagccctaaatccaatgacaggcatccttctaagagacggaagaagagacacagacagagacacagaggagaaggtcacgtggagatgcaggcagagactgagataagatggccacaaggccagggactcctggagccacaaggggctgggagaggcaaaaaggagcctccgctagagcctctggaagcaactggatacaactgtagtggactgtacagtggtcctcctaaaagatatgtccacgtcctcatccccagaatctgcgaatgggaacttatttggaagcggggtctttgcagatgtaattgagttaagaatctcaagatgaaggccgggcccggtggctcacacctgtaatcccagcactttgggaggctgaggagggcagaacacctgaggtcaggagttcgagaccagcctagccaacatggcgaaaccctgtctctactaaaaatacaaaaattagctgggtgtggtggcaggcgcctctagtcccagctgcttgggaggctgaggaaggagaatcgcttgaacccgggagacagaggttgctttgagctgagattacatcgctgcactccagcctcggtgacagagcgagactacatctcaaaacaataacaactgcagcaacaaatcaagatgagatcatcatggcatagggtggaccctccactcaatgacaggtatctttgtaagagacagaagaggagacacagatgcagaggagaagtccacgtggagatggaggcagagactggagtgatctggccacacgcccagggacgcctagagcccccaggagctaggaggggcaggagggattttcctggagggagctcatgtctgtgtcccaatatcttcttcttataaggccactaatcatatcagattaggacccaccgtaatgacctcattttatattaatcacctttttaaagaccatatctccaaacacagtgacaccctgcagtcctgggagttaggacgtcaactgataaatttagaggacagaattcagctcacaacagtctttgcagttgaggtcactagggtgggccctgatttagtgactgctgtatttataacaagaggagatgaagacagacacagaggggaaggccaggtggagacggaggcagagactggagtgatgcggccacaagcccagggatgcctgcagcccccaggagctgggaggggcaggggggatcctcccctagagcctccagaggaagcacagccctgcccaccccttgatctcagactgctgctctccagaactgggagagaataaattcctgttgttttgttttgtgtttgagacagagtcttgctctatcattcaggctgcagtacagtgatgcaatctcggctcacggcaacctctgcctcctgggttcaagtgatcctcctgcctcagcctcccaagtagctgggattacaggtgcgcactaccacacccggctaatttttgtattttcagtagagacgggttttgtcgtgttggccaggctgctctcaaactcctgacctcaggtgatccgcccacctcggtctcccaaagggctgggataacaggcgtgagccaccacgcccgatcagttcctgttgttctataccactgtttgtggtcatttgttatgccactcccaggaatctctttcataccctctagtctcctctgagtccctcaggcagcagcacacccctcccaacggctgcaccacctggttatgagcccaggctccgcatgtcaccccagttcagctctctgtggccgcaaggcccagcacagaagctcctgaccatggcctccccatccctgaatggcccttcccaccattgcctgcttggacactgactgatacgatcctgccctccctgtcatctcggtgatcccttctccttctcagggctctgttccttcctgcctttgctcacacatcccctgttgtgtgacagatttttttttttttaatttcaattgttttgggggtagaagtggtttttggttccacggataaattctttagtggtgatttttgagattttagtgcacctgtcacctgaacaatgtacactgtatccaatatgtggttgttgttgttgttgtttgtttgtctgtttttgaaatggaatctcgctctgtcacccaggctgcagtgctgtgacgtgatctcggcttactgcaacctccacctcccaggttctagcaattctcctggttcagcctcccaagtagctgggactataggcacatgccaccacacccagctaatttttgtatttttagtagagatgaggtttcaccatgttggccaggatggtctcagaaactcctgacctcaggtgatctgcctgtttcggcctcccaaagtgctgggaatacaggcgtgagccaccgcgccaagcccgaatatgtagccttttatcttcacccaccttccacccttaccccgagtccccaagttccataatattatcgtgcatttgcattctcatagcttaactcctacttacagatgagaacatacgatatttggttttccattcctgagttacttcacttagaataatggcctccagggccaagtgcggtggctcacacctgtaatccttgcactttgggaggctgaggcgggcggatcacctgaggtcgggagtgtgagaccagcctgaccaacatggagaaaccccatctctactagaaatacaaaaaaattagctgggcgtcgtggtgcatgcctgtaatcccagctactcgggaggctgaggcaggagaatcgcttgagcctgggaggcagaggttgcagtgagccaagactgcaccattgcactctagcctgggcaacaagagcaaaactccatctcaaaaaaaaaaaaaaaaaaaaaaaaagaaaggataatggcctgtagcttcatccaagttgctgcaaaaggcattatttcattcctttttatgtctgagtagtattccatggtgtatatataccacattttgtttatgcacgcattggttgatgggcacttagatttgcttccctagctttgcggttgtggattgtgctgctataaatgtgtgtgcaagtgccttttgcctataatgactttttcccccactgggtaaatactcagcagtgagacggcttccccaaatggtagttctactgttagttcttcaaggaatctccacactttttcatagtggttgtgctagtttacattcccgccagcagtggaaaactgttccgtaggatggttttgatggggccattttacatctaccctggtttgtttggcccagtaaacaaaccagaactaattcctgaaagtaacccaagggaatctaaattcttcttccttctcatgaattcctggaactatcacacagctttttttttttttttttttttttttttttttttgagatggagtcttgctctgtcgcccaggctggggtgcaatggcgcaatctcggctcactgcaacctctgcctcctgggttcaagcgattctcctgcctcaacctcccaagtagctgggattacaggcacccaccatcacgtctggcaaatttttgtatttttagtagagatggggtttcaccatgttgaccagtctggtcttgaactcatgacctcaggtgatccacccaccttggccacccaaagtgctgggattacaggaatgagccgccgtgcccggccctagcacagctttttattactgtgtgtgcatggagcaacaagacccttcagcattgacctgcaagcactccttcagccctcaagttggaagacgttgcaacatgaccctatgaaacaattgctaggtatttctcccagaatccagcacagagctgaccattccataaatagttctggattggctgataaatattcctctgtaatgctttgtgtatattggagttaatgaagatgtgttgacttaaagctattaaacttgtggcaaccaatcaatgtctgtagtcttgttatcagaagtgcaccagtgttggtgacctggctctgatattgcaccccaatcctaatagaaaatgaagctgggctaagggcaaatgaaactctaggtgggggtcttgtgtacttgcatcttccttagactctttaattatctcaaaaggaaatttaaagaaaaaatataaaattacaatttgtaaacattatgcagaaaactaatttggaaaagtggtacattttaccacgtcttgttatatttcaaaatctaaatttgcttgggcgtcatgaaataatcctgtctggaaccaaaaaccttcccatctttattttttatttatttatttttgagatggagtctctgtcagctgggctggagtgcagtggcgtgatctcggctcactgcaacctccgcctcccaggttcaagcgattctcctgcctcagcttcccaagtagctgggattacaggcatctgccagcacgcccagctaatttttgtatttttagtagagatggggtttcaccatattggccaggctggtctcgaactcctgacctcaaatgacccacctgtcttggcctcccaaagtgctgggattataggcttgagccacagccctcggccccacgtttatctttgaagttgacttaacatcattccctgttaaggagaggtagttttattacattgagtaacaaatctgtctgcttctttgaaatcagggttaagcattaactagaacccatgatggggttaaagtgatggatgcataaacacacacacatacacagacatgcatgcacacctgcacacacatcaattaaaattcggttcattgatttgccggtgacgagaacctgcaaacagaatgtgcaggtgtcctgatctgaccctggaagagagagaaaggttcaaagatgagctcttttagtttcaagatatgagtcaactgccttggattcatttccttgttttctttttttttttaatattagggatgtcaatgactcctcataagatgatgaggagagatagatggtataaagtgtattataaatgtgatggttcttactgcctgcttaaggttctagtgcaatagaatattagggatgtcagtgatttcctcataagatgatgaagagagaaagatggcataaagtgtattataaatggtggttcttactgcctgcttaaggttctagtgcaataaaatatgagaaatacatggcttataattcaggcagctattaatgtgatcctgttggacttttgtctgcccatatatggccaaccaagaccgaacaaagtatattccttaaatgttggaagaatctgcaaaccacagactagccagtttggtgttaatcgccagaagatgattaaccatggaaatcaaagccagataaacagtttctgatcataaactgaacctgtgtgtggacctcccctttctccagccccaaaaaggattgcaaagcccttgaggatgctttatcttgtgtcgctcagggtgcctagaagagcgttgaaaactggcaaattctccataatgtgtgtgttggcatggggaagtggggacgatgggaagctcattaggtacgcagccattagcttttgcagcaaaacaaaccaccccaaaacgtggtgctttaaaacaatacccatttagttcgttcccgattccgtggctcagctgttcaggtttggctcagtgaggcagctctggggtcagctggattcactcatgagtcagtgctcagctgccgggtggccaggagcaggctggtttggatgactcagctggggcagcttggtttagctccaactggtctctcagccttcgctgaggcagctcatgcttatgcatatggcagccgggaaggtttccaagccagggagctaaggcgtgaacagcctctaaaagcccaagtgcagaaatttttaaaaaatgcttatttatttgttttcagagacaagatctcactctgtcaccccggctggagtgcagaggcacaatcatagctcactgtaactttgaactcctgggctcaagtgatcatcccacctcagcctcccaagtagctgagactctaggtgtgcaccactatgtcctgctattttttttttttatagagatggggtgtcattgtgttgcccagtttggtctcaaacttctggccacaagagatcatccccacctgatcccatactgcctacccaccctcacctcccaattctcttcctactcattaaggtcataattttttccctcagtgtctgtgtttttgctcatgtgtgtatgctctctgaaatggagcattttctatccggaagactcctacacgttccgcacaacccagcttaaatgcagtctccttcgtgaaacatttctcaaccagcatggcctccatttttctcctttttcctcgcacagcactctgcgcagcactctgtgtccatcatctgtagactatatcacgttgtgtgagatacattgttatttttggtggtggtcgtggtgtgttttgtttggttttttgctcttcctcaatggaacaattgggctatttgatgaaagaaaaaggacttactcaccttggcatgctttgcatgtaggagacaatctgtaacactctatttgctaagtcaatgtttattggataaatcaacataattttcatgttattacattacagtgcttaaatgtgcttgcgtcagctctgtagctacaatgatgcacatattgttgttggaagagattatatttttcataaatggccacagcaatatttctgtcccacactctcttccagaaccttggtgcttcccatcaagagtgggaatctgattcccttttccttgaaattgggtggatatttgtggctgcttttgtgcagaggggttgccacatgacttcagaaaccaggttgtaaatgtgctgtgactgcacattatttttatttatttttttttttgtgatggagtctcgctctgttgcccaggctggagtacagcggtggaatctcggctcaccacatcctccgcctcccaggttcaagcgattctcctgcctcagcctcccgagtagctgggactacagtcaacacaccaccatgtccggctaatttttgtatttttagtagagatgggtttcactatgttggccaggctggtctcgaactcctgacctcgtgatatgcctgcctcagcctcccaaagtgctgtgattacaggcgtgagccactgtgcccagccacagtggcttttttaaaccagtaaattttggatagctagttatacataataactgaaacaatcaggcattttagaattcatatgtaagctaacttttaccatgtagcattctcacacatatataatgtgtgtgtgcatttatgtgtgtgtgtttgtgtgtgtgtgcacaggcaaaagagatagggagctttattgcctagtgttttgtggtcagctcacttttgccttgcctgcattcagttgagcagttaagcatctaaagtacccagtctgtacactgggctgtctgccaggtaccgtgttaaaaacaaagttgagcctgctcctagcttgttggaaaactcagataaacacaaattaacagctctcctgtcacattctatgttttggaacaccctaggatggctttctcagattcagcactgtgaccatcatagtcagcacttgtcatgatcaagactcaaccttaggtcttggatacagtcctaacgggccactggttctaacccacaaggttgtttacctatctaagcagacttaggggtaaacaggattcctgcttcaaatacagtattctgggaagttgattctttcttgactctgagccaaactaaatgcaagcataagcttcatcaacaaagtagttgttcatatattatgcaacttccgtaatgccttttaatttcttctgaagactcaaccaatgctacaggtaagaaaattaaaaagacacacagacataggatcacacatcaagtttttgccaaattaaattattgttttgaaaataatttgcagcactgatgggcacacaccgtaaaatttccaatgtatgaactctgggctacaagacactctttatctttgcctgctgtgaacgctctgaggaaaattccggtggttttgaggcagtcacaaggcaatgtgctgcatacggcctggactcagaagcaaagggctcttgattttaatcccagcccaccgctgacaagctcaacggccccaggatgtttcctcatcagcagaggtgggctaatgaatccagatcccctgtttcacagttgttcctcaatgaatgaacacctagaaagttatacaacaatacaaaaatatcaggtagaaatttacttgtttgtaagtctgtcaatccatccatccactcacccttccatctattcatccatctatttttctagccacccgtccatccatctatccatgcacctatttatccatccatccagttatccatccatctatccacatatccatccacacacccacccatccatccattcatggatacaaccgttcatctacacatccacccacccacccattcaccaaactattcatctatccatccattcatggatacaaccattcatgtacacatccacccacccacccattcaccaaactattcatctatccatccatccatccctgcatacacccactcgtcgatccatccactcatccattcacccacccatctacccatccatctgtccatccatccatctacccacccacccatctacccattcatccatccatccatttattcatccatccatacattcagccacccatttactgaaaccttatctatcatccatccagccagccagccatttatatacccacccgttcatgcatccattcacccacgcacccatgtgtttatccatccattcattcatccacccacatatccacctacccattcatccaaccctccatctattcacccattcatccatccacccacccatccatccactcacccacccatttgtccatgcattcattcatccacccatttatttattcatctacccatttatctctcagtcaatccatgcatccagatgtctgtccatttatccacacatccacaacccccacccatccacccatgtgtacttccatcctcccactgactcaggaaacttcatttgagcatctgtacagccgacattgcgtgtggctcagacacctcttaactgccttggctgcccacaagtacctcacaggaggtctctgctataaattgggctcagcccctggcagtggagaccagaaataaaaagtgatttaaataacactgaaacaaacctgactttttaaatggtaagattaaaaacgtactcttctgtcctgtaatgaggtcaggagagttggtctgggcctggcacagctgtcttgcagtgtcaccagccaccctggcacctttgctccatatattctgccattcttggaataggacctctaccctctggaggacttcctgctctaagctagctgctggaactccagacatcacgtcattattccaggcaggcccagcatgatgcagagaaagcgaaaagtgggcttgttggccaccagtccccctcttaagggactcctcagaagtttcacccaataactttggtttacattgattttattaaccagaacatagatttttggttacacctaactgcaaaggagaatgaggatatcgtctttcagctgtcacattgccaaaatcagtaaattcaaggtctcttaatataagggaagaaagaaaggatataggataggcaactgtagtctcacacgtgcatgaggaatggatggaaggatggtggacaggagcgcgtatgtaaatactttttagtcttctcaggctgccataataaaatagcatagactgggtacttaaacaaaaggaatttattttctcacagctctggagactgggaagtccaagatcaaggggctggttggttcaattcctggtgagggctctcttcttggtttgctgtgttctcacatggaggagagacagagcaagcatgccctctggtatttcttcttacaaaggcactaactttcctgcatagggtcctaactttacgatttcatttaaccttaattatttccttgctgcaaatacagacacatggggaacagaacttcaacacacgaatttggggagtagatacaactctgctcatggcacatataagcatgcatactaaatgtgtgtgtgcatgtgggtcaatggaaagattggaagtctcattaatagcacatatatgcatgcatactatgtgtgtgtgcacgtgtgtctgtatggaaagataggaagcctcattatctaaatgcctagcctttcgggtgagctaatttttgttgtgtatgcattcaattgagtaattaagcttctcaaaggctgcctctctttgttgggctctctgcctggtgctgaggtacagacaaagatgtgactgctccacagcttatggggaggctcagataaacacgaataaatctaaataaacacacataaattaaggcctatttaaataaacacttgctgctctcagaagcagagccacggctgtttgattttactgctgtatcccacagagcagatactcaaaaagctttgttgaggctgggcatggtggctcctccctgtaatcctaggacttggggagggctgagactgggggatcgcttgaggtcaggagtttgagaccagcctgggcaatatagtgagaccctgtctctaaaataaaataacctgggcatggtggtgcagtcctgtggtcccagctactcaagaggctgaggtcagaggatcacttgagcccaggagtttgagaccagcctgggtaacatagaccccatctctaaaattataaaattagccggacatggtggcacattcctgtggtcccagaggctcgggaagctgagatggtaggatctcttgagtacaggagtttgagaccagcctgggcaacacagagagacctcatctctgcaaaaaataaaaataagcgaaaataaacacaatatttttaaaaacatgaaaaagctttgttgaataaccaggcatgttgagaaatcaccaagaatagagcactgtaggaacctggggagaaaaaagctgagttgttggtgcaggagccaagcagttaggggtacatgaaagaaaatcgctagtgggctgcaccctggcaaatgcagctggacgaaagatctgatgctactcattcccgaaggtcacattcttaagcttgaatgggtggcagagttgacctgactcagggtaatggtacaggaatatacatgtgcatatatatcatactgcaaatgtatccgttttgaatctgactctctaagaataatctacaggccaggtgcggtggctcccgtctgtaatcccagcactctgggaggccgaggagggtggatcacctgaggtcgggggttcgagaccagcctgaccaacatggagaaaccctgtctctactaaaaatacaaaattagctgggcatggtagtgcctgcctataatcccagctactcaggaggctgaggcgggacaatcacctgaacccgggaggtggaggttgtggtgagccaagatcacgccattgcactccagcctgggcaacaagagcaaaactctgtctcaaaaaaaaaaaaaaaaaaaaaaaaaaaagccgggcacggttgctcacacctgtaaccccagcactttgggaggccgaggcaggtggatcatgaggtcaggagatcgagaccatcttggctaacacacggtgaaaacccgtctctattaaaaatacaaaaaaattagccaggtgtggtggcgggcgcctgtagtcccagctacctgggaggctgaggtgggagaatggcataaacccgggggacggaggttgcagtgagctgagatcgcaccactgcactccagcctgggcgacagagtgagactccatctcgaaaaaaagaaaaagaataatctagacatcaggagagcatctgctggtcacaatttgggagaacagggagataagaacatccagcagccacccatccatctattcatctgtctgtctatccatgcacccatccacccatgtatttatccatccatccatacatacatacatccacccacccattcatccaaccctccatctatcaactcattcatccatccatccattcatccacccacaatccaccccatccacccacccgccctcaattcatccacccacacatctacccatctatccatctatccatccatccacctatccatccatccactcatcctatctgaattgtgtctgtgagactcctccatggtgaaattattcttttcctaattttttatgtcatacactttggaagaagtggggatctgtgtccacctccttgatggtgagagcagcagtccccaacctttttggcaccagggactggtttcatggaagacagtttttccacagaaccaagggtgggagggatggttttaggatgattcaagcacattacattgtgcactttatttccattattattattattattattattattatattgtaatgtataatgaaataattctacaactcaccataacgtagaatcagtaggagcctgtattagcccattctcgcactgctatgaagaactacctaatttatgaaggaaagaggtttaattgagggggatggtgcaaaaccattcatgaaggatctgaccccatgatccagtcaccttccaccaggcccccacctccaacactggggatttcagtttgacatgagatttgggcggggacacagagccaaaccatatcaccaccagcacagcaccaagcatcttgccactcagaaagaatgccaaaatttctctctagacatattttatttttattttatttatttatttatcttttgagacagagtctcgctctgtcacccaggccagagtgaagacgcacgatctcggctcactgcaacctccgcctcccaagttcaagggattcttgtgcctagctgagattacaggcacttgccaccatgtcgggccaattttttttgtaattttagtagagaccgtgtttcaccatgttggccaggctggtcttgaacttctgacctcaggtgatccacccaccttggcttcccaaagtgctgtgattacaggtgtgaaccaccgtgcccagtctagacatactgacatatttcctttttctttttctttttttcttttcttttttttttttttgagacagagtctttttctgtcacccaggctggaatgcaatggcgtgatctcggctcactgcaacctccgcctcctgggttcaagcgagtctcctgactcaacctcccaagtagctgagattacaggcgtgcaccaccacaccaggttaatttttgtatttttaataaagacggggtttcaccatgttggccaggctggtctcgaacttctgacctcaggtgatctgcctgcctcagcctcccaaagtgctgggattacaggcgtgagccaccatgcccagtctagatgtattttcttcaaagatgcacttatcattggaagtggttctttctgacagctcccctgccccgatgctttccttcctgttccatggagttccatgttctgtgctgtgtagtttgattttcagtcctcctttgaattctgcagctgtgtatttagacccatttcccaggccagtaaacaaagccccgtgggcaagaaaccacagatccccccatagaaagtgggagaaaatgccagtgtgcaatagtgtgtgcatgtgtgtgtgtgtgtacgtgcatgtatgtgtgtgtgtatgcatgtgtgtgtgtgtgcatgcatgtgtatgtgtgtgcatgcagatggaatataattataacctgcgtgtgtgtgcagtataaaatatataaaactggtttggagagcagggtatgaaaagtccaaagtcagaagaactaatccttggctgtgggtggtggctcatacctgtaataccagcacttcgggaggccgaggccggcagatcagttgaggtcaggagttcgagaccagcctggccaacgtggtgaaactccatctctactaaaaatacaaaaattagccaggcgtggtgatgggtgcctatagccgtagctactcaggagactgaggcacaaggatcgcttgaacctgggaggtggtgagctgagatcgtgccactgcactccagcctggacaacagagtgacactctgtctcaataaataaataaatagaagaagaactaattcttaaaaattaaagacacatggaaggtttccgcaggaggctgggagctaccaagggttaggttgaaatgtgcaacgtggccacgtgggtccctcggaaatggtcagaacatggttatttcttgaggttccactggtgaaataaacgggaaacatggaggctgccccagcagtgagttccccatcccttcttcagcctagtttgtggccttcaaaagatgcttcccgtggcacctggatacaattcagaaggctttttcaattaatttaattttcattctggaggttacggcctcttggtgccagttccagagggtctgcagaatattatggaaattcatatttggagccaaagaatggcagcgttaaaaaaaaataaagaaaaaaggcaaaaggcatctaactaaatgaattagaaacagaagtcttccaaatgcttacctgtgagaacatagataaaaagcctcaaagcctggctttcagaagctgatgttgcatctttattatggctggcgagaatgacctgcgccctccctgaaaggcagccagagtctagactctactggaacataatggacagtcagaggagggaagcttcacctgcagtgccgtccaaatgtcagaggctggagatggtccaggggagggcctttcttttggcggtaatgggggtgaagcaggaagctcacagggagaggggtgtttggagtgtgagacagcaggaagaccctgcgttctttttatctctgcttcatcccaagtcagacttgcctcaggatgccaaaatgcccgggcagctccagcatcctcttgctcctcaaaatgagcccccagggtcctcctacttgccctgacctaggatccacaccctcccttgaccccagcccaggactgtggccagggaaaaagaaagtgctaattgatagagagtcaatgccacgtggggaggtcgggggagaggtgcaggagaaaataccagagaaggagctctggttgggtagttcatccgggttcactccaagaggtaacactttaaaggtggtgttcccatgaagaacgattacattttcctcatacttctaaagtgcaattatgttgctggggttttgctggccgaaaagaaaacgaaaaagaaaagaaaaaaccttccggtgtgcaagctcacactgttactttttaagatgtgcatcactcacaccaccgagctcacattgctgagcaggtctctggggcacaggcccagcccctctagccttgcaggtttctgacctaggggtgcaggtgacctagggaggggtgggtatggccgcaggcaggggatagctcaagaccatttgacccagcaatcccattactaggtatatacccaaacgattataaatcattctactataaagacacatgcacacgtatgtttttgcagcactagtcacaatagcaaagacttggaaccaacccaaatgtccatcaataatagactggataaagaaaatgtggcacatatacaccatggaatatacgcagccataaaaaaggatgagttcatgtcctttgcagggacacggatgaagctggaaaccatcattctcagcaaactatcacaggaacagaaaaccaaacaccgcatgttctcacttataagtgggagttgaacaatgagaacacatggacacagggaggggaacatcacacaccagggcctgttggggggtggggtgcaatgggagagagagcattaggagaaatacctaatgtagatgatgggttgatgggtgcagcaaaccactatggcgtgtgtatacctatgtaacaaaactgcacgttctgcacatgtaccccagaactttttttttttttttttgagacggagtcttgctcagtcgcccaggctggagtgcagtgccacgatctcggctcactgcaagctctgcctcccgggttcacgccattcttctgcctcagtctcctgagtagctgggactacaggcgcccgccaccacgcccggctaatttttttttgtatttttagtagagatggggtttcaccatgttagccaggatggtctcaatctcctgacctcgtgatccacctgcctcggccttccaaagtgctgggattacaggcgtgagccaccgcgcccagcctgtaccccagaacttaaagtataataataacaataataaaaagacaggtgttatctcagagcccctgactcagtcggctgggcagcaagtatgccagcccaggaatgggccaatagatgaggcagggctttgtaaaccaaaaataaaattctttaagaggctggagtgggtggatcacttgaggtcaggagttccagactagcctggccaacatggcgaaaccccatctctactaaaaatataaaaattagccaggcgtggtagcaggtgcctgtaatcccagctactcaggaggctgaggcaggagaatcgtttgaacctgggaggtggaggttgcagttagttgagatggtgccacagcactctagcctggccgagagagtaagactccgtctcaaaaactaaataaattaataaaataaaataaaattctaagcccccaccgccccccaccttcaaaacatctgaatggacttcttcctcagccagagctctttaaaaatttaacctgagagagtgtttcaagccgtgacgggaagcaggggttgaacatgcctcccggtgcctctccggcgttaacatccacacagcctttaagtttgagaagaaacattttacaacctcttctctctgaccctagcaccggaagggttcctgttcaaataagaacttgagtcttcacaattctttatcttaacccagacattcttttctattgatcccaggactttaaagaaacccaagcaattgccaatcagaaaattctaaaatctacctataagctggaagcctcctgctttgggttgtcccgcctttctggacaaaaccaatgtgtctcttaaatttcattgatgtctcatgcctccctaaaacgtataacaccaagctgcaccccgaccaccttgaggacacgttctcgggacctcctgagggctgtgtcatgggccatggtcactcatatttggctcagaataaatctcttcaaatatgttagagttggactcctttctctttttttcttttttctttctttttttttgagacggagtctcgctctgtcacccaggctggagtgcagtggcctgatcttggctcactgcaacctccatctccccggttcaagcgattctcttgcctcggcctcctgagtagctgggactacaggtgcacaccaccacacgcgtctaattttgtattttagaagagacagggtttcaccttgttggtcaggctggtctccaattcctgacctcaggtgatccacccgcctcggtctcccaaagcgctgggattccaggcgtgagccaccgcgcccggcctagtttgactcttttcgtggacagtttgaagtgtggaatgcaagaatattcagggttatttgtcaggctgcaaagttgttccactaccctgcgggaaaatggatacaattttaggcttaggtgttaacagataacattgttaagtgtgggaagggcgacaactgcactgcagctgtggccagtggcgcgggagggtgtctaaactcaaagcccactggaaggcgagtcgcccatgaccaggactagggcccaggtgccccagatagaaggcacctcgttccctattgcccctcactaactcccgtgaccaggagtccccactcccaaccttgtcctggggattctggggagaaactgccccagcgcagaggctactccaagggttgtccttggtccggcgcaaagggttcgtccgccaccctcccggctgcgcaccccgcgctcggacgctctagaaaggacttgggacgggggttgcctgtggagcgggggcctaggcttcctgagcagggagaggattgcactttgctccccttggggaactccctgaggtgagcagcggggaggggcccccatacttttcccagcaggggagccgggagtttcctctgctcccactgcagagcaggggagggtccctgctaggggcggagaaggggctgcaggggcgagtggggaggggggctacacgtttccaagaagggcggcagtttcgtgtcgctacagttgcaggcgtgcatttaggaggctgtagacagggagggacccgcactttcccgagcaggggagctgctgggaaagtttgtttttttgctcccactggagaccagggggtgaggggcggagaagtggctgcaggggcgagtggggagagggggctctatgtttccaagaagggcggcagttttgtgccactacagttaagggccgccctcgggcgtgcattcagagggctgtaaaccgggagggacccgcactttcccgagaacgttgtagttcactttgcttcgggtcggcgccgccctggctacggccctgtgggtgggtgagggggcgtgggcagtttcctgagaaggggcggggcgtgtaccgtactcccctcggcgctgcctgggccacccccgcccgcctaccccctctgtctcctccccgggcccggcgttcccgccccttctgtgcgcgcgtggaggccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccgggtgagcgagcggagggatccgggttgggggacgcggagggcgcgggccgggactggggatccgcttgagatgcggcgttgggggcgccccgcggggacacccggagcctcctccctgcccggcaggacgcgctgtgcccacgggggcccaggcccggaggaggcgcccactttctccccaacgcttttcctggagccgttccagagagaaaagtcagcgtttgttgtcggagttgcaaactcttacatgtggggcggccttgggagaggtgcgtccgatttttcccaatctaggggaccttcttacagatctctctccctttgcatgagcccctcaccccaccccgttatctacccccagggtttggggacctgcgtcttcaggccgcgcgcggaggccgccctggagttgcctgtcacagccacgccctgcgtcccgggcctaaatttggaatcgctaggagcctgagacccgggtggtggggggaagggaaggaaaagttagaaaaaaactttgagccctgaaaatgttcaaaaatactctgtggatgcgggctccgggaatttcagcgcgtgctgtgcgccaagcaacacggggcgcagaaagaaacgtgtgcttaccaaattgtccatctgcggcggtggagaattcggaaaacagaaaaagtgggcagggaagaaagagccacggtcaccctcccacgccctaaaccgggcctatttctaattattactttaatcatgtttttctgtttccctccctttgaaacggaaacggagaccctgccggatgtggtatgttataaattcttttttcatgttataaattcttttttcaatggtcagtgcattttttgctcttcgtatgggcaggcttttaagtagaccggcttgcgggcagtgtggacttcaggacgggccttatcagggctggacgtatttaggaaggagacgcgggaacgcccggccctggggaggacggaggaggcccgatttgtgttgataggatctagctcagcctagagctgcggtgactaggccgggtctctatttttagggaggagttgctaatggatttacaccctctttaaaggggtcccgggtatcctagaaattgtgctttcacttggtagagattagagataatgaagcctgctccgtagaggaaaacttggaggactttccagcctgcaggggaggttccaagcagagcttcctgtttctcccttttcttcctaaatgtccttcttgcgggcaacctgtcaccacggacgggatggctctgtagggttttatcagctgcatttgttccccaggcacctgcagatgaacgggtttttcacttgtctctctgcgaatgcattccttcatccttcatgcctgccttccttcttttgcacctactgtgggcttggggtcagggaaatatatccaagggagtgctggtggcctaagaattcagtttcctggagaacagaggcatctgaacaggcagacgggagacagggccacagggacctttatagttccatcacgaaataactcaggggttcccagtggtaaatcttggtgaggggcttggctggattttgaagccctagggacagatttgccggctggtctggcgttccaggtcattggagcagagtgagtggaaagccttatattctctaagccccaaacaagtcgttgcacagtttttttgtttttgttggtggtggtggttttttttttttggacggagtttcactctgtcaccagtctggagtgtagtggcacgatgtcggctcattggcgttgcacagtttttaaacccacagcagtgttcatctggaactcctgattttggaagcagactgggcttaggaactccagctgctgatgctttgagtaaagggaagagtacctgtctatggggtgggtgggtagggaagagcagtgggataggggcataacaggggccaacctatccttccaattgcagaggagggcctggccgtcagcactgatggatctccttgagggacgcttctcaccccttctttgcagtctgaccctgctagagatggagacagaaacagcctgtcccaataatattaatacacgtttcatcgggaaagttgacttttgagttggtgatgctcagaacacactttcttatagcaacgtgcatcaggctgcaaaaccccgttgagcctgaagtaggttctcagactggtgctgatagctctggcctgatctcagagtgttggggaccctgtgttccttggttccttcataaattctcaggggtacaggtgggatgtggtgagggatggatggacagagggaggtgtatagaggaaaagaggaggcttcagctttgtagagagcaggatgtccccacagggcgacgttggccccgaggagacactttgtgatggttgcagacatttttggttgccaccctggggtgggacatcccaccatcctgcaatgggtggggcagcttagggaagctgctcagaatctttcaagggccaggacggcctccagcacaaagaattcatctggtcccaaatgccagtggtgttgagggtggaaaaccctgaggagggcttgggagttgcatgtatgcgctgattcagggctgcccctgcagttaggagcctgccgtcccgacagtagagtcgcacacatccgatgcatccctgctctctggcaaaggctgatttgccccaccccccggggcaacggcacagcggcctgtgcggtttgaaaaactccaaacatctacggaaccgacatctcttgaacaataccaggcctcttcaggattccctcgccccagtagagcaagtgtgggcttcgttgtttttttttttttttaactctctccagagctcttgtctcctgcccctgtgggtgtgtgtggaagttattaggagaatgtttctgggcagaggaagtgggttttatcatccagcgagtttgccttgattttccatcagcgcgtttggctctggtaaaagttgattgctttgcatttaactccctactttaggccgagcacggtgactcaggcctgtaaatcccagcactttgagaggccgagggccggtgggtcacatgaggccaagagttcgagaccagcctggccaacatggcaaaaccccgactctactaaaaatacaaaaattagccgggcgtggtggtgagcgcctataatcccagctactcaggaggctgaggcaggaaaatcacttcagcccgggaagcagaggttgcagtgagctgagatcgtgtcaccgcattatggcctgggtaacagagagagactcagtctcaaagaaaaaaaaaaacttcctgctttagctctttctcctttctctgtgtatgagacagagttttcatgtaaagacaaatacatgtctttacactttggagatactcaagtaaatgattgtttgtctggaaatcatttttcttcctgaaggtcctatggtgggtacatgctgtcatttagaaagaaatgcagctcatacaatacttttcccaattcagcatttaggaatcatggcgggatttcatggatactgtctggaatgttttcggactcagatatcttcccccggggaaatagacttctcagtagccacgtggaccttgtgctggttttcagtcctgctgaaaatgttctgagcactcttgttactttaggggaaaagaattacgtgtcctttgtgatttatagacacagtaagaaataagacctgtgtgtctctcggggtgcgaaggaggaaaagtcttttttttttgagatggaattttcctctgttgtccaggctggagtgaagtggcacgatctcagctcatggcaatctctccatctcaggttcaagcagttctcctgcctcagcctcccaattagctgggactacaggcatgcactgcatatctggctaatttttgtatgtttagtagagaaggggtttcactatgttgaccaggctgaaaaatatttttttgaggtggggtctctgttgcccagactggagtgcaggggtgcaatcagggctcactacagcctccacctcctgggctcaagcaatccttccacctcagcctctgtagtagctgggactacaagcacacaccactgtgcctggccacttttaaatttttttgtagagacagggtcttgctatgttgcccagactgaaaaaaaagtcttttttttttttttgagacagtgtctcactgtgtcacccaggctggagtgcaatggcaggatcttggctcactgcgacctgtgtctcccgggctcaggcaattctcctgcctcagacacctgaatagctgggaatacaggcacatgtcaccacacctggctattttttgtatttttagtagagacggtgtttcaccctgttggacaggctggcctcaaactcctggcctcaagtgatctgcccaccttggcctcccaaagtgctgggattacaggtgtgagccacctgaaaaatcattgtaaaaatcaactgtcctacattcttatttggaagtgactcctctaaccaaagacagggaaaaacaaaccaaactttattaacatgcgtttttcattgatacatgagagatacctagaaatgggtagttttcaaggaagtggcttggattctagctgctctagtaccctcaacaaagaacagtccatttttagagaattggcagagaaagacaaaggactttgagtcttcaggggcagcaacaaaatggcagagaaaggctggttattgaagcttgttcattctgagtcctgtgttccatgtcccaggcccatgtggattttctgctgtcttccgtgcttcacctctgttctcccagttggggaggtggggttcggattgcttgtgaatgtgggctcatcgttgctggtgtagctgcaggctgcaggctgtccagggcttgaggatttgctgatattctttcttttcttttctttttattttgagatgaagtctcgctctttttccccaggctggagtgcgatggtgcgatctcggctcactgcaacctctgcctcccaggttcaagcaattctcctgtctcagcctcctgagtacctgggattacaggtgcccgccaccacacctggctaatttttgtatttttttagtagaggtggagtttcaccatcttggccaggctggtttcgaactcctgacctcaggtgatccgcccgcctcggcctcctaaagtgtattcttttttgatttattcccagtctcttggctgaaacatggtagctcaccagcatttctactcccatttgtccaactgacggtatcttttcacatctctagagaccagaaggacttcctcttcttgaatttcctgttcagtattctttcttggcttggttccttggtgagttttgaggagatggtgcatgggtgtgtttttcggctttgttttagtatgactcagggttgccaccatgccttgtacggtctcctagtcatagtattaaagtttccgcttagcaggaaaccagaaacttcctttcttctcccccagagtcagattcaaaccagtgtttctcaagtgggctgtgaaagtagcttgcagccacccaccttgcaaagaagaaaattcaacagaggagaggagaaaatgcccacagggtacatggaaagccttgctaaagaagccgcatgggcaaagcttttgttccgctccctctgtcccggtgggctgggctgagatataatatatgtttgtcattgtggacggcagctggatgagtctgaaagcggttgcaaacccctttaattcactttgctttctcaactttgaatggtgtcgtgggctggggtgggtcccctgtttttgagaatcacctgaaagagtctgattttctgcatcttttcggggagtaaagctgttgctccaaagcgctgtttaaaagctgataatagtgtatctggttgagctaacagcccttcttgaggaggcagcagactggccagagggttctgcaggcattactcatcagcgacacctgagtttgcccaggtagcctgactcttgtttgtttctgctttgcctgaccctgcaaaattattgtccaaatgcaccctggcaagcattgatccacgaggggatgctgaccagaaggagctttcgtttctgcacgatggactggaacacgatggactggaatgatgacaagaataaacacactgcattgtcttttagggccaatggacttggaggcatagagattttataactactgccagaacccaaatattgccagtcggcctcttctgctgctgttgctagctgtcttcttctgggggaaatgggttgggttctaaatatgaattaacacagggctgtcttcgatgaattcagcacaaaatgttctcagcaattgaacactcggagagaagtgttaggcatttagtgcagactcatagaatagcaggacagggagggatttggatctgggcaagcaggagatggatatgaacatctgtcttttgagaccgtgccgaggtggcaatgaaggtagaggccccctgtgttgaggtctttactcaagaggctgtggtcctttgggactaacatagcatccgatagacagacaagatggacagctacagccacctatgggaagcggtttctactcttaaaccacaagcccctagacactcatcatatcataaacatatcaccgggcagtggcttgcaatctttttttttctttgtttctttttttttttttttttagacttgcccaggccggagtgcagtggcacgattgtagctcactgcagtcttgacctcctgggtgcaggtgaatctctcacctcagccttccaaggagctgggaccacaggcatgtgccaccctcagctaatttttaaaatctttttgtagaatcggagtctgactacattgcccaggctggtcttgaactcctgggctcaagcaaacctctcgcctcagcttcccaaagtgctggggttacaggcgtgagccaccatgctcagcctgcaatcattttttttgagacaggatctcactctgtcgcccaggctgaagtgcagtggtgtgatctcagctcactgcagcctcgaacccccaggctcaggtgacctgcccaccttagccttctgtgtagttgggactatgggcacatgccaccacactcaattaatttttaccttttttgtagatacagagttttgttctgtcgcccaggctggtggacatattttaatcctacagagtccaggctaaaaacacaccagtaactgtgatgcccatccctcctgcattcctgatttctgagtgatggtttcagacacaaacctgcttgaccaccctccagtagctcttgctgacctagatccgaggttctcagctttggccccattgcgggaagcttggaaacgtcactcttgcccagggttacctgggtagtctggtttatagacgtgttaggtgttttaatttttttttttttttgagacaagattttgctctgtcacccaggctggagtgcagtggtacagtcatagctcactgcagcctcaacctcctgggttcaagcagcccacctacctcagcctcgaaagaagctgggaccacaggtgcacctcaccatacccagctaatcttttctttctttttgtttttttcttttctttcctcttcttttcttttcttttgttttctcttctctcttttctttcttcttcttcttttttttagacagagtcttgctgtgttgcccaggctggagtgccttggtgcaatcttggctcactgcaacttccgcctccctggttcaagtgcctctcttgcctcagcctcctgagtagctggaactacaggcacgcaccaccacgcctggctaatttttgtatttttagtagagacgggatttcactatgttggccaggatggtctcgaactcctgacgtcgtgatctgcccacctcggcttcccaaagtgctgggattacaggtgtgagccaccgcgcccagccttttttttttttttttttttaaattacagagtctcactctgtcaccaggctggagtgcagcgatgcaatcttggctcgctgcaacctctgccacccaggttcaagtgattcttctgcctcagcctccctcaggcgtgagctggcacgcccagccaaatttttcattttttgtagagacagggtctccctatgttgcccagtttagtcctgaactcctgagttcaagccatccacctgccttggcctggcaaagtcttgggtttataggcgggagccactgcatcccgctattaggaatttttaaaaagcccctcggagggtcttcatgtgtggctgagttgtcaagaatcattgttattttactagatattctgtttcttccctcctacatgagatttcccatgaccgcctctcggatgtgaatgtctatgccatggattacatttttcaaagagcattcagtttgttatttcatcttcagcgagcccttaagatatttctcatgggccttttgtagataaagacactggggtcagagagttcaggagcttgctggtgatcacatggtcagcatggggaaaaatgcatgtggacatgagttctgttggtggtgagacgtgggcacaggggttgctgggcttgggagttggtggctgcgtgtgtgggctgaacagagctccccaggcacggccttgtggaccttgagggatgcctgccttcaccactagtgtgacttgaaggggaggagaatgtcctgaatcagtgatgggcattttgatatggaagagaactcccttgaatcctggtggtgaacttagaccagtcactgaggcctctccagctcctcagggtctccgtgttctaggtatccatgtgtccttccatccatttatccatccatttatgcatccatgcatccatccagccatgcatcctccttttatccatccatccatcaacccatcctcccattcatttacccatccatccgttcgtccatccatccatccatcaacccatcctcccattcatttacccatccatccattcatccatgcatccatccatccatgcgtgcatccatccatccatttatccatccatccatccatccatccgtcgtcccattcctttatccatccgttaatgcacctgtccatccatccatccattctccattcatctttccatccatgcatcatccatgcatccatccttttagttcatccagccactcatcaattgatacatccatctgtccaccatccactcatctatccatccattcacccatcctttcatcaatttacccatctaccatccatccatttatccgttcacccattcatctatccatctgtccatccatccacctatctgttcatccatccatccattcatctatccatccatccacctactcacccacccacccatccatccacccacccaaccatccatccacccaaccatccatccatacctccatccgtctacccacccactcatccacttaactacccatccatccacttatccatgcattcatccatccatccacctacctactcacccacctaaactcatctatccactcaaccatccatccacctatccacccttacctccatccatccccttactgcccatctttccactcatcccatccaactacccatccatccacccagctgtccacccaaccatccacccactcactaatttatccactcacccacgcatgcatccatccatccatccatccacccacccatttacccacccacccatccatccacttacctgcctgtccatccaccctcccagtccatggctctttcatgtattccttcagccagcataggttgaagttaaatgtactattggtgctatttgctgtggtccctgttttttgttctctgctttggaggtaacaaccagggcatcaatttgggcataaaagcaccattgtggatggaaggcctggatgtctggaggcacagagcagggactacacttgttcagggggtcagagagagttctcccaggaggggccctccctggacactgagcttccaagaatgagcagaggaaaccaggtgtaaggaagaggaagggcctcttctcagcctggtagacaagcagtaagagtgatgatggggcagctgcagttcatctcagactagaggagctgcaggggccagatggtgggcaacctctgttgccactgctgaggagtgcagatttaagctcccctgaagggtttgacgcagacagctgtgcggggacgcttaacctgcctaaggcccgtctttgggtaacagcatgcagaacaggtgggaggggctggggctatttttggcagagcgtggataagtcagtggagatagaagagaaggcacaagctattttaggagatattgaggaagttaaaatctgtaacaggtccctgcctgcagagttgaccacacgtttgcatcacatgggtaggctttaaaatatagatgcctgcatctcaccttggaaagtttctgatttaattagcctgggcatcaggacttaggaaaaccccacagatgtgtgtaatttgctgctggagttgagaactggggtgcggagctgtgctccttaaactgtaatgtgcttacagatcacctctggtaatacttgtgagaaagcgcttcaggtgggctagggagaggatcacggagggcttcctggagaaggtgacattctcccagggccttgaggggtgaatagacattttccaggttcagaaagaaggaatgggctttcatggccaggtagaggatccaatgaggcagacgaggggcccaaattctgtgaccccctacccctaccccacccccaggatgcccctgtatcagtcccatggtgtaacaaccaaattcacaagatgctgcagaggggaagagattttaaattttctgagaaagacaatgatatattttggacaccatgagaaatactgttattaacttgttttaacctaggtacacgcaatcttcatcattcagtgattctgtatttgtgacttgcctgcttactaaaatgtatttgtcatccccacatcaatattcctggcatttaatttttttattttaaactttcattttaggttcggggatacatgtgaaagtttgtgacttaggtaaacatgtgtcatgaggttttgttgtacagattatttcatcactgtggtattaaacccaggacccaatagttaccctttatgttcttctccttaccctcggctattttgttcatgcacagaacggcaaaaaaattgaactttttttttttattttttttggatggagtctccctctttcgccaaggctggagtgcagtggcgtgatcttggctcactgtaacctccgcctcctgtgttcaagtgattctcctgcctcagcctcccgagtagctgggattacaggcatgggattacagccaccacgcctggctaatttttgtatttttagtagagacggggtttcaccgtgttggccaggctgctctcaaactcctggcctcaagtgattcacccgcctgggcttcccaaaatgctgggattacaggcgtgagccaccacacctggccagaattgagcttctcaatagcacatgttctcagctgaggttcaacaaagccagaccctgccttctcgggccagcgcgtactgtcaacagggttctttgcaaggtctatttggtgtcccgtgttttgtgttttcgtgctttttgtcagtgattttgcgctttcaaatatccccaagtcggtgctgacatgctacctagcgtccctaagtacaggaaagctggcatggtctcacggggaaaatacacatttgatgagcgtcatttaggcacgagttatagtgctgttggcttcgagatcaatgtgagtgactccacaatgtctattcactgcggtgtctttaaacagaaacccacataaaacgcgcttaggtagtgattggttcatgacctctgggaacgtagtcctgtatttacgtgggagcaatagttcactattcgctaattcagtgttcgctgagactttataaaacgtaactgctttgaataacaaagctgtaattaacaaaccgagctgttaagtgtgtgtgtgtgtgtgtgtgtgtgtgtgtgtgtgtgtgtgtgtgttggcctcacatcattttacagagacacacagggctctgtgaactgctaatagttgggaccggcggaggggttatttcaagctagtccaaaactgcagggcagagaccactttgaaaggagatcagcagtcggggagtggctgggatgaagttggaaaaagtgctgaggcccctaagtcagtttccggtgtttccacgttagccttggggggtgatcactcagtttcctgtagggatgggatctgggctggcatctgcctgtggaaggggtgacagggacggagagcagggaaccccgagcagccctgccttgctgttgtctgagcctcagaactcctgaaggcggggtccttcagcatcaccctggagtttgttaaaaatgcaggctcatgagcctcaccccagaccacagaacgaaaatgtctgggggtgagacccaggattccacgtctccccaggtccctcgcagggcgattctgagaactgccggtgtgaggcgtgctcagcccagcccaaacattcacaccattctttggcctcttgtaaaacttggcgtagctcaggggacgttcccagagttatggcacacgaacaaaagaaagtttcccacttcttaccaaacatattgtaaaattacaggaaagagcttgttctttcacgtctatacccttgtgccgtcgtcctagttaggatgaagccgagatgttaccttgtaccttaggccaccgcagacaaggaagtatatgcagtttaaccacctgcatataatctttttcttttttcttttctttctttttttttgagacaaagtctcattctatcacccaggctagtgtgcagtggcacagtctcggctcactgcaacctccatctgccaagttcaagagattcttgtgcctcagcctcccaagtagctggaactacaggtacacgccaccatgcccagctaatttagcagagatggggttttgccttgttggccaggctggtctcgaacccctgacctcagtgatctgcctgcctcaacctcccaaagtgttgggattacaggagtgagccaccatgccctgcctattttttggaggcagggtctctctctgttgcccaggctggagtgccgtggtgcagtgtcagctccctgcaatctcaacctccacaagcgcaggccatcctcccgcctcagcctcccaagtagctgggaccatgggagtgcgtcacaacacctgtctaatttttgcattttttgtagagacggggtttcatcatgttgcccaggctgctgttgaactcctgggctcaagcaatcctcccaccttggcctcccaaagtgttgggattataggcgtgagccactgtacccggccacctatgtataattttcaagctaagaagacagagagacgagtttaactattgctacagacatgaagcccttccctttccatagtttgctagcagagagtgtttccagggcccggcggccactatcacccactgcgttcatagctttccatggggtgaacagattgcgctggactcagcggttaaatctaaagtgtaggatgtttggtgaactcggagttccttgcacttgtctgtgatctggcacattgtgttttctgtactcagatatgcagtcactggcacacatcctgttactgacgggaagctggacccagcactggagtatttctgagactatgacactctggtgtattcctgaaactatttatgacactattaagctcttttctgtaattttacaatatgtttggtaagatctcagcgccagatttttttaaatgatgtgtttatttcttttaattgacaaatacacattgtatgtgtttatgcggttgcacatggtgtcttgatgtatgtatccatggtgagatggatttaaatatgcatgacctcacagactttgcagcacttttttgtgtgtggtgagaacacttattcagaatgggctcctttagtcgttttcaaatattcaagccattgttactaattgcagtcgccatggtgtctctgagctttcctgaagttatttgtcctgtctcatggacgctttgtgccctgtgaccgatcgtctgcccggtgttaaatgacacatcttgaaaaagaggacaatacttccagagcgattcggttttatagcaacagaaaagtaagggtgttttgaccatttgaataaaatagtaaaatgaaatgtatcagctgcctcctgctattcccacacaggaggacttccggtgcttgctccaatgtggaggcattttctcttgcagcattctgagctacaattatctctaggctggggacccttcccgaggccccccaaacctggaatgaaagtttttagggtcagaccatgtgactggttccactcgacctccaaaacgttaaaaagaaaaaaaaaaaaagagccgggcgcggtggctcacgcctgtcatcccagcactttgggaggccgaggcgggcggatcacgagttcaggagatcgagaccatcctggctaccacggtgaaacccagtctctactaaaaatacaaaaaaatcagccgggcgtggtggtgggcacctgtagtcccagctactcgggaggctgaggcagcagaatggtgtgaacccgggaggcatagcttgcagtgagccaaaatcgggccaccgcactccagcctgggtgacacagagacactctgtctcaaaaaaaggaaaaaacaaaaaacaaaaaacgctttgcctttgcttggcatcagaggactcagcagcaagtaaagagcacacacgtgccctctgcaccacctcctcctccttttctacaatgtcctgaaagtttcgtgtttagtgggctttggaaaagggtgtggaaaaccagcaggagcagatgagtactggagtggccagcagcaggtgtgaacaccctggggtgatgctggggctgagtgaattggacatttttcagcagggacacccaggccagtggcgggtcttcatcctcccacccttaatggagatgaacggcattattgagaaagctgcaggcacacacagagcactgcttaaatgatgtccctggctgctgctgttactatgtaatgattgtgttattcttatgaaaatctgaaagttacaggaatcttggaactgcctaattttttttaattaattaattaatttatttcgagacagagtctcactctgtcgcccaggctggagtgcagtggtgcgatctcggctcactgcaacctccacctcccgggttcaagcgattctcctgcctcagcctcccaagtaactgggactacgggcgtgcaccaccacgcctggctcatttttaattttatgtgaaacacctgaatgatgtgatgatggggtttaagataacccaagtgttcgggcgcggcggctcacatctgtaatccctgcactttgggaggccaaggcaggcagatcacttgatgcccggagtttgagaccagcctggccaacatggcgaaactccatctctactaaaaacacaagaattagctggatgtggtggcacatgcccatagtcccagctactggggaagctgaggaaggagaatcacttgaacccaggaggtggaggttgcagtgagttgagatcatgctactgtactctagcctgggcaacagagcaaaactctgcctcaaaagaaaagaaaagaaaagaaaaaaacagcaaaaagagaacccaggtactggctctcctcctgcgtttgccccggttgagtgcattcctgcattagtgcaagccttagtcacgttgcagaggaactcacacaccccatgtggcctcggggacttcactctgggttcgtcctgttttttgagttgcctggctgatgagaaaaagtaaacatggtttgaatcagtagaaagtgtcttgtcagactgactcatgccatctgtcgtccgttccgccttgccctgatgagccattaccctgtcccggaaacatctggagctttgagagggccgggtggaaacagcagtggcagttgggggttctgctgagggtctggtctctttgcaaatttgcagagaggctgaatgccgtaaacgtgcaacacaggcacctgagttctccaccaggctccttctctgagggcatggttgcagctcttgctgggtgggttttgttggtgttttcttcacatttgtagccccggaggtcgttttcaggagcaaaaaggcaagtgggggtgtctgctgtgagcccgcaatttcctgcctaccacctgaaagctcagggaatgtgatgaattgggagatgaatcctaggcaataaagagagcagtggactgagttaggagacgatagcttcatttacagagattcctttactgactgatgatcattgattgggtttgcttccccatgaggcttcaagccaatagcacgtgcatttgcatccatttatatacacctgggggactgccttcctcacacacacctgggggactgcctccctcacacacacctggggaactgcatcccttcacatacatagggaactgtgtccctcacacacctggaagattagcctcagaggtgtctgcagtaccagattccaccagggagtgaacgtctgattatgggtgattcagggtgcccacgtctatatgaaatcgagagcgggtcacctccctttcctccctactctctgtggggtggtgtttggggagctgtcttaagtgttagtcacccgaggagaaaatggtgagggtgggactctgtatctgggagaaaggagaccttggaggcaggggacagactgacagagccttgagcgatggaagctgaggtcgagggcccaaggtcgatgatagaatgcttggggttgtctctcctctggtgtccttgtccttcaggcatcctggagtgacattgaaattgtttcaattaaaaactgtagaaacagcacagagataagaatggaagacaagctccaagtgcggggctgaggcgagttctccaaggactagggctaagggcagagggtgggagaaggggagaagggcgtgaggggcatactgtgtcctttgccacccactctcagacttgttgtcttggacctccgtcggctgagcttggggtccggggagcagtgggtttggacactcagtggtgacgtcagccgtagtcctgaagcagaggggaagttggcaatccaggcttgcctgggggtgacactggtggcgggagggcctgtgccctcccctgtaactgggtttgtgtggggtccatgggggcattggggtcagtggaaggaacatgaagtgagccagagcatcgtcactgtggcctctgagggcaggtggagcaagaaaaggaggaagcttctaagtgacacctggtcccagctcagtggctatgaccagggaagtcatgtggaggaaaaggctggtggactctgagggtgatggaggaggatgggaggggcaagctaggctggggaggtggcaggccatggacacacaccagacagacacacatgtgcatgcacacatacacaggcacatacatgcatgcacactcatgccatgcatatatgcatgcatgcacacgtgtgcacccacacagcaagtcacatgtgcacgtgagcacacatgaaaacacacaagcacatgcacatactcctgcagtgcacatgcacacccatatatgcatgcacacaggtgtgtgctcagatagcaccctcacacatatgcacacaagcacacaggcaaacacgcagacacatgaacaaatgcacatatatattcatgcagtgcacttgtgcacatatacacatgcaaacaggtgtgcattcagcacactcacaatgcacatgaaaacacgtgtgcacacacatgcagtgcaatacatatatgcatgcacatgtgtgcccacaccatacacccacacatacgtgcaggagcacacacgtgcacacacagaaaccacatgaatgcatgagcacgcgtatatgaaatacacatgtacacatgagcacatccacacgcgcacatgcatgaacatagacacacacatgcatgtacatagacacgcacatgcatgtacatagacatgcacacgtatacccaggccctgcattggaaaaaatccaaaatgtggcttggttgcaaagagcacatgaagagctgttgaatgcagaggtgcccagcaagaagcatggacctaaacccgaaggtggttgggggaagcttggggacacctgggtgggcaaatggcccccctgaggcccagggacagatgcaaaaacccagcaagccaggagggtctttgaaaaaaaaaatgtgtaccacatgtgacatttcccatgtgagggaagcatcgagatcatactgtgttttccctgtgccctgcgattttgcagctgacatgccctttctgtggaaatatatagcagtcctcatgctaggattgcgtgttctgtgtcaggcagctgggcatgggagtgcagggtgtggggtggaacctgggaggagagttctagttttaccactgtgttccggccgtggggtgtcctggggaatggaggccacctcctgacactggagtttcctgggttctgctgtgagcgaggagtgggagaagacaagactctggtcttagaaaccttccgagtctcgtacgcccttgactgccgtttctgagtatttcctgaagcttgggaaggatgagtcactttaaggggattgtcctatgttgctttgttttgtttctttagtgacggtgtctatgatcatcttctgtttatgagggtgaaattacagaaataagaagggttacacttaaaataatatctgtactttactttcacgtgtggggtttttttttgtcattgctgctgcttttttttctttaacattctgacagttctgtctgcttattattaagtcttcctacctttctaaagagaatgtctttcttgctaaagaatacattatggactcttggaatctctttgttggggtggagggggtggggacttgccctgacttgctgggaatgcccatagggtttagaagtcacgtctaccgctgaggcactaacaaaggtaagccttcaaggaagcactgtcatttccggggaagagagttttgaggaaattgaaacagttacgaattgatctagcagtccctctactaatgtatctacatatgaagatatgtagagatgactttttttttttttttttttttgagatggagtctccctctgtcacccaggctggagtgcagtggcatgatctctgctcactgcaacctctacttcccggattcaagcgattttcctgcctcagcctcctgagtagctgggattacatgcgcatatcaccacgcctggccaatttttttgtatttatagtagagacggggtttcaccatgttggttgggctggtctcgaactcctgacctcgtgatcctctcaccttggcctcccaaagtgctgagattacaggtgtgagccaccgcacccggccccagagatgacttctaaaccttcagggtattcccagcaagtcagggcaagtctatatatatataatatatatatgtgtatatatatatttgtataaatatataattcgtatatatagtatgtatatatagtatatatagtatgtatgtatatggtgtgtatatatgtagtgtgtgtatacatagtatgtgtatatacagtatgtatgtatatagtatgtgtatatatagtatgtgtgtgtattatatatatatatagtatgtgtatgtgtgtatatatatatatgtttatttgggataaggaaaggaaatcagtatgtcaaagagacactcccctcccatgtttattgcagcaccattcggagtagccaagacatgcagtcaatggaagagcccatcaagggatgaatgcagaaagaaaatgtgctatatcaactctgtacattcactaaaagccattcatttgcacagtgagaataagtgcctttcatgctatgtaaactatgcctcaataaagctattaaatgaacaaagaaaatagggtatattcacaatggaatggtattcagctttaaaaaagaaggaggttggctgggtgcggtggctcatgcctgtcatcctagcactttgggaggctgaggcaggtggatcacctgaggtcaggagttcaagaccagcctggccaacatggtgaaaccccgtctctagtaaaaatacaaaaaattagctgggcatgatgggcgggcgcctatagtcccagctactcaggaggctgaggcaggagaattgcttgaacccaggaggcggaggttgtagtgagccaagatcatcgcactccagcttgggcaacagagtgagactctgtctcaaaaagaaaaaagaaggaagtcctgccatttgcaacaacatggatggaactggaggacatgatgttaagtgcagtaagccgagcacagaaagacaaataccgtctgacccaaacacgcttacgtggaatctaaaaccactgaactcacagaagcagagtggaatggcggtgaccaaggggttgggagtgaggggtgggggaaatggggaaatgatgggtaaagggtacaacatttccatcagataggaagggataagttcaggggtctactgtactcagggtgactgtggttagtaagaatgcgttgcatacttgaaaatgcctaagacagtagctttgaactgtttgcaccacaaataaataggcgaggtaagatgtaaataaagaaaaaaaatacttcaaaaaatacaattacagatttctatggaaacatatgaacatgagtgcatatatatatttatatgtgcgtgtgtctgtacctgccttatggtttattctggatcagtaggatcctcccttgctaccgtctaaagatctgccgcatgctgcaggaggagctgtaattgcatttatgatgtctggcaagtgtcctgttgtggaaacagccatttcagggctctgaggttgtggaaacgactccactctggttgccggcatggggcccacagagctgttccgagcgttttgtctactttctacttattgttgacacacacagaaacacacacgcagccatgagtacacacacacacagacatacaagcagacgtggacacacctacctgtatgtacatactcaaaacacaccttcacactatactcacctacccatacacacacgtgcacacaactacatgtgtgcacacaaacacatgcatacatgcacctatgcatatgcacacgtggaaacacacctgcacactacacacacctacacatacacacacaaacccacaaatgcacacacccacacaggcacaaacacacaaatgcacacacccacacatgcacaaacacacctacacacataaacatattgacacatgcacacatgcacatgaaaaacacatatacacactacatccgcctacacatacacacacaaacccacatatacatgcacctacacacatgcacacataacacctacacacatgcatacagaacccacacatacatgcatccataggcacacagaaacacacctacacactgtgcacacctacatatgcacacacaaacccacatgaacatgcactgacacatatgcacacaaaaaacacactacacacacagaaacccacaaaatacacctccacacttacacaaaacacgcctacacatatgcacatacacaaacccacacatacatgcacctgcctatatgcacccacaacacatacacatatgcacacacagaactcacctacacaccccatacatgcacacaaaacccacaaatacatacatgtgcactgcaaatgcccaaatatacatgcacactcacacacacatacccctgtgacatatgcatgcacgcttcatttatacatgcaggagcatagcctggtcgtttgcacctgttgtggaactggacacacttccggtgttcacagggctcctgcgggttgttcttggacccctcgccacccaccgccaggtgcttcctgacggttgagagatgttgtatgcctttggtgctgaggagtggggacgctggatgttgacgattatcctaactcttcctccagttgaccaaacagtccaagtcgacttttccaaattttcctgaatttggcttttcttcagtgcgccagagatggccagccacgttgaagtagcattgaaattgttgtaattaaagactgtagaaacagggtagcctatcaataattcagcatgccagtttcctcattccgtgggattccatgagatttttttttaatgcataatgcacgtgtctttctgggttgtctagtgtttctactatattttggtttgtaattacaggaaagttgccaataaaaaagggagaattttgttccccatgttgttttcagtacatattcaaaattgttattcatctgtttgaaaggaacgacctgttaagaataatacacaaaatgatcgtgtttttacactattttaatttctactaagcttgaaggtcatcatttatttaaaacctaggctaacatattcttacttttaggcatggaagtgaatatttagaatgagaagagaaatcacgcaccttgtaaatttttttaagttgctgttttaaatatcacaaaaagaaaaatcgcatatcttttttatctctataatattcaaatttatttttatttttcttgtttctaagttgactctttttttctctcttagatggtggtttcgatttatccgatgcccttcctggtgagtatcaacatcattttttaaaatcccgtcaatattttatgttaacatagtatatacaggcatatcccagccatttccagctaggttctagaccaccgcaataacaggagtcatagcaatttttggcttcccagtacatataaatgttatgtttactctcaactgtagtctattaagtatgcaatagcattacctctaaaaacagtatactccaattgaaaataccttattgctaaaaaatgcagatacagagacaggaagtggggcacgtgctgttggaaaaaatgatgccgagagtctggcttgccacagggttgctgcaggccttccgtttgtaaaacacacagtatttgcaaagcaccttaagacaaagtgcagtgaaggaggtccgcctgtatgtgtccacctgccttattataaaaactagactcatagatgacgaggaaaagcaagatgcccttgttaagataaatgaaccaccctggtggaataattcacagtcctgtgatggtcagaggccgagcaaaaacttgccaggtccttggggaggggtctagaggaggtgagcaaatggaggtccccaggagagaggggcatccagtgctggcatcctccctctcgaaatcggcacccgctgtctccatggggccactccttccttcttctgcagctcttcctgtctcccgctcctcacccagagccctcggtgaagggcatgggaaaaggaattgaaggaattccgtcttatcactctatcagcttctgggtcttgtcatccctttgtatttgttttccggggctgccataaaaaggtgccaccaactgggggcttaaaccacagggatttatcatcttccagacctggacaacagaagtctgagatcaaggtgtagacagacccatgctccctctaggggctctaggggagggtccttcctgcctcttgcggcttccgggagctccaggtgtccctggacttgtggccgcatcactccagtctctgcctccttctccgtggggcctcctcctctgtgtctgtgtctccttttctttgtcttacaaggatacttgtcattgggtttagggccactctactccaggattatctaatctcaagatccttctcttaagcacatctgcaaagaccctatttccaaataaagtctcattaccaggttttaggctttaggatgtagatatatcttttgcggggaccactgctcaatccactgcagttatatccagttctttttggtggctctaggggaggatccttcctgcttctcccagcttttgagggcttcacgtgtccctgtgcttgtggctgcatcactgtaggctctgcctttgtgaacgctggtctcttccctgtgtctccatgtatctaaatttccttcctataagggcaccagtcattaggacctatcctaatctattataacctcatcttaactgattacaactgcaaagaccctgtttccaagtaagatcacctattgaggtttggggtgggtgtggatcttggaggaatgcttttcaacccaggacagccctcttcattttttttttttttttttccgagatggagtctctctctgtcacccaggctggagtgcagtggcacgatctcggctcactgcaacctctgcctcccgggttcaagtgattctcctgcctctgcctcccgagtaactgggattacaggcatgcaccaccatgcctagctagtttttgtattttcagtacagacggggtttcataatgttggtcaggctggtttcgaactcctgaccttgtgatctgcccgccttggcctcccaaagtgctgggatgacaggcatgagccactgagcccagccaccctcttcacttttttatgttttacttttttttttctgagacactgtctcgctgtgttgctcaggttggagtgcagtgttgggatcttggctcactgcagccttgaccgtctgggctcaagcagtcctcccacctcagcctgctgagtagctgggactacaggcatgtgccacctcacctggtacagtgagcaacacggggtctcactgtgttgctcagattggagtgccacggtgggatcttgtctcactacagccttgaccatgtgggttcgagcaatcctcccacctcagcctcccaaagtgctgaggcgtgagaggattgcagacacgagccactgcacctcgccagcttttaattttatgtcctgtggtgcagtgcagatggtttgagcggaaacagtgctgatggggatcatctctttcctgaccacctaccccttcttggcccttgggaacaaccattccctgcagtgggaggtgcccttagtcttacagcctccacctgatttgcctgattggcttccattctcagagggggcagcctaggcagaggcctgacggggccaaaagtgtgtttcatatgagaaatgtgaacagcctttcagccatcaatccggtgtctctccttctcatgcatagatctcgggctctgaaaagggcagtttttctcctaactttgccattctcctgccttcctggcttatgtctcagtcatagtcccattcaacgtcaagaagtggagaagggctgggcacggtggctcaagcctgtcatcccagcactttgggaggacgaggtgggtggatcacctgaggtcaggagttcgagaccaacctggccaacgtggtgaaaccccatctctgctaaaaatacaaaaaattagccgggagtgatggcatgcacctgtaagcccagctactcgggaggctgaggcaggagaatcgcttgaacccaggaggcagaggttgtggtgaacggagaccacaccattgcactccagcttgggtaacagagcaagacttggtctcaaaaaaaaaaaaaaaagaagtggagaaggggctcctggtctctgtggaaaccatggccggtagcagcctctgtgtctgtcttctgggctcaagagtcgttgtataaacctcagctcggtgtgggcaggtgagaaaaaacaatgctaaaaacattctccgactgtttccaagaaaatgaaacatccttaaccacaaaagagttgacacttgttttcccagctgcaacttttactaactgaaatatcttatctctttagacaatgaaaacaagaaacccactgcaatccccaagaaacccagtgctggtgagaagggcttcttcctagtatgcaaagaaaaagagcaaatcattttctcggacagcaggacgggacttaggcaactagaaagaagacagaagtgatttgagtgctccggctggagtctggttaatagttaatactggaattgtgttatgatgttacatttcatgtagtgattccagtaaaagaatggttgctgatgtgaaatgtttcggggccatttggacaacatctctgtgtgcttttattctaagggtctgagttactctgtctttagattttcttccctttttttttttttttttttttgagatggcgtttcattcttgtctcccaggctggagtgcagtggtgtgatcttggctcactgcaacctccacctcccgggttcagtgattctcctgcctcagatgcctcagtagctgggactgcaggcaccagccaccacacctggttaattgttgtatttttagtcgagacgaggtttcactatgtcggccaggctggtcttgaactcctgacttcaggcaatctgcctcccaaagtgctgggattacagcggtgagccaccatgcacggcctgtgtctttagatttcaacttcctaggagagagagcatttggtgctgagatctcccccatgatgaccaacaagtgaactcatctctcaacctgtgggcacacacctcatttgttctcagtgcttgctgttctttctttctttttttttttttttttgagacggagtctcgctctgtcgcccaggctggagtgcagtggcgcaatctcggctcactgcaagctccgcttcctgggttcacaccattcttctgcctcagcctcccaagtagctgggactacaggcagcggccaccacgcccagctaatttttttgtatttttagtagagacggggtttcaccatgttagccaggatggtctcgatctcctgaccttgtgatccacgcgccttggcctcccaaagtgctgggattacgggcatgagccaccacacccagccctcaatgctgttctttcaaacaaaagtcagaaacgaggtccacgtgatggaattgcccaagggtcaaccccactggcggataaacagagtaaaaatgatgctaaaacttatggcatcagtgtcttacagctaagacactgtcttgtcttagcacttctgagttttctaatataaaacattaatagctccacttcattattgggcttcctgtctagagtgtcagctcatgagcaaagggaccctgtgtccccagatccttgaactaagcaatcatgcagatagcaccaatgagtaggtgttgagcgtctgaatttatactatcatagtctccttgaggaagggactggaaattcccatatgtcactcaggatggctcagtacatgctgttgggtggatgccagcaaccattcctccatcttagttgggttttcaaaatcattcttcatactagaagacaagatctgaggccatggtgaactgtcacatcagttgcggagcacatatgggttgctagagccatgttttagacaccctctagcctaaatctgatcacagtcatctgtccccttctcttagggtctacctttccaaagttgttagggacctgggaggagaggatgatgggatggggagtcaacaggagaaaatcatgtgcaggcagaattggaatttcaacttggtccaggcaacacaattcatttataaattactttatttctctctctctctccccactgcctctcctctgagagcttctctcctagctttttatctgtctctgtctctctgttttttcctctttttatctgagagaatagtgatgtaaaaatggtcaggaattcactttttctaatgagatcctggtcaagctgatattcagaaaagtatttaggaatgtggggccgtggtgtgtttttgatctgttcacgaggtcattccttcctcgtttctctctggaatttggtattaactgctctttcccctcttttaggggatgactttgacttaggagatgctgttgttgatggagaaaatggtgagtattttcctttaatctcttctgctgctgatctgcttattatcacccaattatgatcatttcagagagaattctcccatttaaattataaagggaaccagttttcacagtggaaacctagggaataggtgtgtcggtttgttcttgctgttgtcgttgggtttttctttacaaccagtacgtgtgcttttattttaaaactcttacagtctttggaaggacatgagacaaatgtgcctaccctggccagggctggcttcaccagcatgtgacctgtgcagtggcacaggaccccatggcatgttggtttggcatgggaaccatactggtttactgctctgttgccgccatcttggaatacttaagaaaatttgaaaaatgggtcccacctttttattttggccctagaaattctgtagctggtgtggacacccgctttaatttttattaaacatagttgacattaagaactgtggctgaaagttgatgggaggaaactggcaggagactgtgtgtgtacaggtatccccaccaggacaaaggccaaggtccaatttctgttcagggaaccatctgtgtgtaaactgatgtttcattttctttactgcaaggcacttaaaattgcaactctcatctttcacaaacagacgacccacgaccaccgaacccacccaaaccgatgccaaatccaaaccccaaccaccctagttcctccggtaagagtctctgaccctgtgggatgtcttcatgttgttcagaattcagcgatatttatgtcagctgagaggaggtgatttcagatgagtgtgtgcttactgttgactgcctgtgcagtgtaatgcccatgttcatgtaatggaaaatgtacatttcaaaaatatatatttagcttggattttatttttagtttgcttttttttttttttttttttttgagacagagtcttgttctgtcacccaggctggagtgcagtggtgccatcttggctcactgcaacctccacctactgggttcaagtgattctcctgcatcagcctcctgagtagctggaattacaggcacacactgccatgcccggctaatttttgtatttttagtagagacagggttttgccatgttggccaggctggtcttgaactcctgacctcaagtgatccacccaccttggcctcccaaaagtgctgggatgacaggtgtgagccactgtgcctggactagtttgctacttttgtttccaagttccatcttatggaacttctaaaaaattgcatacaataatttaaatgtagacttgataaagagaaaagtattggcatacacattccttgtggagaagctagtgtgttttaaatctttctgcccttaaatatttaagtcagtttttctgacatatcacagcattttcagcgtaattcgaatagcaccagttttttttttttagctgaatggttgtcgaaagtttatatgtttaggtttttttgtttacatatttaatttttaacacagaagaatattaatgatgtccatatcttgttgacattttgatggctatttgtgctagtattttatatatcttttttttttcttttttgagacagggtctcactctgttgtccaggctagagtacagtgctgtgatcatattaaacataagagcataccacagcctccaactcctgggctagagagatccccctgcctcagcctttcaagtagctggggctacaggcacacagcatcgtgaccagttagttttttcattttttgtagaggtggggtctcagtatgttgcccaggctggtctgaaactcctggcctcaagcagtcctcttgcctcagcatcccaaatctctgagattacaggcacgagtcacctcacccagcctatatattaatctaaatgaaataaattttaaataaagttccaagtcttttgtttgtactgcattgtaacattactttttgcttactgatagtccatgaacattttttcatgtcatgtaatcatttctatcgtatgagttttactgataatcatgtactattacatactacatatataattatattcttcctgtaactaatccctaattctgaaaatgttatgtttcttctggcattttagaattatgaattaacaaagcaaatctgagtcaactccatgcgctatttttattcctttgaagacatttctagcattcaaatagtttagatcaacgtatatgagtactttcgtagcttttgacctggttgttaatttgctgcagatttttaccaatttattttgatgccaggggtgtgtgcaaatgtccctgtcttcacaccatctccaatattagttatcacctaggaaacctttgcaaatagtgtgaaattttctatcaactttctcctggtttcatgactttacttttaaaattaaaaaaaaaaaacaaacctgcatcaattggccgtggatacttcttattttgtgtattgtatgctttgccttttattcttacattctgatatgacattattgatttataagccttcttcatttatttacagacataaatattgccagcatgcaatattatgctcacgtttttccactttatttatggttttttgttttgttttgttttgagactgagtttagctcttcttgcccaggctggagtgcagtggtgccatcttggctcactgcaacctccacctccagggttcaagtgattctcctgcctcagcctcccgagtagctgggattacatgtgcctgtcaccacatccagctaatttttatattcttagtggagatggggtttcaccatgttgatgaacaggccggttttcatgagtttttcctttattctaagacatgaagacccttggaggagttccaggttgacaggtgatgctgtattttctttcctaggtagcttttcagatgctgaccttgcggatggcgtttcaggtggagaaggtacagttatcttgttttctgtctcttttctctctccatcccatgatgcccacctgctctgtagaatcactacagggtctaaactgtcagctctctgtgaactcacagtgaaatgttcagccatctctgtgggaactccgcctgtttgctgaggcttcaaggatgtgggaagtaaaggctgccccgtagaggttcggtcctcggagaagagttcagggcccaggcagctgccccacttttctgagggacagggcgtgatgaatgggcccttgtcaccacctcctcacccatccgttcacctgtgtgttcttgcaaataactagtgttgtttcagcttcattttattaggctgttttctgtaatttaaggaatgtgaatattaaagccctgagaatagtgataatgcctgggagtatgcgttctcagagtacccctagagtgtaacaggcagcacctcagctctgtagctgtgtaacatgcacccttagagtgtaataggcaggaccccagctctgtagctgggtaacatgtacccccgtagagtgtaagaagcaggaccccagcctcttcacggtcctggctgtgaatttttccttgaccccaaaccttcccattgcagacgttgtttttgtcttgcaggaaaaggaggcagtgatggtggaggcagccacaggaaagaaggggaagagggtaggtgcacctggcttctgtcttcttgtctctcccacgtggtgttgagaaggggaagcagaatgtctgagagctggcggactgcactggcattggcctcctaaagctactggcaggaggcacgggtgttctgtgccaagtgctcccaagtgatgtagctgcagaggtcccccagcaaaccagccctgctccgggtgcccacgtgacgcggattttatgtttggtcacctgcccacgatgccctggctggcgacccgacccctacatcacgcttcgccttgtccttgtgtttacaaaagctcctacactcaccctaacgatcagaggcttgtgacgcagtatcctcggttgcgcttggcccttgagaacgtcagtaaccaggtgggaggtgggaatgtggatcgcttccaccctggctgtaacaggcattgtgttctccatggaagtgccggtgatgtatctcctgtctcctttttcataaccttttcccttagatgggacaagaaaataatgacagacagaattccttttaaaactgtaaagaaaacaaaatgaggtaagaaagagaaacagagaagtagggaggaagaaaaaagggaaggagggaaggaaagaaggaaggagggatggagagaaggaaggaaggagggaagaagggaaggaaggaagggaggaaaagtgggtagtctacccttgttttaggtatttattatttttatgggtacagttcttgaattctaggctttctttgaagaggtagtaatctgtagccctcacctaggactacaaggtcattttttaaaaaatagctaagaaaacacatgtctggcatgtttatctcaggccatcgttcttggccttctagagagttaatgtctactatgtcacttcatcagggaggggtagttaagcttgaaaaatctttctatgacatgactgtgtcctgcacatattaaaaactggccgagtgaacacaccaccgacaggccatgtttggagccagtgtttttgctgaaagtcagacaattctccttccccgtcgtggagggcggagaagattctatctggagaagggtcctctgaagctcacatctggcatttggaatgaataatctcttcaatggccaggcacgctggctcatgcctgtcatcccagaactctgggaggctgaggcgggaggattgcttgaggccaagagttcgaaaccagcctggccaacatggtgaaaccccttttctacaaaaaatacaaaaattaggccaggtgtggtggctcacacctgtaatcctagcacttcgggaggccaaggtgggtggatcacttgaggtcaggagttcgagaccagcctggccaagatggtgaaaccccatctctacaaaaaatacaaaaattagctgggcgtgtgccatgcacctgtagtcctagctactcgggaggcacaagaattgcttgaacccgggaagcagaggctgcagtgagctgaaatcgtgccactgcactccagcctgggtgacaaagtaagactgcatttcaaaaaaaaaaaaaaactagccaggggtggtggcacacacctgtaatcccagctacttgggaggctgaggcaggagaatagcttgaacccgggacgcagaggttgcagtgagccgagatcgcaccactgcactccagcctgggcaacagagcaagactctgtctccccgccaaaaaaaaaagaattattgctggaataacataaaaaaaaaaaaaaaggctgagtgtggtggctcatgcgtgtaatcccagcattttgggaggcctaggcagcaggcaggttgctttaggctgggagttcgagatcagactgggcaacatagcaagaccccaattctataaaaccacagtaattaaccaggcatggtggtgcacacctgtagtcccagctactcggaaggctgaagtgggaggatctcatgagcccaggagtttgagattgcagtgagctgtgattacatcattgcactccagcctgtttgacagagcaagaacccatctcaaaataatacacaataataataattaattaaatagagatagatttaaaatgtctgcattgaaacccaaagctatcttcaaggggtgaaaaaggagcattctaacgatacaaaacgcattggcaaatgccccaagcattgcaggtctttgcttctttatcttctgcccctgcctgggctccttcctccaggtttgatgtccagctctctctttcttttttgttttgttttgttttgagatggtgaattgctctgtcgcccaggctggagtgcagcggcacaatctcggctcactgcaacctctgcctcccaggttcaagcgattctctggactcagcctcctgagtagctgggattaaaggcacccacccttactcccggctaatttttgtatttttcgtagagacgggttttaccatgttgaccaggctggtctcaaactcctgacctcaggcgattcacctgcctcggcctcccaaagtgctgggattacaggcgtgagccaccacgcccagccccagctctctttccatctgtctttgtctttttttgtctctgccttggttctgctgagcttctgcccgtacctcgctggcctctcttcatgtctcttttctcctgctccactccctccatggtctgaccaggtctgcccagcacgtgcgatgggagattgtgccttgctttgccttcctgtgtatcattctcggcatgcttcctttgcaaatcggtcagctcaggcgtctgagatgttctgaggatcttggtgctctcagactgactgtctctgccagccactgccccctgggatcttctctgcaccgtgcgtgtctcaatcacgatgctgtgtgcttcctcctgcagccgacgccccaggcgtgatccccgggattgtgggggctgtcgtggtcgccgtggctggagccatctctagcttcattgcttaccagaaaaagaagctatgcttcaaagaaaatggtaagtctcagtccgccggtgcctctccttcatgccttgctgattggaaaactgtgctttctttaaaaggcagaaaccaaactcgggctggcacgaaacaggtgcacgatggctgatggttcgtgaaactgctaaaattctggaatcgaaccttctggctttgatttcagggctgttctgccttgtgttttgttgtgtgaaagtttacaagttccccactgctgcagtgcttgggttgtttacgtctaccaagtgggaaatggttggtacatatgccgcggaattgttgctggggttagagacagtcctgcaggaaagccgctacaagttaccctgcagagagcaaaggtggaagacacttagctctgatcattcctgccctgttatttacaaccgatgtcatcatcaggaggagagccgtgaccagggggccgccacggtcctttctccactgagagttaagttaaaagccggcacaaggccggacatggtggctcacacctgtaatcccagcactttgggaggccgagacgggcggatcacgaggtcaggaggagatcgagaccatcctgggtaacatggtgaaaccccgtctctactaaaaatacaaaaaattagccgggcatggtggcgggcgtctgtagtcccagctactcggaaggctgaggcaggagaatggtgtgaacctgggaggcagagcttgcagtgagctgagatcatgtgactgcactccagcctgggcgacagagtgagactccgtctcaaaaaacaaaacaaaacaaaaaccagcacagcggattccctttctgttagtaccgaaaacccacaggcacccaggacctgggaagtttcttggatcgggactaaaatttacaggggaattaggaggaggacgtactcaccattgcaatcctcctaggtcagctggcaggctctttgggaccttgtattgggatccgccgtgaagctgggaagtaagccctgctatttggaacacagctaacgtgcatgcatcactgggcacttacatttagctcttgccttccctcttgcatgaccaagcattgtggtttgcaggaatcccatcgaccgggaacagctactcttattttttatttcttgagacagagtttcgctctgttgcccaggctggagtgcagtggcgcaatctcagctcactgcagtctccaccccacaggttcaagtgattctcctgcctcagcctcctgagtagctgggattataggcacccgccaccacgcccggctaatttctgtatttttagtagagatggggtctcaccatgttggccaggctggtctccaactcctcacctcaagtgatccacccgcctcggcctcccaaagtcttgggattacaggcgtgaggcaccacacctggccaacagctactgttttatggaggagcccctggggtccctcacgcctctgggtgtctgaacttctcaccctacttagatcttaagtccttattcattcttggtcactgatgtcattcactcaaagcactgcctcctgaagattttagagggattcctagaacatttgaatagatgctggtgtggacaaagttagactgtaggggtggagtttccccgtaatctcccatcattccagcatttgacatccacaaacattatttagagcgtgaaatggagagtcctaaacagctttcggatctcaagactttaaatgagctgctcgtgtttatttccccgttcttgctgtggggttttgggcagtgcgtggaagacagttgcctcctacctggtgggcagacgagtgggaaatggtgtttggttgtttcttttttttttttttttttttttgagatggagtctcactctgtcacccaggctggaatgcaatggctccatcttggctcactgcaacctccacctcccgggttctcctgcctcagcctcccgagtagctgggattacagatgtgcaccaccacgcacagctaatttttgtttttttagtagagatggagtttcgtcatgttggtcaggctggtctcgaactcctgaccttggatgatccgcctgccttgacctcccaaagtgttgggattgcaggcgtgagccaccgtgcccagctggtgtttggttgattgaatggcagttttgagcgggacccaaatggacagatgaccacattcaaggagatgcctgtaagagacgtacgattagaatcacgttggaaaaaagcaaacagcataacattcttctcccctcttgcttcttctagaagtagcggaggggttaaaacagtagggactcaatggaagggaatttttgtttgcttttcaatgacatttctttttcttttctgaaactgttcaactcacagcataatattcaaccaggaggtaaggaaggcttgtttgccaggacaggatgcgtaatattctagatgttgtatttcaaactctctggcttttttttttttttttttttgagacggagtctcgctctatcgcccagaatggagggcagtggtgcaatcttggctcactgcaacctcgcgggttcaagcaattctcctgcctcagcctccgaagtaactggaattacaggtgtgcatcaccacacccggctaatttttgtatttttagtagagatgggggttcaccatgttggacacactggtctcgaactcgtgacctcaggtggttcccccccgcaatcttggcctcccaaagtgttgggattataggcgtgagtcaaagcacccggcctcttttttagaatcccagacaattgttgaacacttttgcattaaactacaaagtctctgattgatgattctctgaaaatctttaggtcaacccaaattggattcatgagttgcaaaggatgtttattaccttgtgcgtgcagacgtaggaacttttgggatcttgtaagcctatttcatattcacatcctgtattagtccgttttcacactgctatgaagaactgcctaagactggataattcatgaaggaaagaggattcattgattcacagttcagcatggctggggaggcctcaggaaacttaacaatcatggcagaaggggacgcaaggcaccatcccattatcacgagaacagcatgggggaaccttcgctatggttcagtgaccccaacctggtctctccctggacacatggggattatgggaattacaatttaagatgagatttgggtggggacacagaggctcaccatatcacatctgaagacacacaaacttgggaaagcacccaggaggcttaatagacttgattttgtcaaaaattttgaaatagaattgggaaaaggaaaaacaacttttcctctaccttatccgccccgccacccctgggtcttggtcttgggtggaagcattatctttttttattgcaggaggtggggcaggcatgaacaatgaaagctctcactgggtagaaacaattttcctagattcttcaagaacaaaagcaaatatgtcctggcgaggtggccgacacctgtaatcccagtgctttgggagtccaaggaaagaggattgcttgagcccaggagttcaagatcagcctgggcaacatagtgaaacctcatctctacaaaaaatgtaaaaaattagctgggcgtgcttgcgcctgcctgtggtcccaactactctggaggccgaggtgtgaggattgcttgagcccaggaattggaggctgcagtaagccatgattgcaccactgcactccagcctggacgacagacagagaccctgtctctagatataaaaataaaaatacctttttttttttttttgagacggagtctcactctgtcacccaggctggagtgcaatggcgtgatctcggctcactgcagcctctgcctcccgggttcaagcgactctcctgcctcagcttcccgagcagctgggactacaggcgcgtgccaccacgtccagctaatttttcatatttttagtagagacggagttttgccgtgttagccaggatggtcttgatctcctgacctcatgatccacctgccttggcctcccaaagtgctagaattacaggcatgagccaccgtgcccggcccccaaaataattttttttaaaaaagcatcctttctgaagaattggctcaggggagtccaagattcactttatactaatgagatgctaggctaattttcttctaatattttctataagtctcttattctgatgccaaattaacagaaggtccaactttcaattcctggtttgctttctagttatcctgggattgattttcttggccttttgtaaatgcacaaagcaaagggccaaaaagaaaataaaataaagtataacaaagagaagcaagagatggtgaaaccccgtctctactaaaaatacaagaattagctgtgcgtgatggtgggcacctgtaatatcccagctacttgggaggctgaggcagggaattgcttgaacccgggaggcagaggttgcagtgagccaagattgtgccaccacactccagcctggacaacagagtgagactctgtctcaaaaaaaaaaaaaaaaaaagagaaagaaaacaaaaacaaggcactcttctataaataccaagaccctacctcaaaagaggacctttccaactgcatccactcacagcttggtttttatacctgaattataaaatgagtttaatatttatctcagtgacatgattttgttagtagacatggaattgtgatgttggatcgagttatccggaagacgaaagatgtcagagccctcagcctctggggcaggattttgctttatgggttcgatttccgggatggtgattttgagatctggcaaccccataggttcatggggagcttggagatttcataagaaggatgtgagtatagcatgccctggtccttcaagaaaccatgggccaggcgcggtggcttacgcctgtaatcccagcactttgggaggccaaggcgggtggatcacctgaggtcaggagtttgagaccagcctggccaacatggtgaaaccctggctctactaaaaatacaaaaattagccaggcatggtggtgcacacatgtatttccaggtactcgggaggctgaggcaggagaatcgcttgaacccaggaggcagagttgcagtgagccgagatcgagccactgcactccagcctggggacaagagcgagactttgtctcaaaaaagaaaaaagaaaagaaaaaccatgcccagttttggggatactgttattctaccagacaggctcattttccgggactgtgtcattgcattgaaatctgtggtgtttgttaaatttgtattaaaatgagtcccaggcgagtgagtagacataggtgagtcttcggcatctttccaacaaggagatgcctttatcaaatcctgtgacttgatatagatttactgagaagctttgcagtgttatattttggggttcacggattagaaactccttgtggaatcagatggctctgtctgttataggttggtgcaaaaataactgcggtttatgccattaaaagtaatagcaacatagcaagacctcgtgtctacaaaaaacgtaaaaaaaaaaaaattagctgagtgtggtggctcccagctaattttttacctttttttgtagagacagagtcttgctatgttgccattacttttaatggcaaaaaccacaattacttttgcaccagcctccgttcctcccttcctacagatttgagtttgtggtgcttgggcttctcctggtttttgtccatgtgatacgaaggggcctgttgaagctgcttctctcatgcactcggggtctgtgacttcgcatctgggtgtgttggcttcgcgggggacctggctcagaccactaaccacacggagcctgaccacttcccacagagcccagcttccgtggctggcaaggggtgttcaggatgctgtcctttggctgtggtggctggtcctactgctctgtttgccagggtcctgggctcacagtgggtttcttgaggctttggcaagatgggcgattggctctccctgtctccttctttctctttcttcttctctgcctttcttccttccctcctcctttctttccccctccctccttcttttctctcttccttccctgcttttctctttcttcctttgccctcagttctccctctctctctcttttcattctttcttgaactctccctctttcttcctccctccctcccttcttcttttcctccttttcctttttctctcttccttttctctatctcttcctttcttccttctcttttcttcttatgtacctctttcttttttctctcttctttccttccttcctttctttccatccctccctccttctttccttttcccctctccatcccttcctcctttccttccttcctttctttttttcctctctattctttgtctctcttcatccatctctcctgttcttacatgcctcttttcttccttccttctttcttctctccctccttcccttctttccttccttccttcccttcctccttccctctctccttcccttcctccctccctccctcatttccttcctccctgcttcacttcttcctccctcccttcctccatacctccctgcttccttttttccaacctccttccctcctcgttccttccctctttctgccttcctcccttccttcctcccatcccttcttcctgcttccctcctgctctccctgttccctgcctccctccctgccttcctctgtctctcccttcctccactccttaattttggtttccacttcccactctcacactttgagcctctatcccattacttccttgctcagagcagctctttctaacacctccctgctgctgggagccccagcgcacagcaaaagcagacccagcaccagtttactttttgtattattattttttatcgttttcaaccttccatttcagatggctgaagacctaggggtgagcagagaacccagcccaggcctgcggagcgtcctgaccgtaatcgttttatctgctaagacatagccttaaagcaaacccttccatctgccgctcccctcgccctgctggcaaattcccaccacgatgggattctcaatcacatggcggattctctgccttcagttccatatgcttttgcctttctggatgcacagaagctcattatagcaaatcatatttctgcataagagcttcagaaaatgaagagaaatgcagatattttcttttaaacatgaatctaacagaaacagggcagtgacttccatgttttaatgagttttgtccctaagtccatccctgccaagggaacaaactggggcccagggtggccaccctcttccctgcagtgtcctaggttaagctcactcacgtcctaaggatttgaccttccaggtcatgcatggatttttaaatcttcaacgtttttggccgttgacttgcatttctcactgcacttcctatgaagcagttcttaactctttctgtgatcagtgttccaaacaggtacacaccttggttcctagaaaaacaaaattcatacgttgaggaatcacctaaacatctcctgatcttcacactgtaaggcgtgttgggaattggtgggtggtcaggtccctattcacacatttgagcacggagcctctgcggccgtcttccttggattctctcatatccctgaaaaacacaaattgtacctggattttccttctgtttccaaagtccaccaacttgttcttcaatgtaattgattttaacttgttttctttcttttacttttcttatttttttctttcttttcatttttttcttatttcttttccttctatttattttacttttcttatttgttatatgttatttctttttcttttcttacttttcttcttttttcatttttcttttttaaattggagtctcactctgttgcccaggctggagtgcagtggtgcaatcttggctcactgcagcctccacctcctgggttcaagcgattctcctgcctcagcctcccgagtagctgggactacaggcacacaccaccacacccagctaatttttgtatttttagtagagacggggtttctccatgttggccaggctgatctcgaacttctgacttcaggtgatctgcctgcctcaaccttccaaagtgctgggattacaggtgtgagccactgtgcctggccctttttcttttttctttttttttttctcttatttcttttttcttatttgttttcctttttgctttttctttttatcttatttcttttacttatttttcttttttttacttttatttcttctccgtttttcctcattcttttcctcttatttctttgacttttctgatttctttttttttcttattttcctttttttttcatattccttttaattttttcttacttcttttacttttcttatttgccctcttgtggaaatgaggcacagcctcccttatggttgagccgtagttctagctgagcacggatggtttgatcctcctgtgttggggcactgtatggtgtgagggcacaaaaccttgacccacatgggtctggtcaccttctcacagaggtcacctttacagccccccaactctttgaaggatgtgtcccaaggtgtctcaagtctgatgcaatgaaagctgccccccattgaccacaggactgagtccagaatgtcctgcgtgtttcccagagtgtctgtcctaacaccgcttaaagattagccactgctagacagtgatcctcaggtatatggtctcaggattggccccaagcacacggtgtgtgtgtgtgtataaatatatcttcacaaagcataggtacccattaaagccatattgctttgctgaatggttctaatagctacagatgatttctagcctgaaagaaaagcaccacgaattgtttgaagttgacttgtcagatgtggcatgcttggtctaagttttgacaggaagggtatgtgggtaggggtgtacggagcatctcatgagaccagttctcctcctgagaggtccgtgatgttggaactgttgccccagatggactttgcccttgtgagactttatacttttcaatgcagtttttccctctttaaaactcgccagcttttatgtagtgttttataaaattacaggaataaaaagaatatcttttatgctttttaaccaatgaggggagagggagaaattatttgtcctctgaaatgaatgcaggttttcaatttctagccaggacagtttgctgcaaaatgcacccgtgttgacaacttgtgactggcagaacaaatgacatttgtggtgaacattttcggatcatttcgaatgttcttctcttcagggggttttcctctctttttcttaaatcaaagaatttggccctttatgtgggagtcatttagtggttagggagaacagttgaaactgtggagttcacgtagcgtaaactggcgaggctgtctctgctgctgtcattaaaagttacgctgctggcttggcacggtggttcacacctgtaatcccagcattttgggaggccgaggtgggcagatcacgaagtcaggagatcgagaccatcctggctaacatggtgaaaccccgtctctactaaaaatacaaaaaattagctgggcatggtggcgggcgcctgtagtcccagctactcgggaggctgaggcaagagaatggcgtgaaccctggaggcggaggttgcagtgagccgagatcgcgccactgcgttccagcctgggcgacagagcaagactctgtctcaaaaaaaaaaaaaaaagaaaagaaaaagaaaagttacgctgctgcaccatacaaacgtgttcctttatgaaggcatttgaaccacagatggggccgttttacaaatagcacggtctttgtgagggggaaacgcatggccacagattcgatgagcttctgctgcttccctttgtgttgaaaacgtgggtgttccttcacaccaacactggaaataaataaatacctattgatctgtgcatctcttacgcgtttccaattctgttggcttatgctgtgggtcagaaaagaagcgacaccgacaacatttggggacttgaccctgtttgcattgcggcatgtttgaaacattttttaatggaaatttgggaatagagggccgggcgtggtggctcaggcctgtaatcccagtactttgagaggccgaggtgggcggatcacaaggtcaggagatcaagaccatcctggctaacacggtggaaccccatctctactaaaaatacaaaaaattagccaggcgtggtggtgcatgcctgaaatcccagctactcaggaggctgaggcaggagaattgcttgaacccgggaggcggaggttgcagtgagctgatatcgcgccactgcactccagcctgggcgacagagcgagactctgtctcaaagaaataataataataataaataaataaataaataaataaatttgggaatggaaacaagactgggaaaaaatgctggaggaggaagaaaaccgggtacacaagacgccttggctgtcttgtcctttgatggctggggaagctcttagtgctcggagtcctcactcacctctctgcattctgagggaggtagaaggggggacaggagagccaattcaacctgagaaggatgattggtggaggtgggtaaaggaagaaagtcccctttccctaggtactgaaaagatgctaatctgctgagattctctgtatttatttttatttattttaatttttattttgagacagtcttgctctgtcacccacgctggagtgcagtgccacgatctcagctcactgcaacctccacctcttgggttcaaatgattctcctgtctcagcctcccaagtagcggggactacaggtgcacgccaccacgcccagctaatttttgtatttttaatagagacggggtttcaccatgttggccaggatgggctcgatctcttgacctcgtgatccgcccgcctggcctcccaaagtggtgggattacaggtgtgagccaccatgcccagcctctgcatttatttttatttatttatttttatttttattttgagacagtcttgccctgtcacccaggctggagtgcaatagtgtgatctcggctcactgcaacctccacctcctgggttcaaacgatcctcctgcctcagcctcccgagtagctgggagtataggtgcacgccaccacgcccagttaacttttgtattttttagtagagacggggtttcaccatgttggccaggctggtctcgaactcctgacctcaagtgatccacctgcctcagcctcccaaagtgctgggattacaggcgtgagtcaccacgcccagccgtctgcatttgtttgatgagtttgggggcagttataaataagaatcttattttcacagatgcacgtactttttttttttttatagaaagagcttccatgtgcgtgttcctcagtgtttagggagaagaaagcaacccttaaaatagaggaaaatgaagctgcttggattaccctgttgaagttcatctctgcctgtgccatgcatgaaaaaatactggcaaagtcttcacttacatgagtgttagactccatgttcccagtgggtctcggggttcagaactgagtgctctcatccaagcaataggagcgtcgacctcaggaaagcccaagtgttttgtgtgtattttgaggagtgggttatctgttgcactgagcctctctgtgtattttcttcttcttttcagcagaacaaggggaggtggacatggagagccaccggaatgccaacgcagagccagctggtaagaaggacggggaacgatggcttgcacacgtggccagtgttcccattttatcttctccatcctctcccatcttgctgtcctgctcacattctcaaatttggttgcatggctttgaatgtcttcctttatgtctcgttgctttggagggatactttcaaaagacaatgaatgtgtaaacttcctagggcctgggccttcagagaagacctatatgtgcctaagtctctgtttaacaaaatattaaggaagttttcccaggagttcgagaccagcctggccaacatggtgaaaccctgtctgtactaaaaatacaaaattagctgagtgtggtggtgggcgcctgtaatcccagctacttgggaggctgaggcaagagaactgcttgaacctgggaggtagaggttgcagtgagccgagatcgtgccattgcactccagcctgggcgacacagtgagacatgtttcaaaaaaaaaaaaagttccaagtggcacacgattggtgcatagttgggaagtccacagctggctggtgtgcactgggaattaaaagcccatctcctgaaatataactcgttaagttttgctgtcaactttttttttgttgttagagatagggtctcactctgtcgcccaggctggagtgcagtggcacgatcataacttactgcagcctcgatctcctgggctcaagggatcctcccacctcagcctcctgataagctggaaccacaggcgtgcaccaccgtgtccggctgatttgttgttgttttttttttattttgtagagacaaggtctcactaggttgcccagacagggtctcactatgttgcccatcctgagctcaagcaaccctccgacctcagcttcccagagtgctggggttctaggcgtgaactaccgcacccagcctgctatcaccttctaaaaatcctctcaaccaggtggaaaatgtggttaagaagagactttaattcgtgagaaacttctcagggtaaaaggcaggcattttgccatcagaaccacttttgaaaatggcaagaaaaaaatgtgtgtgtgtatatgtgcgtgtatttttttattttgtttgtgcatacattggaaccttctcatttgcctgagagatgcagtgcttatttttaatagcagctgtcaaattgagagggatttttaatgaaatgatttaaaatattttaattttttttctttttgagatggagtgtctctctgtcacccaggctggagtgcagtggtgcgacctctgctcactgcaacccctgcctcccagtgtcaagtgattctccttcctcagccttctgagtagctgagaccacaggcacccgccatcatgccccactaattttctttctgtttttactagagacggggctttcgccatgttggccagagtggtctcgaactcctgacctcaagtgatctgcccaccttggcctcccaaagtgctaggattacaggcatgagccaccgtgcctggcattccattttaaagatagagacttctacaaagttagtgtctcgccagacgcggtggctaatgcctgtagtcccagcactttgggaggctgaggtgggcggatcacctgaggttgggagttcgagaccagcctgaccaacatggagaaaccacgtctctactaaaaattaaaaaaaaaaaaaaaaaaaaaattagccaggcatcgtggcgcatgcctgtaattccagctactcagaaggctgaggcaggagaatcgcttgaacccgggaggcggaggttgtggtgagccaagattgcgccattgcactccagcctgggcaacaagagcaaaactctgtctcaaaaataataataataataataaaagaaagttagtgtcttgttgactgctctttcgagtcagggaaagatgtttagaacaagctatatcttaaagagaaaaggaagattccttctgcccactgcaatgaagttgtctggcttcattagccagtacattggtatatgtgtgtggagccctcgtgacttgaagggcgtggcattccagtgttttctgccaccattgttcttaattccttcttccaaatcccagcttctccctccaaaatagttttaagactgacatgcagaataaagtttccaaaacttaaatgaatggaccagaaaatctcagcccagcatcattgcaaatcaataaaaactgcacactctcatttagaagatttattcttccatttggtaagttataggcatttgttagtgtctctgtgacgtcgttagtggaaattgccttctgctgttttccttctgctttttctgcagcatccattttttttaatgaatggcatcattcaatgaaattgattgaattgattgagatttagggttttgctttctcgtgatgagttttgggcccatttttcttatgcagaaataaaaccactggctcctgaaagttgtaggaactgtgtccacgtgagtgctcagggacctgggaatgactttcttttgtctctgtctcccacagttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaagtacttttttttttttacttaaatattttgccgtgggtggatgttaaagaaggccgtggtaatttacaggatgggttccaagttctcttcttctggggctttaaggcagatttccagcctaaatgctagctctttatttccaaaatgtccttgttgggctcttttcctttcccgtgtcctgccacatcgggatgggtactcttctgcacccagatactcccagccagatactctcctccatccagatactctgtttccagatactctccctgcagctagttatccccttgagtccagatgctgcctgcttccagatactcctctgtatccagatactcctctaaatccaggtactccctacatccagatactgtacttcctaagatgtacaagatgtaccgcattttcccaacactgaagacttgaccacagcttaagtgggttggttaaatacattatggcccagattgcaatggatcttctgccttgttaaaaagaatgaatgagtcaagggtctttttgtttactgacactgcctagcatgtattgaagctcagtaaacacttgcagaataaatcacagaaaagcctctctccttaagaagttaagagattggctctgataccaacaactaccatactattccaaatactattatttcaaaaatttataaagtattttattctatgttctattagccattaagtaacttttttttttttttttttgagacagagtcttgctctgtcacccaggctggagtgcagtggggcaatcttggctcactgcaacctccgcctcctgggttcaagtgattctcctgcctcagcctcccaagtagctgggactacaggcgtgcaccaccacacccggctaatttttctatttttagtagagcctgggtttcaccatgttggccaggctggtctcaaactcctgacctcaagtgatctgcctgccaaggcctccaaaagtgctgggattacaggtgtgagccactgtgcctggcccagcccttaagtaactttttaatcatcattcccaaaatcataggactttctttacatagaagttccaaaataatgaaacaaaagacttgttttacccaggtatttaatgatccaacaagccgtataatttaaactctatttttcaagtaacccactttcaataaaatcatgtttatttttatgtccatgagaaattaaaatcagtcatctacaaagatggacatccaccctccacaaaaaaataagtcttgttgacacatttcttggaagtatagatttatttataagtaagccctaatttgacatatctaaaaaaatacctttttttttttttttttttttttttttttttactattcttctttttactcttctgcttcttgtttaatgagccatttctgtggatagtatgattacaatgagccatttgtgtggatggtatgattataatacttacaaaaatgtcagtgttattcatagaatgacaacagatttaatgcattttttcttttttttattctaaagttagtcaatgtgaagaatctgacctcaaagacaattcttgataattcattggggaggactagaaacaccaccctctaactttataacgtgtcattggtcactcagcaaagcggccaggcatgctggtttatccagctttcagcccttgaagattcaccagactaaggattaagtgaaaaagaatatctgccacctacttcactgaggcgtaaacagtccctatagatcaatgagaaaaggacccaacacccgtataaaaacaaagggcaattcacatgttttccagaaatggaacgcagatgattttatgaagatagcccatttgatgtcgtttttcaactaagagattggcaataatcagaaagtttgtagggctcttaggaaacagatctgagacatcatgtaagtcctgggcatttgcgaaacttctatggggaatggactgacagtgtccttaaacaattaaacatgcacatccgtggtcggccccctcaagggtggagaggatgaggcatttgtgatgtctcaatacatcctggagaatctagaaggtcacctccacacacctgcaccacaggtggcatcctataggtatttgctaaaggaagcaatgaaagggtaagataaataaccaagaggtgcccgccactgtgttcacccaattttacatactccaagttatcactagtgtcaaaatcagaagaaataactccaatgccagaaaaagccagctggctgtgcccttcaatatcctgagaatgatgggatgtgaaaaggtgtcgaatcctcaacagcagggagactgcttggatgactcccacccagaactgaaattgaaggcggagtttctgagcttagaaaggggaaagacccagcatttatgactgactccttcatccaacctctttccccaaatcagacgatttttgacatgggtatggtaacaccatacgtttgcatagagagattcatgggaagcctagctgctgtgacgtgcagcagtcagtttttaacaccatcatcagtggcgaaatgaaacattcccttgaaatcgcctttctctggatgactatttaaacagcttcacgttagcctgcctgtgcgactgaggacgtactgatgatatcctcattttccggtggaggaaagtttatgacgtcaatcccattccgaatatcaggactttaaatctctatgatgttagcacaaaatgcaagtggagccctctccaagctttcatagagccatgtattttggaagccttaatggggagacagttctcaatgtggaaaagttgtcatgtatcgcagagaagagaacagaccaccatgcccagctaatatttgtatttttagtagagacggggtttcaacatgttggccaggatggtctcgatctgttgacctcgtgatctgctcacctcgacctaccaaaatgctgggatttcaggcgtgagccaccgcgctgggcccaatacatctcttttcttagttgacttcttttgtatctcttcatagccttttcatatttttatattgatttgtatctttcattttttatatatttaaactacctacttatgttaattctgtgccatggtaacttccttaattcatgattcatatgggcatacatacagtcatggatacaacaggctttcgtatataaaattatgaaaaagtttattcttttaacattttgtggggatacaacaggttttcatatataaatcatgaaaaaatgcatctattcttctaacactttgtgaggatacaacaggttttcatatataaaattatgaaaaaaaattcttctaacacctttgtggggatacaaaaggttttcatatataaaatcatgaaaaaggccgagtgcggtggctcacgcctgtaatcccagcactttgggaggccgaggcggctggatcaagaggtcaggagatcgagaccatcctggccaacatggtgaaaccctgtctctactaaaaatacaaaaaattagctgggcgtggtggcacgcacttgtaatcccagctactcgggaggctgaggcaggagaattgcttgaacccgggaggtggaggttgcagtgagccaagatcgcgccactgcactccagcctggccacagagcaagagtccatctaaaaaaaaaaaaaaaaatcgtgaaaaaaagtatctattcttctaacacttttgtgagggttacaacaggttttcatctataaaataatgaaaaaatgtattcctttcttaagaacatttgtcaggaatgggtattaaattcaatcaagtgttttcttgggatgcatcatgctgactatggttttctactttgacctgttaatatggtgaattaaatataatgacatatcatcgatcatccttcaatccaatcttatttggtgttacactttagttttgttattttctttaggattattgtgtcaatattcaaaagtcaaattcatgtgtgttatatgtttgcatgtaatatatttcaatattgtgctttcttcatacatacattttggtagattttcttctttctcttgtggaaaatctgattggctaaagttttctgggcatgggctgtgtgtgtgtgtgtgtgtgtgtgttttagagggggcaaagggtttttgtttctttctgttggagagagatttatttatttagagatggagtctcactctgttgcccaggctggagtccagtggtgcaatcttggctcactgcaacctccacctcccaagttcaagcaattctcctgcctcagcctcccgagtagctgggattacaggcatatacaagcacgctcagctaatttttgtatttttagtagagatggggtttcaccatgttggccaggctggctcaaactcctgacttcaagtgatctgccttcctcggcctcccaaagtgctgggatgacaggcatgagtcactgtacccggctgggaaatgaatttttaaaaaaaaaactttatgtatttctacttcttcattggaaagtcattcgtatttacttaagttttcaaatatcacagtgcagattagaacaaagtagttgtttataattcttccgcatcctccaagtgtatggagaagctcgcattcttcttgttttgtgctgtcattattttagtttgttatcttcgtctactttagttttctcagataatgtttaaattatttggcaaatcatttctcaattttcaatgcattaatttcctccacctgcttttctggagtttcatgtgatacccactctccccacacaggatgacttctcgagttgaatgttcattccatttattttcattctttcttgcttaatgttgtaaacaggcgaggttctaacttttcatctgtgtactacaagctctcaagttctttcatggggagtttgtatcatggtcattttctagtatttagcattttcagcttttgtttcctgtcaactcaacattaaaagttttttaaaacgtccgggtgatattgttgctttgtttgctttcctggtttcattatccattttcaattttgctgctgtgaatttgcaccgtctccttggggagtgatttggctgtatattagtcagcgttctctagagggacataactaatggaatatatatatacacacaaaggggagtttattaaatattaactcacacgatcacaaggtcccacaataggccatctgcaggctgaggagcaaggagagccagtcccagtcccaaaactgaagaacttggagtccagtgtttgagggcaggaagcatccagcacgggacagagatgtaggctgggagggtaggccagtctctctttttgcatttttttgcctgctttatattctagccttgatggcagctgattagattatgcccacccagattaagggcggggggcctgcctttcccagcccactgactcacatggtaatctccttcggcaacaccctcacagacacacccaggatcaatactttgtgtcaatcaatccaatcaggttaacagtcagtatgaaccatcacaggcagtgtctacaagcaatgaaacatgcacacacctttctacctaattcctgcccattcctgaccaacgctcctaagaaaggaatagatttgatttttttcttgattttatatcttaaaaacctgttgtatccatgtctgtatgtgtgccagggtgaatcacaaagtcaggaagttagtgtgacgcagaataaggatatctttattcttttattttttattactttttattttgtttttgagacagagtcttactctgtcccccaggctggagtgcggtggcctgatctaagctcactacaacctccacctctccggttcaagtgattctcctgcctcagcctcccaagtagctgggattacaggcacatgccaccacacccggctaatttttgtatttgtagtagaaatgtggtttcaccatgttggccaggctggtctcaaactcctgacctcaggtgatccatccgcctcggcctcctaaagtgctgggatcgcaggtgtgagccatcatgcgtggcctagaatattcttatttccaattttacagcaacagaatgtcttctgtcttgtttctactttaaaaaaacagtttgctaaagctttctttgtagtgcagttgtgaattttcaggagcatcccatgaacattgaaaaggagatgcattcacgctttttaaggttatcgaggatgtgaaaattaaagtcggctttgtaaattctgccatgtctgtgagctcccagcatttgatcagctgaggcttcgagcggtgaagtagagtgcttttcccctaacgtgctctgatctggagcctgcgtgtattaccgctgggcacacggcctgccctgaccatactttagtgaagcagaggtgataaaactgggtttcccaggactcctgcaacacacagctttgatgtcggcaaactagaacccgggagccaaatctgcccacggtgtgtttttgtacagctttcgaggtaagaatttttttgtattattgtcgttatcgttgttttgagatggcgtcttactccgtcgcccaggctggagtccagtggcatgatctcggctcactgcaacctccgcccctgggttcaagcgattctcctgcctcagccacctgagcagctgggactacaggcatgcaccactacgcccggctactttttgtattttcagtagagacagggtttcaccatgttggccaggttggtctcgaactcctggcctcaagtgatctgcctgcctctggctctcaaagtcctgggattacagacatgagccacggtgcccagccaagaatggtttttacatgtctgaataattttcaaaactccaaagaacaataatattttgtgatgcatgaaaattatgtgacactcaagtttttatgttcataaagtccacttggcgcacagacattggttacatattgcagcagaatccatatggtttgcaaagataaatgcctttactatctgaccttctgcagaaaagcttgtctactcttgcctcaagaagcatgtaaaatacttacaacactggcacgttaggcatgctggaaatcgtagcaattattttgcaccttcactacatctgagaggatttcctgaacttaaccatttaacctaactcctcactaccttttgggaaacattttttttattaaggtgaaattcacaaatcatagaattaaccttttttttttttttgacccggagtctctgtcacccaggctggcgtgatctcatctcactgcaacctctgcttaccgggttcaggcaattctcgtgcctcagcctgccaagtagttgggattacaggcagtcaccaccacatctggctaatttttgtatttttagtagagatgggttgcatcatgttggccaggctggtcttgaactcctgaccttaggtgatccacccgcctcagcctcccaaagtgctgggatgacaggagaattcaccattttaaagtgaacaattcaggttgcttgctgctttcacagtgttttgtggccaccacttctacctagttccaagatattttcactgcccccaaaagaaatcccattagcagctgttttttatattggcttcctggggctgtcataaaaacatgcttcaaactaggtagggggcttaaaaaacagacagttaagctgtcacagttctggagcatagaggtctgaaatcaaggagcaaacagggtggattcctccctccgtccctccttccctccctccctccctccctccctccctccctccctccctcccttcctgccttccctccttccttcctttctctttcttcctttccttacctttcccctttccctccctccctccctcccttccttccttccttccctccttccttccttccttccttcctttcctcctcctccttcttctttctttctttcttcctttctttcttctttctctttcttctctctctctcgctctctctctctttctgagtctcactctgtttctgttgcccagtctgtagtgcggtggcacaatcttggctcactgcaacctctgcctcccgggttcaagcaattctcctgcctcagcttcccaagtagctgggattacaggcgcgcaccatcgtgcctagttaatttttgtatttttagtagaaacgggatttcaccatgttggccaggctggtctcgaactactaatctccagtgatccgctcacctcagccacccaaagtgctgggattacagacgtgagccaccgggcccagccagcagggctgatttcttctgatgctgtgaggtagaatggattccatgcccctcccattgcgtccagtggtttgctgccaatatcccttggcttgtaggtgcatcaccccaatctcccacttcatgttcccaaggccttctccctgtgtgcatgtcagtgtccagatttctctcttcttttaaaataccaatcatattgcagtatgacctcatcttaactaatgattaggttggtgcaaaagtaattgcagttttcaccttcaaaagtaatggcgaggagctgggcacgctacctcacgcctgtaatctcagcacttcgagaggccgaggtgggcggatcacaaggtcaggagttcgagaccagcctggccaacatggtgaaaccccgtctctactaaaaatgcaaaaattaaccaggtgtggtggtgcatgcctgtaattccagctactcaggaggctgaggcagaagaatcacttgagctcaggaggcagaagttgcagtgagctgacatcacgccactgcattccagcctgggtgacagagcaagcctgtgtctcaaaaaaaaaaaaaaaattaatggtgaaaactgcaattacttttgcaccaaagtaatacatctgcaaagatcttatctccaaagaaagtcacattctgaagtactgaagggttgggcttcaatatatgaagtttgcgggagaaaaaatgcaactcataatatatccattcccacgtctttccagcccctggcaaccggcaatgtgctttctgtctctgcagatttgcctgttctggacatttcagagaaatggaatcctacacaatgcgttcttctgtgtctgttttctctaactcagcatccagtttttgacgtccatccactttgtagcagatgtcacggtgtcagtcctctttagggtcaggggactttgaaggaaatatctttctaaatgcatcaactgcttcctggactctgccactcagagcttaggactgcacaagctaactgccttagagcatttcccccatatgcacacacacacacacatgaacacacatgcacacgcacacatgcacacgcacacacgcacacacacacagacagacacgtgcacacacacacacacctgtgtgcacaggaacttaatccatccaagtaacttacctttataaagatgttgcagtccaggcgcgatggctcacacctgtaatcccagcactttgggaagccgaggcaggtggatcacttgaggtcaagagttcaagaccagcctggccaatgcagtgaaaccctgtatctactaaaaatacagaaattagccgggtgtggtgtcgggtgcctgtaatcctagctactcgggtggctgaggcaggagaatcacttgaacctgagaggcggaggttgtagtgagttgagatcacaccactgcactccagcctgggcaacagagtgagactctgtctcaaaaaaaaaaaaggaagatatttcatagaagacaactcccaaacaccaggtcaacaacatgaacagacttaacactccagatgctcaaatttgcagagagaaaagtccaaggtttatttctccttttgggtctgtttgccatgaatcctgcttctctgggaatttagaagctgccctcataactaagactgattttcccctttctcctgcagttaatctatttaccagaggacttcaaagctgtttgcaaatggtaactttttaagtgcttgcctactgcttcatggtaggtagagtgtaagggttaacccacgagttgtatatggataaattagacacactcacagatctgcagggaagaatataattaaaaccattgtgaaagcaggagtcatcatcgaactcagctatccagtcatgtttcttctccaaggagatttcaaacagaagatgtaaattttggtagttacataaaatgtctcagatttaaatgaaagacacaaaaagccacatatctccttttcctgaacaaccgtctctgctgaaatattagttctgccacctacaaagacaactgaaggctgaggataaaaaatgcctcttggaagtcactgagtttgttaggtataaaagccaagacttcaactgaggtctttgcactgatgtgtacattaaccccacactgggtatcactgtacaatcatgtcctgcaggaggaagattacaggcggccagtgtcttctctggtttctgggttggtgactttgaacttgctacagctcccacacccgcagcgagcagagttgccaagcaagtgtgccggcttccagaagcctgagatgcccattggtgcttgggaaccaccccagtttccccatcgtctgtgctgctgcagattggttggggcagcccggggaggctggctccgacacacgactgagtgtgcctacactggtcccacaggttttcagctgtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtaagaggcattttgctttgagggagatctgcctgggcatggatttttctattcttgctttaagaaactctttccaaaggagttgctatgaagtgaatggggataatttgcccaatgggattagaaaggagactaagagcgatgggtggctgagaggggagggagaagacgggctgctcccatttggaatctgggaattagatccagaagggcaggatgttagctgataccatctagatattcgccatattttcctgttttgatccatgtgtcccaagcgtttaaaaaatgacctatttaactccatgattcaagcatgactgggtgtgtgtggaatgtcagtcatttctttctgattttaaaaattagttctgaccatttccatacagtaaaagtagagttgaaactacttcatcccgtggggcagattaccagagattcgtttgccggaagggttgcatttattcagatttttaaatcttttcctaaacactgtcattcattcttgcaaattaaaaccacctgaattgttcacatcaaaaacttcgatataaacttgcaggctggctgtcccagatccaagattagatttttcagttccgtacgaggacctctttaagaaactccaatgaactcataaagtacaggatttgaacaacggttgagtaagtttctttggtcattttcatgtggcgatttcagagaagggaacacctgggcgcatcttaagagagagaagtatttctgttaggagttaaaacacatcattcagatgtccctgtggcagcatttcctgtttatcctatttaaagacatggacgtcattaagattggagttggttgtttatgggcggaggcggtgtcgggatggatagatcctggtggacatagtctaggatctgcagtgagaattttttattattctgtgctgtcttcagatctcacctagtaagtggacaatgtggccatgcattcattagcttctgtttacagggagatgttcaacagtaaacccacctccccagaaaagtacttccaggagtttgtatcattcacagtaagagccaaaggttaaccatatccccttgggcaaatcaacttctacaaagtgcggatacagacagttcccaacttaccatggtttgacatgatggttcaatttaagatttttcaactttacaacggtgtaaaattggtatgcattcagtacaaacgaaaactgtactttgagtacccatacaacttttcttttttttttttgagatgtcgtgtcgtttcattctgttgcccaggctggagtgcagtgacacaatctgagctcactgcaacctccacctcctacgttcaagcaattctcctgcctcagcatctcaagtagctgggattataggtgcccaccaccacacccagctaatttttctatttttagtagagactgggtttcaccatgttggccaggctggtcttgaatcttgacctctggtgatccaccggcctcccaaagtgctgggattataaatgtgagccaccatgcccggccccatacagccattctgtttttcactttcagtacaatgttcaataaattatgtgaggtatgcaacacctcattataaagttgactgtgtgctagatgatttgtccatccgttggctgatgaaaagtgttctgagcactctgaaggcaggtaaggctaagctatggcgtttggtagggtagttgtattaaatgcacttacaacataaaatattttcttttttttaatgtgttttaatttttttgagggaggggcccactgtgtcacctagactggagtgcggtggttccatcatagctcactgcagtcttcaccccaggggttcgaacaaacctcccacctcagcctccagagtagctgggactacaggcatttgccgctgtgcctgactagtttttaaaactttttgtagagacgggatctcactatgttgtccaggctggacttgaacatctcagctcaaacgatcctcctgccttggcctccccaaatcttgagattacaggcatcagccaccataccctgtcctgcgctaaattctttgactgacggcagcacttcctatgcactaggcatggattaacttagttgattgtccctcagccctatgacgggagtgtcgtgcctgatgtcattttacagatggtgtattagtcagggttctctagagggacagaactaatgcaatagaaatatatatagagagaggagtttattaagtattaactcatatgatcacaaggtcccacaacaggccgtctgcaggctgaggagcaaggagagccagtccaggttccaaaactgaagaacttggagtctgatgttccagcatccaccatgggagaaagatgtaggccagaagactaggccagtgtctcttttcacatttttctgcctgcttatattctagccacagcggcagctgattagatggtgcccacccaaattgagggtgggtccgccccttccagtccactgactcaaatgttaatctcctttggcaacaccctcacagacacacccaggatcaatactttgtatccttcaatccaatcaagttgacattcagtattaaccgtcacagatatgggtaaactgaggcactgaggatttggacgggggcagccggcagcggaatctgagctgtcctgtagctctgtctgggaagactccagtgagcatcccgctctatcccaagccttgtcttctgaaaatcagaatcatccctcctccaagtgttacaggaaaggggtccggatccagacgccaagacggggttcttggatctcgctccataaagaattcagggctagtctgtaaactgaaaacaagtttattaggaaagtaaaggaataaaagaatggctattccgcagagcagctcttagagctactgcttgcccatttttatggttatttcttagtgatatgctaagcaaggcttggattattcatgcctcccctttttagaccatgcagagttcctgacattgccgtggtatttgtaattgtcatggtgctggtgggagggtaacactgaggacaaccagaggccactctcatcaccatctgggttttggtgggttctggccggcttctttactaccacctgttttatcagctaggtctttatgacctgtatcttgtgcagaccttcagtctcatcctgtgactcagaatgccttaatcatctgggaatgcagcccagtaggtttcagccttctattgcccagcccctattcaagatggagtcgctctggttccagtgcctctgacacaagtagcgccccttagggaggttacaggagggactggaaggaaagtgaggtctggatcagggcccttctgtgtaaataagatgatgtacatgcagcagctgggtatgtcctgggtaaaaattagttaaatgcacagacgaccctgtttcatccccagccatcaccagctggaaatggggcacattcccaagatcccaaaaacattctgcaaggctggtgcgatgattgctatgaagtacttaagaaaacagattattgttcaggatcaatagctaatgcatgtggggcttaatgcctctgtgacgggttgatgggtgcagcaaaccaccatggcacatgtttacctatgtaacaaacctgcacgtcctgcacacgtatcccggaacttaaaataaaataaagaagacagaatattgttaatggttaatatgctgtaaatcattatgatgattactaaattatcaatacaaaagaagataatagcaagacggccatattcctaatagaggttgacattttagcagccctacatttccactgtatttaattagtatttgccgtccaatccagaggggcatgaaggagcacgagacaaaatcaggtcttctaacagctgagaagaagctgagaaccagaagtggaaaccccaaagggcagtgtatgaaatgtcatttattgaggggaaaaaaaagaaaatgacagagttcgatagaagaaataagcactagtgtttacataatcagtagggtgactttagtttacaataatctattgtagacttcaaaatagaagagtcggaatggttctaatatgaaggaaagacaaatatttaaggtggatggatatcccaagtaggctgatttgatctttacaaattatataaatgtattaaattattacatgtaccctgaagctatgtacatctgttatgcatcaattaaaaataaattaaaagaaaaggatatatgtccaggatatacaccagctaagacagtctcttccaagtctattgtacattattcccttatcagatttgaaacctgagagttccctgacgccccctcacaggatgtgcaacaggggtgtgtttgatctgtttgaccgccacacactgaaacctcttatgggaggcagaacttgcagacgggcaggtgcagcagctagtgtgagtgtttttgagctctgggccccacggtagcatctagggatgggtgcctgcgacccccgaagccctagtgggcgttttacggtgctcttttagctctgccatccgcacgtggcttaagtgttagccagctcagtgccgtcttggtacccgggttcttgtccagcatccaggaagaatcaggtcacacgaaccagctgaaggatggtaaatgcagaagagtttgttgccagatggagatgactcttagcgggatggttggggagttggaaaggggatggagtgggcagatgatcttcccctggagtttggttgtcctgcggctaatctcttctccaaccatccccagctgaacacctctcagtgttcagatgttccttctcttctctccttctctgctgtgctgctctttggttcctcaccttttctgctcatctgtctgtctgcacatggggtctggggtttggggttatatgggtacaggacaggcaggcatggtgggtcaaaaggcaacatttgggcacaaaaataggaatgcctgtttccatttaggactacaggtttccaggcttgagggcggggcctttgctggggaactgccctcttgtatctagtatcttcaggcctcctgtccgtatcaacatgacttaaaatgtgtgtgcatttgtatagagctgtgtttctatgtaaagactaaaaaagacttatgaaaaagatcactcagagctctgaacagtagcaaatcatatttctgagtacttcctgttgagtaaaggtaagtgaggattgtgccaagtatttttcattacttgctgcattaggttgtcacaggctgtttagtttacttctaaaaattgggatatggggaagttgtgggccgggcacagtggctcatgtttgtaatcccagcagtttgggaggccgagttgggcagatcacttgaggtcaggagtttgagaccagcctggccaacatggcagaacgctgtttctactaaaaatacaaaaattagccaggcatggtggggggtgtctgtaatcccagctattcaggaggctgagacaggagaatcgcttgaacccaggaggcggaggttgcaatcagctgagatcataccactgcactccagcctgggtgacagagtaagactccatctcaaaaaaaaaaaaaaaaaaaaaaaaaggaaaaaaaagttatgatgatcgcctaaggtgagaagccataccacgccagcgtacagaaccccaaaccacgccagcctcatcctacgtctcagttatatttttcttgacttgcttccattctggtgccccctctctccctgccccctccttccctgcaaaggatctagcaaatttgtaggtgtggaaagggaaccacaaatgggtcatttccctgccattgtcacctggagcgtgtagccatttcgtgcagtgattctctgtctttgatgtgcaggtcatcaccttgaagggaggaggtattaaaagcgccacccagtccccacccactgaggtctttattcagcaggtgtgggtcaggcatttgggagctgggagacctgcattttaagaagcaccccaggtgatgcccaagcggagctatgtgcttcttttaagagatgatgactccgtgtgcaaccgtgtggttacctttgcgtggagtctcatggatcactgccacagtggggaggcagctctgtgctctccaattcggtgatgtgtcattcactctatgcaggcccaaggtgacacccccagatacaggtgctgccatccagccattctcaaccagggatcatgtttatccacagggacacttgtcgatatcttgaggctttgcgttgccacactgatagcagggatgctgctggcatctagtgggtggagcccagggatgctggtcaacaccctgcagtgcacaggacgccccacagaaaagaatgatccaacctcatatgtcagtaggactgaggctgaggaatcttgccttagcatgagagatcctgtctgtctgtctgcctatctctagatctatctatcgtctaccattatccatccacctatctgtctctattatatacacctatcatctacctaatctatctgtcaatgattttctgtcatctattatctatctatttatctatctttctacctacttctctatccaactctcatctctattacctatctatgtatctatgtatctatctatgtatctatctatccatccgtctatcaatctatctatttatctagcagtccatcatctatctgtgacattcttctgctacccagggataattgtgttcctcgagtaacacttggcaatgtctggaaacaattttggtagttgcactgggatgggtgttctcgcattcggtgggtggagacaaggcatgttgttcaacaccttacagtgcacaggacagcacccatgacagagagttacgcagccccaagtgtcattagtgctgtagtggagaacctgctgttagttataacttctaaccctgcgaaaggggacaggttggaaatgtcatgctcctgtacgctgtaggaggtatagttgtctggaggtatagttgtctggaggtatagttgtcctgtacagtataggaggtacggtatagttgtctgggcatttctaaatggatcttactgtcagaatgcacttgtaggatcttttccccatagggcatagagccatggcacatataacccagaagctgagcattccatagtttccttcttggagtaggaaggggctgtgcagaaaaagtctatggctgtttggcacctgagtgtgaagacatctggcaaatattggagccaattagcagacaagcacggagtccaagaaatgtctcccctttcttggataacaactgacccttcctgtgagggcccccctcattccagccattttcctctttctcattggcacacagggggtagaaaagtggggttctgcctgcaggtggggctctgccagacacggcaaagctcctggggattcccccgatggatcaggggccagaggcacctaaacctgtgagcgatgtgtgcagccacggtgctgaggctgggaaactctgctgtagtctgtgaatcccaacctctgggaatgcttcagaatcagattctgggctgatctggaatctgcatgtggctggattctggtctgatccaggcatggaggcgtgtgcctgtaatcccagctactcgggaggctgaggtgagagaactgcttgaacctgggaggcagaggttgcagtgagctgagattgtgccattgcactgcagtgagctgagattgcaccactgcactccagcctgggcaacagagcgagactctgtctcagaaaaaaaaaattaaggaagagtattattgagagcgtaggccaggcgcgtgatgttgctgagatgaaactgtctctctagattcccaaaccctggttatctccactgaaccaggctgtccaatggcatccccattgtaattgaccatgttccatggtttaaatctgttgtgagccaaattgtaccctcctcaattttacaaatggaagtcctaacctgcaggacctccaattgtgactgtgtttggagatggggtctttaaagaggtgattcaggctgggtgcggtggctcatgcctgtaatcccagcactttgggaggctgaggctggcagatcatgaggtcaggagatggagatcatcctggctaacacggtgaaaccccatctctactaaaaatacaaaaaaaaaaaaaaaattagctgggcgtgcctgtagtcccagctacttgggaggctgaggcaggagaatcgcttgaacctgggaggtggaggttgcagtgagccgagatcgcactactgcactccagcctgggcgacagagcgaggctctgtctcaaaaaaaaaaaaaaaaaaaaaagaggtgattcaggcaaaatgaggtcactaggttgggccctgatccaacaggactgcagaccttataaaaagacgagatgaagacacagacatgcacacagggacgatcctgtgaggacttagggaaaagatggcatccacaagccaaggagagaggtctcagtaggaaccagccctgcccacaccttgatctcagacttccagcttccaggcctgtgggagaatcaatgtccactgtttaaacagcctggtctgtgggactttgctatggcagcagccacagtggacaaacacatttgtattccaatgaatgagttacctctgtaagggttgaattgtgcgtctccaaaatttatatattgaaggcctaatccctaggacctcagaacatgactgtgtttggtgatggggtctttaaagaggtgagaagggtacaatgagctcaggaggttgtgccctgatccaataggactggggtccttataaaaagagtagataaggacacagacacacacagagggatgaccctgtaaagacacagggagaagagggtgtctacaagtcaagaagagaggcctcaggaggaaccagctctgcccatgccttgatctcagaattccagcctccaggactgtgggagaataaaagtctgtggtttgtaagccacccagcctatggtattctgtgatagcagcctgcaatggactaagacatctcataagaagagcagatgaggacacagacatgcacatagagggatgaccacgtggggacacagggagaagatggtgtctacaagcccaggacagaggcctcaggaggaaacagccttgcccatatcctgatctcaagacgtccagcctccagggctgtgggagaatcaatgtctgttgcttataagccacccagtctatggtatgctgtgacagcagcctgaaatggactaagacacctcataagaagaggagatgaggacacagacgcacacagagggatgaccacgtggggactcagggagaagacggcatctacaagcccaggagagaggactcaggaggaaccggccctgcccacaccttgatctcagacttccagcttccaggactgtgggagaatcaaggttgttgtttaagctgcccagtctttgggattgcattgtaacaactctgggaagccattaccaagtctctgtcctgcaaagtgagatccatggatctgcagccttgacatcccctgggagctgatgagaaacactgtgtcttgggcccagacagacctgctgaagcatagtctgtgtgtcacccatgtcctgagggatccgtgtgcatgccactctgggaagacgggtttataacacaccgtcaaccagtgcctcattgcatggtctgcggtattttcctcgagttttccttgcaccaaagatgtcttgctttttgtgatgaatgatcattccttcctcttcgacgacaaaatacttcgatctctgcagacaccgtctgttgtgttacagacagacactgaggcctgaattctcattaccaatgtctgctctaatagagcttcaatctgcaactgcataatatggtcactgggaagtcaagaacggggccagttggttgaccttctggggagaggctgggctgcttggatgctgagaccgtggagggttcatgggttccgaggagcagatcatgcaccagggcggcctgctcagctctggtgtctgcagccccggtgagcttgagcattagggagtccctggatattcatgttgaggtgtggaggaggagactccagctgtgtttgatttcctgtcctgctggaaatataaacttcttaaccaattagagaacagaatggatttcatcttatccatggggctaaagtagaattcagcccttggcaaacaagccccccgggaataagattccccattggggcagcagccttccttgtcactttctgttgcaacctacggtcctaacctagtcatatgatttaattttttttactctgtgaatcatgccgtcctgggagagagtgagatggagcaaggacaaccctcttaggggcctgccaggcactctccctagcatggaaataaaggaaaaccttgagttccttcaagggaaattccaggcacctcgctggccttgagaagtacatggagcagcttgataagcaagaaggtgattgtagtgtagaacaatagccaaggaagttagagcctcaatatgtttagtttcctgtaaagactaaagataacatccttttttgagatggagtcttgctctgtcacccaggttgcagtgtagtggtgcaatcttggctcagtgcaacctccagcacctcctgggttcaagtgattctcatgcatcagcctcccaagtagctgggactacaggtgcacaccaccacgcccacatttttgtatttttagtagacacagggcttccccatgttggccagtctggtctggaactcctgacctcaggtaatctgcctgccctggcctcccaaagtgctgggattgcgggtgtgagccaccatgcccagccaagataacatcttactatatggccctgagttgattttcaggaacccagacccccaccaaataaaaaatgccatctgctggctcatagacgttgggtaagagaaactgaggcctgaattctcattacaaatgtttgttctaaattccttccctggggcatgtggcggtgggaggggggtggaaggggggtgaggggacgtgctggaggaagtcacaccaatggccacaactaacattgatttctgctgaccccaaatgctcagacaaacttggcctccttaaccaatgacaaatcagagaaactttgaatccacattaagcccctgcttccaggtatcccgcctttttagatcaaagcaatgtatagcctgcatgtattatggctttgcctgtaacctctgcctccttgccattgaaaaccctcagctactggccacccaggaggttgggtcttgaggcatcaaggaggttgcttgatgccctctaaatagctcggaataaacgcctcacttcctcacgctgcaatcccaatggcggtgttcggctttactgcacagggccggtggacctaagttgagttagtgggaggtgttcgaaccagggcaactccaggttgagtaggggctgtgtaaaatgaggccgagagctgccgggctgcattcccggatggtcaaggcattctaaggcacaggatgagataggaggttgacacaagaaacaagtcataaagaccttgctgatgaaacagcttgccgtaaagaagtcggccaaattttaccaaatccaagatggcgatgagagtgacctcgggtggtcctcacttgtgtcttcccaccagcaccatgacagtttacaaatgccacggcaatgtcaggaagttaccctatatggtctaaaaagaggaggcatgaatgggccactccttgtttagcatatcctcaagaaagaaccatacaaatgggcaaccagtggccctcggggctgctccgtctatggaggagccattctttattcctctgcttttctaataaacttgctttcattttatggactcgccgcaaattctttcttgtgcaaggtccaagaaccctgtcctggggtctgattccagacctctttccggtcacaagttcagtcacaagaaccattatcatatgctttctatatatacacataggtattttttaattgctgaactggagtcaaagagaaaccttaggatttgcctgaaggaagtcaagatttgtccttctcggggtccctgtgccagctttgtaaaacctcggaactttcccctctgtgggcttcctcaagctgaggagggctctatgggcttagtacccactaagtggcttcatctgcagcagctgacccaagaaagttgatttaaatgaacccacacttcagaggaaaccagtacaatccgatgtaaagaaataaaaaataggccgggggcggtggctcatgcctgtaattacagcactttgggaggccgaggcgggtgaatcacttcatgccaggagttcaagaccatcctggccaacatggtgaaaccccgtcattactaaaaacacaaaaattacctgggcgtagtggcatgcacctgtagtcccagctactcaggagactgaggcactagaagcgctcgaaccagggaggcaggggttgtagtgagccgagagtgcgccattgcactgcagcctgggcaacatagtgagattctttatccaaaaaaaaaaaaaaaaaaaaaaaaggctaggcacggcggctcatgcctgtaatctccgcactttgggaggccaaggtgggtggatcacgaggtcaggagtttgagaccagcctggccaacatggtgaaaccccatctctactaaaaataaaaaaaattagttgggcatagtagggggcgcctgtaatcccagctactcaggaggctgaggcaggcgggagaatcaattgaacctggggggcagaggttgcagtgaacagagattgcgccattgcactgcagcctgggcaacatagtgaggttctgtatgagagaaagagagaaagagggagggagggaaggaaggaaggaaggaaggaaggaaggaaggaaggaaacaattgcttgaaagggctttgtttcaccagggcacgcagatcaaaggacattggattgaataatgaaacagaagagcctgtctgaatttactaatgtggttgcacgtcccgtaatgattgcagttggctctaattcagttccgtggtgtataaattctgctggcaatagctgtaattggggtcagggatttagatagtctctgtgtgttccttttcattttctgctcagagcctgctgggagctgattttcttctttaaagcgaggtaaataattcagtggggagcagaggttttgctgtgggtccattgctctcctgtgctgcgtggcagctgtgctggtggcagctaatattcagtgggcagtggcctcgacattgcattattattcgagcaatggtactgttctttgctttgcaaaattgctgtttgttatattgactttctggggtcgtggcccctgaagcattactgaaaatcatggacatgaagcagatttattaactggagaaaagacatacaaatgtatttaatgtgtatacacgggagcattcagaatgaagaccccaagttacaaggggagattgtctatatttatgctttggttcatccaagtctggacagctgtgtagaaatagggttggacaaaaagggcctgatccaatgctaatggcctgagtggggaaacccagccaggcctgtgtgtctagattcttcttggcctctctctctctctttttttttgagacggagtctcactctgttgccaggctggagtgcagtggcacagtcttggctcactgcaatctccacctcccaggttcaagcaattctcctgcctcagcctcctgagtagctgggattacaggcacgcaccaccacgctcagctaagttttgtatttttagtagagacggggtttcaccatgttggccaggatggtctcgatctcttgaccttgtgatctgccctcctcggcctcccaaagtgctgggattacaggcgtgagccaccgcacccggcctcttcttggcctctctgaacagtgctccttccttccgggtatggggctgggagcttctctgggatggggggtcttaggacgcccaaacaaggcaggtcagggaatttccttatggccacttttttttttttttttttttttttcaagacagattcttgctctgtcacccaggctggagtgtactggtgtgaactcggctcactgcaagctccgcctcccgggttcacgccattctcctgcctcagcctcccgagtagctgggactacaggcgcccgccaccacacccggctaatttttttgtatttttactagagacggggtttcaccgtgttagccaggatggtctcgatctcctgacctcgtgatccgcctgcctcggcctcccaaagtgctgggattacaggtgtgagccaccgcgcccagcctgtgccactctttatacagataggatagagggaaagttagattcctgtttttaggttttatggctggcttcggggggaaaggcgttcttgtttctgggacccgtcttggggaagagggattctagttccttcggtgccttaggggagaatgggactcagagacatgggggctggagaagttccgagagaaacttctgcttctgaggctgctgctgaggcctgcacttggcggtattgtttcgtaagcctgaaccacgtgcaggtctgaatcaacataaagaatttgggtgggaggcaggggaactccaataagaagcatctttgaatccggcaggggtggaatttgggtcccagaggggtttggtgactgcaggctacagaagaatgcttcaaagtgctgtatcacatggctttgctccgaagggtcccgagcacagctttaccgggggctcatgtgtaacgctcggcccacccatccaccaacaggagccacttaatcgacatctccaggatgccagcaaccgaggaccgttgtcatagtcccagcacaaaatgaggctgctttcttcttgggggtttagggatcccagaccacaaggatttgattaaaagccgctcagttcactaactataagcaaagcaaatcagaaatagatctcctgttcctgccccgtcttatgttcccagtggaaaataaaccccgtgaaagcaatggcgtcatgtgcaacccgaccttggagacagagaccccagagttagcgttgtctacctgggacatctcccagcccaggggtcttactccagacccgtgaggaccccaggcgtggctttgctgcaacttccctggagaggagagaggacagggggccctgcctgggagatagatttgctgcctggcatgcgggactggagactgtctcagtgcccaggccgtctgatgctggccggagtccgcctggtttatgtaacgaggtctggatgtgaccaacaacggcctcgtgtgtgtgagtcacgcgtgcagcaacttctggctgtagtgcaacccctgaaaccaagcaaagcctaaagcccccaggctccacttcctctgtgaccctccccacccccaattcctgtcatctctcagggtcatccggagcatctcaaagctgaaggagcctccgctgcaacctggcctcctgctgcaggatgagacgagctgtctgcagccctcccgtgccacctgcctgttttatgcaacagcatttcagagaggagggactgggaggggagagacaacaccgaggcctttggttatttagggcaacagcagggagtggccgggtgcacagattggaggagattaagtggttgctgaggggatgcctgggattgctgggatgggcggagacataacacagtgaaagatattggtcaacggcgaacacagattggaatgtaaattctcagggtgtgtgcatagccgggacgcttaactttggcgtcctggacaggtgtctcgactggaactgctggcagccttggaggggagatgttgcacagatccaagaggctgacacggttcctgtcccccagcccagtctgagcagcttggaccatgatgatcaagagcgctggaggaggccaggtgcggtggctcacgcctgtaatcccagcactttgggaggccaaggcaggtgggtcacttgaggtcaggagttcgagaccagcctggccaacatggtgaaaccctgtctctactgaaaatacaaaagttagctgggcgtgatggcatgcacctgtaatcccagttactcagacggctgaggcacaagaatcgtttgaacccaggaggtgggagttgcagtgggctgagattgtgccactgcactccagcctaggcgacagagagagacgccatctaaaaacaaaacaaacaaaaagaaaacaacaataaagaaaaaataagaagagagctggatggagcaaagatttgctgggttgttcttaaaggcgagcctgtagtgatcgctggtaacagagaacgtcatctgagagggacgtgggggctcccagagtttgagagaaacggccgtgtgggatttgacctgtgatggcaccgccagctcccagcctccagtctgggcccaggggcagctgctgtgtgcaccctgggctcagagttccccttccctccaaggtttgtgactttgtcctgacttagggattcctgtctggggatgcgtcttctgctccggagaggccctaattgcctccacaaggagcggcaaagcctgcccgggtggcatctgactggagccatgccacagcctatacgaatctatgttggagcccttgaaccttcccccagagcaagcgtcaccgaggcagaccgatttttgggagggagacagacatcagagcgggggagacccagtacctagggctcacctggttcccccaggcttagcctcctccagggcttagtgtttgagtgagagattgtcccccctggacaattctgtagattctgactctgctcctgccttgccctgaacttcccagaacctcagtttcttcctttgggaaatatgcatgctggtcataccaacatccttgggtgggcagatgagactcttgggtgcctggcattactgcaacagaactcaatgcatagtaagtgctgactcaatgtgctcctggctgcatcctctacttcctgataaattctctggtggtgttttctctacaaggctagtactggcaggggcaagtgaggaacaagatcaaggtgtgcatatatgtcagcaagagggacccttcaccctcacaaattctgcagtgtgtttttaatgatgtgtcccaaagatgtgaatgttctcttctctctgctgcagacacattcattagattaactgcttttggatcaggtaggaacctcagcttgtccacacaggttgcttcctgaccctgtatttgtcagtgtaggctagctgctataacaaacagcccccaaagaattaaaagtttatctcttgtttgtgttgcagccaggtgaggtggcaaaggtgtcctatgctccatatagtctctcaggcatccaggaccctcacattgttgtgcttcaccttcttctagggcagcccctctcaacctagactctgtgcgtgtgtggaggggtggggggggcgttggggggcggggatatgcctgtcctaagctgtgagtgggacagtccaggagagaagtctatgtgcttggagagaggcttccttcaaagtttcctggccatgagcaggaatgaagctctgacacaggttgcaacgtgaacgcaactcaagagcatcatgctcaatgaaagaagccaggcacaaaataccacatattgtagaattctatttataagaaatttgcagaacagacaattcatggagacagaaagtggatagtggttgtcaggggctggggaggcgggaggggaactaactgctgaatggggacaggggtcttcttttgggtgatgagtatgctctgggactaggtggaggtggtggttgcatctcccatgtagctcatggtcaggttagttttagtgctctgggcgaccctaggcttgcaggaggaggggagcagcatgaggtgaggaacaagggggattctggcctttccatcatggggtgacttatgccctgtttgctcccaataggtcaaagagactttgatttggcagatgcccttgatgaccctggtaagtgccgatatttcaaggggagccttcccttttcagcttggatctaacagcatcagctgtatagttactttggggttggattgggccagtgttgggaatttcttggtcttgagatctctgttctttgcaggagattgcagacaccttgagacaaacctttacacactctctaaaagtctcagactcatttcttggtaggtctgtgcttctaaacctgtggtttaggaatatgctagtattttattattttattttactttattttgttgagatgggagtctcgttctgatgcccagactggagtgcagtggtgcaatcatagcttaccacatagcctcgacttcctggctcaagtgatcctcccacctcagcctcccaagtagctggaacaacaggtgtgtgcccccatgccaagctaatttttttcttttttcttttttgtagaaacggattctcactatgttgcccaggctggtcttgaacccctgggctcaagaaatccttctaccttggtttctcaaaacactgggattacagacgtgcctcaacatgcctggcccagtttctgcttttcttacacttcagttcatatccctcattgtcccacaccccgatcccaatccatggcctccaatctccccagtttctgcttttcttacacttcagttcatatccctcattgtcccataccccgatcccaatccatggcctccaatctcccctcccagagcacacttcattccgttctcccctcaacttctctggttaccttcactgacggggctgtgagtttttcttctccagggcactgaggacctggaatcttcccattctgtgttttcatcagtccaagttcagctagaacctttctggctgaccagaatgctgaaaatatgtgtcctgggccctgcagaaagtcctgcttgaggcagatagtctgattgagattcaggtgtattcagaccgcggtgggtgggagaaagggaaagatttggtttctgatgcaggcacaatggaaccaaacatttattttgaaagaaaaataaacttttgtgtacacagaggaagaatccattgggctttagcattgggaacaactggttgaccagtgcagttacataatggtgtttgttggaggaagagagaatgataaccagatctgatcctaaaaagccaacaacaagatgataggaactcatctctctcccagttttctgcacacagtgatgtttttgctaataattatcctaaaaggcagatacaaaattgttgtcagtgcaacaggaaaatgtaatgactcaccccaacatggagatgccatttctcccatgaagttagaaaaggtgaaggttgaatcctaccctgtcaaggcagattgaggggtgggggttagaggcaggtgtgtggttgcaaccactttggaagcattgggggattatctccaaaattcagactgagtgtgttgcaccagcgtttggtctggataaagaatgaggcatatctgcaagagaaccctgtgcaatagtgaaggaggggctggctggtaggctcagatacagaacaagacatgttattgatctgaaagatcactgacatgtgacccaggagttccacttctagacagatacccaagagaattgggagcagggactcaaacagttatttgtgtacccatgtttgcagcagcaatattcacaataagccaaaggtggaaacaacccaactgtccatcaggggatgaatgaatgaacagaatgtggtccctccaggcaacagaatatgatttggctgtaaaaaggaagggggttctgatgcgtgctacatgagccttgaaactgtgctcagtgaaacaagccaggcacaaaaggccacagggtgtaggatcccattaatatgaaatgtccagaataggcaaattcagagagacagaaagtggattagcgattgttgggctggaagaggggacaaaagggagggactgctcgtggctatggggtctccttttggggggatgaaactgttctggaactagatacaggtggtgattgtacaatattgtgaatatatgaaacaccattgaattgcacactttaaaatgtcaaattttatatgtgagtttcacattaattttttaaaaatcacataaataaacttattttccactcacctgctactaccttttcattgctcacctagaaggctgccagtgcctgcaaacacatctttgaatgcatcgttttgctaccaagagccccccatgaatgggcaggcatgtgcctgttcatccacagcccttcctcatgggaaggaagccccagtgcagaggaaccacagtcacctgcatggcgactgtggggaattcacttttcactgtctatactgcctgggctttaagaaactctgtgagtgtatcactattttaaaaaatagttataattttacattttaaaaaggagacagagaaaggaaggatgggagagagggagggagggtgggaggaggaaggaagggaaaaggaagagaagaaagaaaagaaggaaacaatgaaaggacagaggaaaacagggagggagggaggaaaaaggatggaaacaaggagggaagaaaaggaagaagagagggaacgatggagggaaggaaggaagaagaaaggagaggagataagaaaagactgaggggaggaaggaagaaggagaggaatgaaggaggaagggaagaaaggaggggggaaggaaagaaagaaaaataggagaagaaaggaagaaagaaaaagaataagggaaggacggagggaaggaaggagagagggagaggagaaaggttggaggggaggaaggaagaaaggagggtggggaggaaggaaagaagaagggggaaaaggagagagggaaggaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagcgaaggaaggaaggagagaaggaaggaaggagagaaggaaggaaggagagaaggaaggaaggagagaaggaaggaaggagagaaggaaggaaggagagaaggaaggaaggagcgaaggaaggaaggagcgaaggaaggaaggagagaaggaaggaaggagagaaggaaggaaggagagaaggaaggaaggagagaaggaaggaaggaagaagggagggcaggaagggagagggaggtggcaggaaggagaaaaggtgatgagaaaccttctattaaaatacaggacatgcgaaaccatatgccccgtttggaggttcaagctctccttcttgcagtctctgcatccccagtgaatgtccgcaccacacacaaacccgtgttccagccgcctcctaccaaggcaatgctaggctgttatgtaaaccatgctttcaaatacggtgtttcctctgtttggaagaagtctggccattgcacagccctgaagctccaattttcccagccatggccgactccacctcctttgagccatcttcctcaaacctcctcctgccctcgtctgcccatccacactgcacacccaggttcactaagcagggcagtcacaggctgcaccctgagcactcctgacctgatatccacatccatgcaatacatatttgctgaatgaataaatgaatgaatgaaagaaagtgagataagccatcattctggaagctgcaagtctttctccttcttttcttttgcctccccctgcctcaccctccaccgtccagccctgtggtggctctacgggcaggtggctcacttacttgtcttggatgttctcagctactttggccatcctgtgggcatcctcacagcctcaagggtggattgtttttgaatggattttaagggtgttttcttgtcttttttctcaattcaacatggaatttgtgtctatatcatttactttgtatggctttgtcactcccttttcacctttcatcagggcgttcatggcctttcttcatgcttccaatgaatcttcaatgcatattgcatttattttctctctttgttcacagaacccaccaagaagccaaactcaggtgagtgtctcttcagctgggaaaaactgaggcaacgtccttgaactgatgcttacggaggggatggttgaggatgttttacagaactgtggggtatatgaaagagatgcaacaactgtaccagatagcagatattgaaagcaaaatgtggtgattagggaaatgcaaatcacaaccacagtgaagcaccacttcgtccccactgagatggctaaaatctaaaatggaaaataacaagtgttggcaaggatgtgatgaaactggaatgtttgtacagtgctggtgggagtctaaaatggtacagccactgtgaacaaatgctttggtggatcctccaaaagttaaatacaggattactctatgaaccagcaattccactcctaggtatgtactcaaaataattgaaaacacgggttccaagaaaaatgtgtacacaaatgttcagagcagcactattcattatagctaaaagatagaaataactcacatgttaatcagtggaaggaatggataaacaaaatgtggtccattcacacaatggaatattatttagccttgaagaggaatgaagcactgaaaattgctacaaagtggttgagcctcaaaaacattttgcaaagagaaagaagccagacacaaatgatcacataatgtatatttttatgaagatgaaatttcaagaataggtgaatccctagaaccagaagcaatgtcgtgactgccaggggctggaggggaaagagagagtgactgcttgataaattccaggtttctttttgggggaacgaaagcattctggaagtacacagaggtgatggctgcacaacactgtgaatattctaagtgcccctgaattattcacttttaaatggttaattatatgtaaatttgacttcaatttatttatttattttcaattaaaaaggtaacctttggctgggggcggtggctcacacctgtaatcccagcgctttgaaaggccgaggtgggcagatcatctgaggtcaggggttcgagaccaacctggccaacatggtgaaacctggtctctactaaatataaaaaaattagctgggcatgatggcacatgtctgtaatcccagctactcgggaggctgaggcaagagaatcacttgaacccgggaggtggaggttgcagtgagccgagatcatgccactgcactccaacctgggtgacagagtgagattccgtctcaaaaaaaaaaaaaaaaagaaaagaaaagaaaagaaaaagaaataattcccggggccgggcgcagtggctcacgcctgtaatcccagcactttgggaggccaaggcgggtggatcacaaggtcaggagatcgagaccatcctggctaacacggtatgttgtacctgagcgagttagaaaaacgctttgagacaaattaagagtcctttataagccagcgaccgagagacggctaatgcttaatagtctctcggtcctgaggaaggggcttgattaacttttagatcttggtttaggaaggggagggctgggggtctagtgaaaaccattttacagaagtaaagtaggcaaaaagttaaaaggataaatggttgcaggaaagtaaacagttccaggtgcaggggctttaagactattacaaggtgatagacgcggggctttgggcgttactaatcagacgaattcccgggaactgcggatgtagctcgccacagtatcttatcagttaactgcattcttggatgtgctgggagtcagcctgcacgagttcagtccttgaggaaggggctgccagtgaaagagccaaggtggagtctggctggctctcttagctaagggagagtccattcaggtggaaagaaggctaggtgagtaaaggaaaagggagagtctaaaaacaggttagtaaaaaccaggttgggcattacaggtgaaaccccgtctctactaaaaaatacaaaaaaaatttgccaggcatggtggcgggcgcctgtagtctcagctacttgggaggctgaggcaggagaatggcgtgaacccgggaggcggagcttgcagtgagccgagatctcccactgcactccagcctgggcgacagagcgagactccgtctcaacaacaacaacaacaaaaagaaataactcccagacttccagcagactccttgactgccatgagagatgtcaggaagtcaatggacgggtgtttataggttgttcaggaaatgttcactatcaagcaagaattgaaaatgcagctaaattgctgttggagagtgatgatagcataaagatttccaacaagaagctctgcaaattttgctgaaaaatcttccaaatgatgctctgccataagaagaaattcacaccctgaatagcacagcaggatgcgaatagcaatgccagccaaagacattgcaaacaagccggtaaaactaagtgattgttagctgtttaaaaaaataataataactggtgttaacaacaaagtgaaacttaacttctgaagatgaggctaccttcacagagaggataagaaaggaagaactgagtaaaagtagttagatattgctggattttgacattttaaggttaagtgttcctgctaaaaataaaaattgaacatataactcctgaactagtggatgaaaatgaagaatgaagaataaaattaaatacaaaaaaaatgaagagtaaaattaaataccaaaattagccaagtgttgtggtgaatgcctgtagtcccagctactcaggaggctgaggtgggaggatcacttgagccccagaggtggaggttgcagtgagctgagattgcgccactgcacttccgcctgggtggcagagccaggctttgtctcaaaaataaaaaaaaataataaattaaaaacctgaatactaaatggaagttaagaaggaaggaattaaaaaagaagaaaagtaaaataaaatagtaggaatagtgaatccttagttatgttagatgttcagtgatttaataaatctgtaaaaagacggagatgagatgatgcaatttaaaatgtttcggctgggcgcagtggctcacgcctgtaatcccagcactgtaggaagccgaggcgggtggatcacgaggtcaggagatcgagaccatcctggctaacacggtgaaaccccatctctactaaaaatacaaataaaatgtttcatgctatttacgagagaagcatttgcaacaaaatgccaaagagaaggtgaaaatagctggaaaaaaaatgcgcaaagcaaataaccaatagaaagaaagccaagttgggctagcaaaatcagacaaaataaccttcgaggtgcaaacaactttgaggcccaaatagaggttcttcccactaaaagaatgattccctgaatgataatggaatcttgacccagcctgcacctcaggttaagttaaaagtggaaatttaaagatctaagtgtgagattttaaaaagcatttccccagaaataccaggatctgtagatggaaatgttattaagaataaagatgtggagctgggcgtggtggctcacgcctgtaatcccagaactttgggaggctgagactggctgatttcttgagcccaggagtttgagactagcctggacaacatagtgagaccccatctttacaaaaaaattaaaaaaaattagtggacatggtggcatgcacctctagtcccagttactcaggaggctgaggtgggaggatcacctgtgcccaggctgaggctgcagtgagccatgatcacgccactgcactccagcctgcgtgacagagcaagaccctgtctcaaaagaaaagaaaaaaaaagaagaaagaaatgaaaaccgtagctcagagacagagaaactgagcaatgcataggttcagaagggtttgaaacagactgaattgtgtcttggcatatgagagaggtcgcagctataaaacaatgagagaagaaaccaaattccacataggcaggactgagacaattggctgttcttgtggatgatacgtgatcaaatctcaacctcatgcgatacttttttttttttttttgagatggagtctcgctctgtcacccaggctgcagtgcagtggtgtgatctcacctccccgcaaacttctcctcccgggttcaagtaattctcgtgcctcagctgggactacaggcatgtgccaccacgcctggctaatttttgcatttttttagtagagacggggtttcaccaagttggccaggctggtctcgaactcctgacctcaggtgatctgtccacctcggtgtcccaaagtgctgggattacaggtgtgaaccaccacacccagcctcatgtaatacttaaaaatgaactacaggtggattacaaacctgaatataaaagaaaacttttttttttgaaaaatagagggaaatgtcttataacctcagagttaggaggtttttcttagatacaatacaaaaagcataaccacgcccatagtcccagctactcaggaggctgaggcataagaatcacttgagctcgagaggtggaggttgcagtgagccgagatcctgccattgcactccagctgaggctacagagtgagagtataaaaaaaaaaaaaaaaaagcataacctttaaaaatgggttagcctatgtctacatttaaataataataataataataatgttccaacttcaggctctgaaaaaagtcaaaagatgagctgtcaactagaagaggctccttactgctcataccaccagggaaagtttaatatgcaaaatgcagtcatccttcagaattcatgggggattagttttaagacgccttcttccccgcagacaccaaaatccacagctgctgaagtctctgatataaaacgtgcagtacttgcatataatgcaagtatatgttcctgtatatttttatttatttatttggagacagaatctcactctgttgcccaggctggagtgcagtggcgtgatcttggctcactgtaacctccacctcccgggttcaagagattctcctgactcaacctcccaagtagctgggattacaggtatgcgccaccacccccagctaatttttgtatttttggtagagacgggttttaaccatgttgtccaggctggtttcgaactcctgacctcacataatctgcccaccttggcctcccaaagtgctgggattacagggatgagccaccgtgtccagcctctggtatactttaaattatctctaggttactcataactcctgatacgctgtaaatgctatgcaaatagttgttatactatattattttttatttgtattactttttattggattgctatattttattttttgaaatattttcaatacaagactggttggatctatagatgcagaaattctggttatagagcacaaactgtgtatagatagctcctaccaaaacagacggatggtgaaaaaaagaaaagaaaagaaaagaaaaagaaaatggaggagagagactatgaggcgactaaaagaagagggatatgatcattccattcgctgacaagaaaaattcaaagaagagggaattatgcaattgaccagctgatgtgtgttagaaatgctcagggtcacacatattcattgaaagccaatttaagccactatttaaatttaaaccgatttaaacaattgggcttttttttttttttctaaaaaaaaaaaaaagtcaattaggccaggcgaggtggctcacacctgtcatcccggcactttgggaggccgaggtgggtggatcacaaggtcaggagtttgagaccagcctggccaacatggtgaaaccctgtttctactaaaaatacaaaagttagctgggcatggtggtgtgtgcctgaggctgtgagactgaggcaggagaatcacttgaacccaggaggcggaggttgcagggagcggagatcatgccactgcactccagcttgggcgacagaccaagactctgtctcaaaaaaaaaaaagaagaagtatattggttccgtctggaaaggtggagcacttgaagcaaaggcaggaagactggaagcagggagagggttttcaggtcacaaacaggtgagagacaaaacagttgccttcttttgagtttctgattagcctttccaaaggaggcgatcagatacgaatctgcctcagggagcagaggggggactttgaatagaatgggaggcaggttggccctaagcagttcccagctggacttttccctttagcttagtgacttgggggtcccgagatttatgttcccttcacagtgtatgagtgagagcacttggaaactgagagtggaagtgtcgcaggccaggtctcactaacacaggcccccacaacacctgtttcagtattgactgagtggttaaatattaaaagccagtgctgttatacaaaggctggaatgtaacaaaagcccaccgagagtttttcccaggactttcccgggccttaaagcatgacaaaataatgaatgaattcttaacaggacccatttaggattaaacaagttttactgggggtctgcagaaactccccaggcctccacaaacaagtttattggggctttgaaggaactctgcaaacctcctggatttagcaggagacaacatgagggtaatcaccccggcacctggacccattagattaagtcaatttactgaggctcctgaggaagatcctcaggactcagaccttagttatagattaaaagaagttaatcacttatgtctttagataaatgcacacacatatctccacatagcttggaaggtatataagctctggaaaactataattttgagttagtctggtgataatttccaggccttctccctgtaacaggttgcagaaataaaaactctcttcctccccagttcatcggtgtttcattattgggctgtgagaaatagcaacccagttgggtccgggaacagaaggtttggtgttatcttcatcacaggcactggactgtcggtaaatttattccatgacaattcttcctaggtttcttttttatattacttgcttccatcatggcagacagctacactggcttcttgccatgaaaacgaacttctagtaacaaaacggaaacctttttttttaagtttcaggtttcaaggttttacttctatctgcaaagtgatttttaaccagacaatggcaatctataaacacaccgtgggcagcaaatcagaacaaactgcaaggtcgatagtcacgctgatgagcttgtttctgcagcctgctcctaagggaaggacaattttcttttctaacagtgcaatgttgtttcctccacagatatctacccaaagccaaaaccaccttactacccacagcccgagaatcccgacagcggtggaagtaagaatccgcaggcctgaaactctttctcaatctggtttgatgatgtttgcctttttatttactagcaggtttagcctggttgcatttgaaatatgtgtgtaatagctcccttactgggaatgtagtttctttcctcactggggggagcaagaaagtccaacggacagaaacaatcttattttccctttgctttgacatctagaaaccactaaggtgtacttgtaaccacccaactggttcactttgttggctgcctagacagagctgatttatcaagataggggaactgcaatggagaaagagtaattcacgcagagccggctctaagggaggctagagttttattattaatcattcagtctctggaacatctggggatcagggttgttaaggataagttggcaggtaggggcttgggaagtggggagtgctgaccggtcaggttggaaagggaaccatagggggttgaagtgaggttttcttgctgttttctgttcctgggtggatggcggacctggttgagccagattaccgggctgagtggtgtcagctgatccatccagtgcagaggctgcaaaatatctcaagcaccgatcttaggttttacaatagtgatgttacccccaggagaaacttggggaggttcagactcttgcagccagaggctgcacgagccctaaagtgtaatttctaatcttgtagctaattttttggtcctgcaaaggcagactggttcccaggcaagaagggggtctttttgggaaaggggcattcttaattttgtttcagagtgaaaccacgaactgaattcgttcccaaggctagtttggctcacacccaggaaagaacaaggacagcttaaaggttagaagcaagatggagttggttaggtctgacctctttcactgtcatcatttcctcagtcataatttttgcaaaggccgtttgatactcaaaggacactttgcattatcatcacagaaagctaatcaggctgagagacaagtcctttctctcacttgttttcagtgctccaaatacctttggcttaaccattcccaaacccccacgtgtgctgtgcactttatgtgttttagagttggtttctccattttttctaacatttggcagacagtttttttccacagatttattacactcatcattgaaaaatatgcaattcaaaaaagaaagagagtgaacgagagagagaagagtggggaggggggtgggcatggagagagaaagagaaagagaaaagaaaggggaaagaagaaaggaaaagatagattctggccattaaagttatcagcagttcaacaaccttaaaaacttaaatgtttgccaggcagagcagcgtgaagctggctaaatcaagaggggttctggaagcttcctggtagtttgctctggctttaaactttcacagcttaacagcgtgtccattcattgcagacacgcacatccagatggacagaaattatctcctcttacaaggaatcattaaaaacagagaccaagacccaagggaggtgacacccacttgaaaaactacacctcaggccgggcgtgggggctcacgcctggaatcccagcactttgggaggccgaggcgggcagatcacctgaagtcaggagctcgagaccagcctggccaacatggcgaaaccctgtctctaccaaaaatacaaaaattagctgggcatggtggcatgcgcctataatcccagctacttgggaggctaagacacgagaattacttgaatccaggagaggaaggttacagtgagccaagattgtgccactgcactccagccggggaacagaatgagattctgtctcgaaaaaccaaaccaaaccaaaccaaaccaaacaaaacaaaaccccaaaacaccacctcacccttaactgcattagttaagccagctagtctttcttttttccccctctttcatgatgaaaatcccaaataccacccacctttttctcctgctatttcctcctagtcttttaaaaaccattgtcctgcggatcatggctatgttgcaaggcactcatgggaattccacagggaacgtgtttcttgctgaaacatacttgggaaacgcccagttaaacagactgccgtgggcttccctcccagagaattcatcaggacttaaaatgtgtggctgggcatggtgggtcacgtctgtaatcccagtactttggtagaccgaggctggtggatcacctgaggtcaggagttcaaggccagcctggccaacatggtgaaaccccatctctactaaaaatacaaaaattagtcgtggcctgtagtcccagcaactcgagaggctgaggcataagaatcgcttgaacctgggaggcagaggttgtagcaagctgagatggcgccactgcactccaggctgggcaacagagcgagactccgtctcaaaaaaaaaaaaaaaaagaataagaaaaaaaaaacttaaaatgcgagatcctttaagatgggccatcttcagagtgtgaacactcagcccctcccacagcaaagtgattcatgaaccccaataggaggaggagtgggggaagagaggctcaggctggggaggtgaccccccatgactcaagcctcaatctcctgatgcttgtcccaacaaagaggaggcttcctttccgactttggtttttcatgttgtgcttaaatccagccacactgatgcctttaacatggcagtcctgaattattaatcaatactgtgtgaatccaaaatatctgagacaggtctcaatcagtttacaaagtttattttgccaaggttaaggacgtgcccgtgacacagcctcaggaggtcctgatgacaagtgctcaaagttgtcaggacacagcttggttttacacattttagggagacaggagatatcaatcaatatgtataagaagtacattggtttgatctggaaatgcgggacaactggaagcaggggcttccaggtcacaggaagatacgagacaactagttgcattcttctaagtccttgatcggccttttactgaaaactcaatttacatgtgagacagggcaaaggaatagtacttatgcctcagtctggcccagtgaatctgcatttttcatcaacaatagggcagaggaagcaatcagacatgcatttgtctcaggggagcagaggggatgactttctgtcccacacctgtgaagatgagctgttggtgtacattgccagggtgaaattccacagaactgttttagggtaaacaaaacagtttactttcctcagattgtgaggacagtatgtagcttttaaaaaacttaaaaaaatttttttgtagctatcttatttagaaagaaaatgggaggcagatctgactaactttttttttccagcttgacttttcccttggcttaatgattttggggtcccaagatttattttcctttcacaattgaacatcagaacatggagtatttaacacaggaaatgagcaaatttaacgtacacacccaaggaaaaggaaaaatgaagctggttggaagttaattatggatagtgtggtatatgagcagaaattccccttaaccagtgttcttgcccaggctagcccaaatgagcccaggctagcctagattcccaagtgtgtatcttgagaacgaggaagagccctagaaaacaatgtgtaacgtccctccaagatggggtgttctggaacaatccctcagacaacgaaggcaattgttgatgggcaacattgggaagaccccagagatggaatgtcctaggcctttccatgttctctttctcattctccctccattgacttgataggtggctgggggatttataagtatttaccacacaccagccagctttctccggatggctccaggcatgcttggagcccagtggtctctttcccttagaatttgatctggaggaacccaaaattctctctgtgtcctttgaaattcagcacatttttcttggcttccatgagctcctgtggcatttctcaggccaactgttgactctgcttcctatgtctgtgcttgtccctttgagagatgtcagcgttgctcaccgattcttttctctgaccccagcagctcctatccatgttgtctttttttttttttttttcagacagagtctcactgtattgctcaggctggagtgcaatggcacgatggcatgatcttggctcactgcaacctccgcctcctgggttcaagcaattctcctgccttagcctcccgagtaactgggattacaggcgtgcaacaccacacctggctaatttttgtacttttagcagagacagggtttcaccatgttggccaggctggtctcaaactcctgacctcaggtgatctgcccaccttggcctcccaaaatgctgggattacaggtgtgagccactgtgcctgtcctcatgttgtcttgaaagtaacaagacaggcacggattctttttgatgcaagctgttatgggatgaattatgtctccccgcaaattcataggatgaagtcctaacccccagtttcctcagaatgtgactgtctttggagatggggcctttaagaaggagattaatgtaaaatgaggtcactagggtgggtccggatccaataggactagtatcctaataagaagagatgaggacttagacacacacagaggaaagattatatgaagacacagggagaagacggcatctacaagcccaggagagaggccttaggaggaaccagcccagaccatatcttgatctcacactcccagcctccaggactgtgggagaatcaatgtctgttgtttataagccacccagtctatggtgttctgtgacagcaacctgaaatggactaagacacctcataagaaggggagatgaggacgcagacacacacagagggacaatcctgtgaggacacagggagaagatggcatctgcaagcccaggagagaggcctcaggaggaatcagcccagcccacacctggatctcagacttccagcctccaggactgtgggagaatcaatgtctgttgtttataagccacccagtctttggtattctgtgatagcagcctgaaatggactaagacatctcataagaagaggagatgaggacacagacacacacagagggacgaccctgtgaggacacagggagaagatggtgtctacaagccaaggagagaggcctcaggagtaagcccaggaatcaatgcagttggaggttctgtgtgtgaatggaggagggaagctcacagatgaaggcgttttgagggaggactgaccttacagtgaggtacccagagacttcctgaaccaagccacgaatatgcagctcgtgctccgggcagtgccttctggcctggaaaccaaagctcccttgtgtccagtccccactcctctgtttggcccccaagtttccataatcccccacagttgtatcattttagagacctcaaaagagagtctaggctgggcgtggtggctcatgcctgtaatcccagccctttcagaggccgacgtgggtggatcacctgaagtcaggatttcaagaccagcctggccaacatggtgaaaccctgtctctactaaaaatacaaaaattagctgggcatggtggtgtatacctgtaatcccagctacttgggaggctggggccagagaatcgcttgaacccaggaggcggaggttgcagggagccgagattgtgccactgcactccagcctgggcaacaacagcaaaactccttctcaaaaaaaaaaaaaaaaaaagagagtctaggcagggcatggtggtccatgcctgtagtcctagctatactcaggaggctgaggtaggaggatcacttgagcccaggaggtggaggctgcagtgagctatgattcaccactgcactccagcctgggcaacagagcaacaccctgtctcaagagagagagaaagggaaagagagagagactattttgagaagtgaaaaaccagtcattctcagcccagatttccagtgttctgagacgtctgtcctgaggaaggactttgagaacagcatccttgccttttttgtgaattaaagtaatttcactcttgagccaatgtggataagcacttgacaggtactggcagtgccaggtaccaggaatatagaatgggtacagaaaataaagtttctagtccagcgacaaaaaggtgctgaagatacagactcatgtcgtgcaaagagcttgcactgattatttcatttcggcttcttgaatagggtcaaaggacatttaagctgagacaggagggacgagctaattaatgcttttccagatgacaaatggattcttcaaatatttagggagagtgtaaagtgatggacagggaacaggaggggtcatgacagaaggaatgccacctgcaaaagtcctggggcagggctgggcacggtggctcatgcgtgtaatcccaacactttgggaggccaaggtgggcagatcacctgaggtcagaagttcgagaccagcctgggcaacatagtgaaatcccatctctactaaaaatacaaaaattggccaggcgtggtggcacacacctgtaatctcagctactcgggaggctgaggcaggagaattgtttgaacccaggaggcagaggttgccgtgagctgagatcacaccactgcactccagcctgggcgacaaaagcgaaactccgtcttaaaaaaaaaagtcctagggcagaaagctcatggtaaacttgaggaacatgcaaaagtcattgcaaaaagttttaagaaattcaaatgaagccaggctcagtgtggctaatgcctatgatgattccagctctttgggaaggcaagacaggacgattgcttaagaacaggaatttgagaccaacctgggcaacatagcaagaccttgtctctacacaaattttaaaaattagccaactatggtggtatgcacctgtagactgagctacatgggtggctgaggtgggaggattgtttgagcctaggaactcgaggctgcggggagctatgattgcaccactgcactgcagcctgggcaacagagcaagactctgtctcaaaacaacaacaacacaaattcaaatgaaacggtgtaactcaagcaagatggaaatacaacacactatcaaaaggtcagatgtttcatcctaacatttatagaagtgactgacttctgtaaatggtgctggcatctgtagtagccctaaacagggaaaggtcaacaacgcactttctgccctgttaatttcagagagccctggacttcttgcgaaagcaccagtggtgtaagtttttgttttttcattgtaagctctgaggtggtattatgaatattgtctacatgattaataagctccgtaaaagcaatgggcagtaacatcttttctgtactttggcattcttatttatagatggtatctacctgaaagatgtcattatttttctgaaatcatactgttgttttccaacagatatctacccaaggccaaagccacgccctcaaccccagcctggcaattccggcaacagtggaggtaatgagtatttatttatttatttttattttattttattttattttattttactattttatttgattctatgttattttactttattttaccattttatttgattctatgttattttactttattttatttgattctatgttattttactattttattttattatttattttggagacagggtctcgctctgttgccctggccagagtgaagtgatgtaattgcagccttgaactcctgggctcaagcaatcttcctccctcagcctttcaagtagttaggactacagatgtgtaccacctacattgcaccacctatatttcaccacctatattggctatatttcaaattttttgcagagacaggatcttgctgtgttgttcaggctattcttgaactcccggcctcaagcaatcctctgcctcagcctcccaaaatgctgggattacaggcaccagctattgtggcccagcctgataatcagtattaaagtccattttagaagtgtttggggccaggcacagtggctcatgcctgtaatcccagcactttgggaagccgaggtgggcggatcacttgaggtcaggagtttgacaccagcctgagcaatatgatgaaaccctgtctctactaaaaatacaaaaattcgccgggcgtggtggtacatgcctgtaatccagctactcaggaggatgaagcaggagaatcgcttgaacccgcaaagcggaggctgctgtgagttgagatcacgccacagcactccagcctgggagacagagcgagcccctgtctcaaaaggaaaaaaaaaaaaaaaaagaagtgcttcacgcctgtaatcccagcactttgggaggccgaggtctcctcaggcagatcacctgaggtcaggagtttgaaaccagcggccaacatggtgaacccctgtttctactaaaaatacaaaattagctgggcagagtgacgcgtgcctgtaatcccagctactggggaggctgaggcaggagaatcgcttgaacccaggaggcggaggttgccttgagccaagattgtgccaatgcacaatctatctaggtgatagagtgagactctgtctcaaaaaaaggcgggggggtggttggatacaagtattatttaatgacttaaaaattctcatctccatggtgaaagaccaattgcttttgaaatgcacagacattgttttgcgaggagttcagttctactatccaccagcacctggggattacatttagttgatagtaaataaatttaaatgtttttgatgacattgactgaaaaataccatgcacactaagacatttcaagttatgatggaggaaggcaattttttcttgtttttttttttgttggtctgtgttctactcacttattcttccctctgcaagagttatctgcggccactttgcctgtgttcctacagcacttcccatctccgccttggcaattgtgtctcacgaacgtgagacactcaggaaagagatgctggtctgtaaagttggaagagtctcagcgattccattggtggggcaaatgtgtgcagattgaggaagctaagatacactgggtgtcttcctctctccacctgctttaaccattgggagttcccctgattgtgattgtttcaggacgttgcttggatgttgtcatattcctagggttcaaggcactccgtgaaatccaaggaaacaagctttgggtatgtcccagtgccttttcccttgggtcttgcaactgaagaattgtgtttcttccctagaaaaacgaacacacttttgcccactcacccacctcctgcaagtctccaaaaccacagcgttgtatcctagactatgttcccccaggaggtggttcctccctctgcattcccgtactccatactgcttgatatgttcttacatgcaacaccgtgcaattgtgtttagttgattcctgtgaattagaatgagaactctacatgggcatggatttttgcctttcattcactgctgcattccctagtctggaaagctgtgcctggcacacaatgagtcctaggtgaaggtcagtgaagtcattaatgcttgagtcccaacaggcaaacagctggattcatgaatgaaagacttaccgctacatcccttcatcagggtgtatagcttcaactccatttcctggaaagctctacaatagttcttcctcctcaaaaggctctggtcttgtgattcatagcattcgtccaccaagacatgaacaagggatctttatgtcagaggttccctgttcaaagctgttttagaggccaggcgtggtggctcattcaggtaatcccagcactttgggaggccgaagtgggaagaccacttgaggtcaggagttcgagaccagcctggccaacatggtgaaaccccatctccattaaaatacaaaaattagccaggcatggtggcatgtacctgtaatcacaactacttgagaggctgaggcaggagaatcacttgaacctgggaggcggagttcagttggagttgcagtgagccgagatcatgccattgcactccagcctgggtgacagaacgagactccatctcaaaaacagtaaaaataaaaaagctgttttaggaaacatcccttttttattattttttctttgagtcagggacttgcttggttgcctaggctgaaatgcagtggcgggatcacagctcactgcagcctccacctcctgggctcaagcaatcctccgactttagcctcctgaatagctgggactacagacacacagcactccacctggctaattttttcttttttctttttctttttctttctttttctttttctttgtgtgtgtgtgtgtgtgtgtgtgtatgtgtgtgtgttgggacagggtttccctctgttgcccaggctggtcacaaactcctggccttaagtgaccctcctgccttgacctctcaaagtgctgggattacagatgtgagccactgagcccagccctaggaaacagcctcttaagccaagtgcaatgactcttgaactccccagagcctctgtgcatgctacctcgacttcagcttcacagatgtatgcaactgcgggatcaggttaggggcactcacttaccggcagtcccaaagctctggagagtctgtgctgagggaatggtccatgttaaagcaaagcagaacaaccactctgccttttgtattttatacttgttttttttttgaaacagggtctctctgtgtcactcaggctggaatgcagtggtgtgatcatagctaactgcagcctccagttcctgggctcaagtgatcctcctggcagatgggactacaggcgcacaccaccaagcccagataattttttgtatttttttgtagagacagggggtctcactatgttgcccagactggtctccaactcctggcctcaagcaatcctcccgcctccacctcccaaagtgctgggttgcacccggcttgcatttcacacgtttaataaactcaatcagcatgtttcctaccccctagagtgacaatggtgcacattagcatggatttcttatagatcgagaccaaagacctaattacttatctatagaccaatcttggagaggaaaggcagactccaagggttaattcggggtccaggaaccacagaaggaaggtctccttggatctcgtttgagcctgaagtagctcagtctatgacagacaccatcagagggcagaggcacaggtgaacgcagcagtcggaactttgtcagagcagcaaaggacatcttaggaaatgaggcttgcaaagcagccttgggttattgagaaagctctctcagcgtggattctcagggctctgggatcttctctgccttgcaggtgcctctttgttttttgggaggaagcaggtgggtctcatgtgtcagggcagtaaggagcaggaatgaatggatgaaacaaatctgttggggtgggtagcggctgtgctctggggagccaagagagagacagggggatggtgctggtttcagacaagatagttgagcaggaacttgaaagagaaaaggagagtggatcgtggggacctgagaagctggaattctccctggggaatcggccactgccaacgtgagggctggggttaggagcatgcctatggtgatggagaagcctgggggaggtgcctggttgatggggcaagaggagccatctggagagaaggaaaagcctggagtctccttccgggcttgcttaaggactagggaggggcaggacatgagatgatgttggaggattctgagcaggggatgggcctaggtgggaggtggggcagaaggagagctggacgaggacatggtgagaggtgatgttggctcatccaggaaggacggccaggaggaagcagagggaaaggggcatgcaaaggtccagaggcaggagcaacggggaacatccagggaaggagggaagggcaggggatttggagatggggcaccctgagagagggatccaggcagcaggcagacacgacagcctgagcttcaccccagctcacggttggccctgggagggctttgagcagaagaggggcaaacatcagcaatatgaggccacactgcagacgttctgggccctgcacacgcctccttgcaggcaaggcggccagcccacaaggtaatttaattcctggtgcctgtgggcgtcctgcaaagagccagttggcgtcggaacgctcttctccaaaacctgtgccagtgcccccagcgcagacctggtgtgaaggggacctttggagaggtctcatgagcaatgccgcgtgctctgccccacaggttacttcaatgatgtggaccgtgatgacggacgctacccgcccaggcccaggccacggccgcctgcaggtaggtgccgagcctccccagatgcgacacattgaatttgcacagagagggtgggatgagaggcctgaagttggggatgagagagctgaggttggggcagagttggtgacgagcagacgataagctggtgcaggggatgacagagaaggccccatggccgcatcagtggggtttgcggtctgggcatctgtccgcctctccaggctgggggactggatggaaacaaaatgaacaggcagaactggagggtccactgaaacacttgcggtcatttctgtttagacttgtatatgtgtaagtgtgggtgtacatgtccagacacacctttatatatctgcatgcttatcaatcttcatttgtgtgtatatagatgtttatgtatctttatatttgtgtgtatatatgcttttaaatatatataaatgcatctacatatgtaggtatatggtttttttcatgtgtgtatatacatgcttttgtatatatacagtacgtggatacctttctctgtttttatatatgtatatcctgactttatatatatccttatatatatctttacataggtacatgttttatatgtgtatatatatctttatatttatatgcagatatatgctttttatatatatttatgtatatgtatatcgtttaatatatctttttaaaaatatatcttcatgtatatctttaaatacatatacattttatatacattttaatattttatgtgtatgttatataaatatatatctttacatatataattaaatatatgcctttatttatatacatctttatatatgtacatatatacctttacatgtatgtgcctttatttatatatgtatatatttatatatacacttttatatatacatatgtgtatatctttatatgtgtgtataaatgcctttatatacgtacacatatacctttatgtgtatatacttttatatgtgttatgtatgtacacacaactttatatatacatgtgtatatatctttatataggtatataaatgtctttaaatatgtatatacatatcttttgtatttatttatttttttttgagacggagtctcgctctgtcgcccaggctggagagcagtggcacaattttggctcactgcaacctctgcctcccgggttcaagtgatgttctgcctcagcctcctgagtagctgggattacaggcgcctgccagcacgcctggctaacttttgtatttttagtagagacggggtttcaccattttggccaggctggtcctgaactcctgacctcgtgatccacctgcctcagcctctcaaagcgttgggattacaggcgtgagccactgtacctggtctatatgtatatcttctaatgtatctttatatatatctttaatatatctttatatacatgtacattttatatacatttttatattttatgtatgttatataaatatatacatttatacatatataattatatacctttatttatatatctttatatgtacatatatacctatatatgcttttatatatgtatgtgtacatttatatatacacttttatatatgcatatgtatatgtctttatgtgtataaatatcttcataaatatatttatatatctatacataacctttatatatgtataaatatcttatataaatatatattttatgtgtatatatgcattatttgtataaacacatatttgtaaatgtctttccatatatatgcatatatagcttacatatgtttctatactgttatatataggtgtatacctttacatatgtatgcatactgttttatatatgtgtatataggtcccttcatgtatatatgtatatacatttaggtatatgtgtgtgtgtgtgtgtgtgtatatatatatacacctttatatatgtacatttatctttatacacacagacatatataaacacttctaatataaagttttctctgtaattggaggtgaatgtctatcaataatctttcatatagaaatacaagtacagactataggagacagagatgcatacaacattgggctgaagagtgtgatgtttgaggctttattttcaagcatgtgaggtttctggcctgtttagttctgcaattttattttagaagacataaaggacttgtcccagatattttgcaaagctggacctgcatctttcggacaaccagattgcatccagtcatcttttctgccgtgtttacttgcaataaataaagagcgctgtcttaggatttattacaataacaatcaggaataaactaaaaattactagttatttttgaaaggagaagctgagaacatttacgattgagaccatctgctggaaggtcctcctaatccggcgtcggcgtggctgatctcatatcagtttctcggcaggaagcgggtgcgcctgcgtgaatttggagtccccagggtaaatgttagtcccgtgacggcaaagtgtttttgatagctagagctcagtgttggcatgagttttcccacggggaagaggaagctttggtggggccacccttgactctcccctgctggtcactctttggagctctcttggcagtgacacgttcacacgacttgttgccattcccaatgagctggacagaccaacacctgcaggaaaccccacgctcagacacctgaacatccctcaactctaccttctctgtctaacaggaggtggcggcggtggctactccagttatggcaactccgacaacacgcacggtacccctacatctgggcatgcgatggtgggtggagggtgggaggggtcatctttctagggctcccgcttgcactctgccctgggccttctacctggagtctttggtgagtagggtgctgtgtgctggtgcctggtcttctgagaacctgtctgtgctgggctgttctgcttctgttccccaggagggtgggtgcagccacacatacacacacgcatacacacatgcacacacacacacacacacacacccctttaggtaaaagtaaacagagcaaagaactatacaactaattagagaaagagagcatccaacaaactggagagcatccaacaaattctttaggggcgcagctcgcttacttcaagcagaatagaaaacactttcaatggctgggcgcggtggctcatgcctgtaatcccagcactttgggaggctgaggtgggaggattgcttgagcccaggagtttgagaccagcctggacaacatggaaaaaccctgtctctacaaaaaatacatatatgcaaaaattagccaggcgtggtggcatgtgcctgtagttccagctactcaggaggcagaggtaggaggatcacttgagcccaggaggtcgaggcttcagtgagcagacagagataagatcgtgccactgcactccagcttgggtgacagactgagatcctgtctcaaagaaaaagaaaagaaaagaaaagaaaaaaagcaagagaactcttttggtcggtgcttatgcccagagtgaaagccgtgttctacagaagccataaacaggctcttggcttggttgagtttttctcatggagaccaggggaccttgaaaccctcagatcctctccggtttggaaaacgactgaagcaaaatgtcatcactgagaaagaaaacaataacaaaacactctgtaggttgattttaaaccatcatctccgttttaacattttccctttgttaagagttttgtacaccttcaatgaattgagtaaccatcttttcttttttttttttttttttttgagacagagtttcacttgttgcccaggctggagtgcagtggtgtgatctctgctcactgcaaccttggcctcccgggttcaagtgattctcctgcctcagcctcccaagtagctgggattacaagcatgtgccactacacagggctaatttttgtttttttagtagagacagggtttcaccatgttggtcagattggtcttgaactcttgacctcaggtgatccatctgcctcagcctcccaaagtgctgggattacaggcatgagccactacacctggctaatttttgtatttttagtacagatggggtttcaccttgttggtcaggctggtcttgaactcctgacctcaggtgatccgccctcttcagcctcccatagtgctgggattacagacgtgagccaccatgcccggccttgagtaaccatctttttggttaaaactaatatgtgccaagagctctggtaatgtgggaagtacttttttttctttttctttctttttttttttttaagatatggtctcattaggctttgtgagagccaaggctgttggccccctaagttttctctgaatcactgacatgaggcagcttaattaacaggagaaaaagcgtataaatttattgagtggatatacacgcaaaccttcagaaccaagactcaaccaccaatgggatgcaaaagcttatagaccatcttttttaactttgatgttaggttcaggggtccttgtgtagggttgttacataggtaaattgtttgtcaccggggtttggtgtacacattatgtcatcacccaggcaataagcatagtacctgataggtagtttttccatcctcactctactcccaccctctgccctcaagtaggccctggtgtctggtgttcccttctttgtgtccatgttgtcaatcgagaaaaatgacgagacgagcgtaaaagatttatttgccaaagttaaggttaagggcgcgccccaggagacaggtctgtggccttctccgaagatgattttgaaggctgcaaatttaaaggggaaagggtgggggtagggaaaaagagttattcatgcttttgtctggctcagtgaatctgtgtttttttacataagatggcatagacaaatggggcagagggaaaatgcagggaatctgcatgttgcataagataatctggacaaaatggggcaggggagcaatcacatatgatttgtgtctgctgggcgggggtgactgcaaagctgtcgatttgcatattgtcatggtgaaatcttcacagctcactaggattttccttgtgggcaaaatatgggggagacgtgtagcttttcatcttgtagccattttatttaggaaccaaaagggggaggcaggtttgtgtgacccagttcccagcttgacttttccctttgactaaatgagttcaggatcacaaaatttaatttcctttcacaatgcgtactccgtgtttagctcccacttgtaaatgagaacacatggtatttggttttctgttcctgcattagtttgctcaggagaatggccaccagctcgatccatgttgctgcaaaggacatgatcttgttcttttttatggctgtgtatatgggccacattgtatatgggccacatttcccttatccagtctaccattgatgggaacctaggctgattccatgtctttactatttgagtttgctatttgttgttctttgcaggaagaatgtgggctcagagcatggccccaaataggtgacgttggtaaagcaggtttaacgggtggcaagccaggtgatgagagggagacaggaagaggcctgcttagcaagggggtccttgttatgcagatgaaggttcccaggtagcagcgctcagagacgaccatggtaaatgtttcttttcagacctgtaaaggtgtcagagtctccgtttctctctcctacatccaggaaaagcttagaaagggaaggcctggctgcaacagcaaagatcctctacagatgccaatttccccacctcagtctgctggccctggagcggcaatttcaaaataaggcaaagcaatatattttggagtaaaatattttgatgtccgtcatcttcgttacctcggaagcgagtgttgtcatcagatccatttaacaaaatgaaagcaatgcatgacgctcgactgtccacttcaaaggagcaatagctgtggccctataggtagcccatcctcagaactcactccctatgacacagacaagcttcaggatgggagggggctcatgacaaagtgctcattacctggggtcaagaactgtctacttttggccgggcatggtggcccacgcctgtaatcccagcactttaggaggccaaggtgggtggatcccttgagttcaggagttcaagaccagcctgggcaaaatagtgaaaccctgtctctacaagaaaatacaaaaattagctgggcatggaagtgtgcgcctgtggtcccagctactcgggaggtgtaagtgaccctggaagtttgaggctgcagtgaaccgtgatagcaccactaccttccagcctgggccatggagtgagaccctgtctcaaaaaaaaaaaaaaaaaaaaaaaggacactaaaaaagaattgaccaccttcaactcaacgtactatgagatgagttccttccaccatctttctggaactagctaaggggttccccttacctactacctaggtagacctgatttattaagacgggaatcgcaatagagaaagagtttaattcacacagagctgactgaacgggagcatgtgaagcagctatgctgtctggggtacatacctggggttcattgttgcacgctgagaaagaattcaggacacagacacatgtggttgggttaaggagttgaaagtttaatagaagaaaggagagaggagagcagctccttgcaagagagagagggagagagagaaagagagagagagaaagagaagcatctgaaaaagttgggaggttgtggaccgcagcagcttttgtaggcaggctggaggaggtggtgtctgatttacatagggcttacagactggttcgatcaggtatgacttctacatagtgcgtggggaaggctggtggccccaccctaattttgttatgtaaatgggctttccagttggtcagtgccatcttgtctgctacttactgtacatggggctgacaaagaggagggaagatgaagctgccatcttgaacgtgtctaggccctagttcctgccggcattcacccatgtaagctcctagctggcttgtctatgtctgcagctcaactttattttttattttttatttttttttgagacggagtctcgctctgtcgcccaggctggagtgcagtggcgtcatctcggctcactgcaagctccgcctcccgggttcacgccattctcctgcctcagcctcccgagtagctgggactacaggcgcccgccaccacgcctggcaattttttctatttttagtagagacggggtttcaccgtgttagccaggatgatctcgatctcctgacctcgtgatccgcccgcctcggcctcccaaagtgctgggattacaggcgtgagccaccgcgcccggccacagctcaactttacaggctgctctttgttagaaaatgatttggggctgcttttcattaaaaagaaaagccttaccaaggactcccatacccttgctatgtgcctaagtaattaactaattccttcttaactcctatatcaactggaggttttgcttttttttctttaaacagggtttcattttgttacccaggctggactgcagtggtgaaatcatagctcactgcagcctcaacctcttgggctcaagcgatcctcccgcctcagcctcctgtgtagctaggaccacaggtgtatgccaccacacctgcctaatttttaaaaaatttttgtagagatggggtctcactatattgctcaggctggtcttcaactcctggcctcaagtgtttctccgacctcagcctcccaaagagctgggattacgggcatgagccactgcacctagccaagactggagttttatgactcaaatcagcttcccccaaaatttggacactgggctttttaacgtgtaatttggctggtaggagacccgggcgtggggagtgctgagtggttggttggaggtggaatgacagaggacggacatgggttctttttgttgtcttctgttcttgtgtgggacggcagagctcgctgagccgcattaccagtctgggtggcgccggctggtgcatctcaatgaagggtttaaaaaatgtctcaacttcaaccttaggttttacaatagtgatgccatccctaggagcaactgaagaggtttggaatcttgtggcctccggctgcatggctcctaacctattaatataatttctaatcttgtgactaatttgttagtctttcaaaggcagtctgatccccggggaagaagggagtttgtttcagaaaagggctgttatctttgtttgaatgttaagctggaacttcctcctatggttatctgagtctgtgttcaggaatgaactagggctgttcgagggctacaggcacgatgcagtcggttaggtcagatctctttcactgtcgtaattttctcactgttataatttttgcaaaggcggtttcaatttaactgaaaatgtcaggcaaagaccaaatttaatatttttacagaaagccactgggagtagttttttattgttttattatttatttatttagagacagagtctcactctgttgcccaggctggagtgcagtggtgcaatcatagctcactgcagcctcaaactcctgggctcaagcgatcctcccacctcagcctcccgaggagctggggctacaggcacacaccatcatacccagctaaatttttaagaaattttttgtagagatggggtctcaccgttgtaactgcccaatgggtttaccttgccccctgcctaaacagggccgatttatcaagacagaggaattgtaatggagaaagagtaattcatgcagagccagctgtgcccgagaccagagttttattattactcaaatcagtctccccaggcattcagggtccagagtttttaaagataatttggcgggtaggggcttgggaagtggggagggctgattggtcaggttgcagagggaaccataggggggtgaagtgaggttttcttgctgttttctgttcctgggtggatggcggaactggttgagccagattaccgggctggctggtgtcagctgatccatccagtgcagaggctgcaaaatgtctcaaacaccgcgcttacgttttacaatagtgatgttacccccaggagcaatttgcagaggttcagactcttgagccagaggctgcacgacccctaaaccataatttttcttttcttttcttctttttttgtttttttcgagacagagtatcactctgttgcccaggcttgagtgcagtggtgtgatctcggctcactgcatcctctgcctccctggttcaagcaattctcctgcctcagcctccccagtaactgggactacgggcacatgtcaccatgcccggctaattttcatatttttaccagagacggggtttcaccatattgttccggccggtctcgaactcctgacctgaggcgatccaccctcatcggcctcccaaagtgctgggattataggcttgagccactgcgcccagccctaaactataatttttaatcttgtagctaatttgttagtcctacaaagtccaactggtccccaggcaagaaggaggtgttttcaggaaaaggctgtgatcagttttgtttcagagtgaaaccatgaactgaattccttcccaaagttagttgggcctatgcccaggaatgaacaaggacagcttaagggttagaagcaagatagagtcggttaggtctggcctctttcactgtcatcatttcctcagttacaatttttgcaaaggtggtttcgccacgttgcccaggctggtcttgaactgggctcaagcgatcctcctaccttggcctccataagtgctgggattacaggcctgcaccaccacatccggcccaccttggagcgtgttatataaagcgagccgtccccacacccctacagcctacgaatgagccttttcaccccatgcacgattctctgaaactgctctctgtaaggagctattcgggacacgttcttttgttctctggcatactcatcaggtagaaagaagtgattcagcaagcggctcccctgagagccctgatcgtttcctgttttcctgtgaagttagtctcgggaggtctgcgctgtgccatttttgggggaccattatctggctcccgaatggatcaaagcttactggtcagggggctgctgtatccctggggcaaaactgccagaaaatagcaggtagccctgtggtccttggcagggccagggcccggtggaagcagcagctgggccaagaacatcaggcgtgcatgaggcacagcccagttttgggagcatgacgcttgttttcgaggatgcctgtgctccccttcctgcctggacccctgctctccagccccggcagagcgaggctgtgagtcagcgctcggattagcatcagcatggaggtgccggctgggatgcaagccgccgccatgggatgagtcacgcggcttctccccgaatccccaaaggaggcagagcgtgttaggcttgttctggcttcatgcagagcactgaggggtgagggctgaccgtggctggccgcggagggaagcccaaagtctggcctccctgcggagactggggagaaaatgttgcgctcgtcgtttttaaatactgggggacaagtttcccttgtctgctaaggctgccattgtaaattacaagagtcaggagggctgaagcaaaagggatttcttctcccacagtcctggaggctggaagtctgagatcaaggtgtgagcagggctggttcctcctgaagcctctctccttggctcgtcgacatcatcatctccctgtgtcctcacagggtcgtccctctgtgtgtgtctgtgttccaatctcctctccttatgaggtgtcttagtccatttcaggctgctatcacagaatactatagactgggtggcttagaaacagcagacattgattctctcaccgtcctagaggctggaggtccaagatcaaggtgtgagcagggctggttcctcctgaggcctccctccttggcttgtagacaccatcttctccctgtgtcctcacagggtcgtccctctgtgtgtgtctgtgtcctcatctcctcttcttataaggtctgtagtcctattggattagggcccaccctagtgatctcgttttattttaatcacctctctaaggacgttgtgttcaaatacagtcacagtctgatgccctgggggttaggactgcgacctgtgaatttggagggggatatagttcagcccatagaacccactatccacataagtcattccacttcaaaatcagcacaaagcattagttttaaaaatctcaaatctgtatttttaaaaattgctcttaacacattagaaaaatatagaaaaactttttttgctgtttttctgagacaaaatctcactctgtagcccagcctggagtgcagggacgtgatcatagatcattgcagcctccacctcctgggctcaagcaatcttttgcctcagtcgtctcccaagtagtagctgagactacaggtgcacatcaccacacccagctattttttttttttaagtagaaacggggtctcactatgtttctcaggctgggctccaaatgagctcaagtggtcttaccgccttagcctcccaaagtggtaggattacaggtgggagccaccacacccaacctggaggaactctttttttttaaaattttaaataaattactatttgtggcctgcgttttcatcctattctctttttttttaaccaacatttgctggcatttttttttatgccgaagaaaacacctttgcccatctatgtcaggcctccagaccctcagggatgtacatctaatgcaccttcagccaccggtgtaaacagtaaacaggggccagatggcgcctgtgcaccttccctggccttgggagagcattggaatctctgcagcttttaagagcatcttgcttcaggtttgctgacctgcttgcttctgtaagatcatgcagacttcctgagcaatatctagcatttcatggtctcttttctatcctgcaggaagagggggctatagactcaactctcgttatggaaatacttatggtaaaggaattatgtcttacagaatatgtgaggcaaaactgtccatttgcaaataactaacacactgtctgcactgatgggaagctgatgctttcatccagtgcacaaccaactggccgttcgagtctctcatttgcattttccttggtcatccatgctggggggagatgttgtgcatgccctgaggacttcatttcttcaaaggaactatggcccacttacaggtgttactgggtgcatgtgtgtgcacgtgtgtgtgtatacatatgtgttcacacacaggtatgcttgtgtgtattgtgtgtgcatgcatgtgtacatgtgcatgtggattttgtaatcatgtgcataagtgcatgtggatttcatgtgcatgtgtgcaagtgtctgtgcacacatgtggattgagcacatgcatgtttgtgtatgtgcacagatgtgttggcatgtacttgtggattttgcatgtgtgcatgcttgtgcttgggttgcatgtgcattgcatgtttcccatgtgtgtccattcacatgcatacatttaggggtgtgcaagcacatgtgtgcatgtggatagatgcaggagtgtgcatctgggtgtgctcgtgtggtatgtgcatactgcacgaatatatcatgtgcatctgtgcatgtggattgtgtgtatacatgcgtgtgtacaggcatgcacacacacacatgaatgtgtttgtgtgtgcatatttgtgtgtacatgcatgtgtttatgcatacaggtgtaaacatgtgcacacatcggtgtgtgcatgtgcacacatgtgtacatgtgtatgtttaggcgaattgtgctttatatgtgcttttgttgcctgtgtgtgtggtatgtgcatgtgtgtgtatgtggggatgtgtgggatgtgcatgtgtgtggatgtgcacattgcattgtgcttctgtgttgcatttgtatttacatgttgcacatgtgtgtaaatgcatgtgtgtgtgcacgtgtgtatgcgtgcttgtctgcctgtgtgttgcacgtttgttgcatgctgcatgtgtgtatgcatgtgcacacacatttgtgcatgtcagtgtgtgttgcatgtgcttgtgtatgaatggcgtgcgtgtgtgcatgtgtgtccatggggttgtcagcctgtgtgtgttttgcatgcgcatgtatgtagactctccaatcctgaaattaaagctgcatctccctctccctggtattatccccattctgctaatgaccattagacatggcatacacattcacattcctcctccttatgctgcttggctgtccccctccccccacaagaatgtaaattccctgaaaacagggatctgtgtgctgtgttcacagtcgcatcctcaacagtgcccggcaatataaggccctccataagctctgctgaataaacacgaacatccttttccgcttacaggtggagatcaccattcaacgtatggcaatccagaaggtaactgattgactcacccggtcccaacctttaataagagcacactctcctagatcagtgctgggaggagctgtgtgggcttctgtttcccaacctcatgactttcacggagcactcatactttgtatgtatataaagtagctcctgaataaaaatatctgaccttcagcacaggaccaatcagagttcagagaaaggagaggcaagcattggttttcactgcagaagatgccccttagctctcaaagcaaggctgtgaatgagtgctgagactattacatttctcccagtaccaccattactcccctttctttgaccagcactaacttgaaacccaagaaggacaggagaaaggaaggtatgaacactctgcccaaagaagccatcagagtgcactgtcaatcccgtctcaggtcaaaggagggagaacttgaagcccagaaggctgactttgtgtcctgtattgttgggagaacaggttccccattccctaagggtcatattcttagagatttgggctgacacctgcttgagtttaagttgagagtaaacgcactcaaccccaaggctcttgtgagttttcaattatgggggaggagaaagtgattgaaggtgacctctacctttcaatgatcatgcagagtactagtatcaatatttttggggtatgttggcatccttagaaaaatttatggtttcacctttttccctctgtggtgtaaagtgaggtccagagatggaaagggcaaggcaaataaacaagtaattgcagtcaaatctgatgaataatttcctggaacatatgggatcctgtagcaaggcagaagggatactcctagactaggttaggtgagggaggtagggtttcctggagagaacaatatccaagccaatcccccaaaatatgggtgggaggtgcccaggagaagagtgaggtgtcagggaagatggtgcactaggtagagctggatacacacgtggggacaccggaaattgtgtagccaggatgtggaatgcaacgggaaccagggaaggatgcaatggtgaccaggaaagacctccaggttagcagaggtggagtctgcacttcatagaaccttcatgggaaggagcctgcccctgttgatatgtaggtgaagaatggacctgagggggctcactaagacccagggagacaccctttcagaccagttcagtactccctggaaatgatgacaggctgaattaaagcctgggcaaaggaggcaaagagaagcagtcagcttggatgaccacttggtaatgacaattgattgtacttgattgatttgtaagagatgagagagaggaaaaggtatgtatcagtcagctatgctgtgtcacaaaaaaccccaaaacttagtagctggaaataacaaccatttattatgttcgtgattatgtgagtcagcaatttgggctgacaccattctagtggtcctcctggtctcttctgaactccctctcttgtgtgcagtcaactgtaggtgtggccagcgctttgaccatgtttcctgggtcttcttatgtatctgggactttaggtggaatggctcatctcagcttcatgtgggctctcacatccctccaggaagccaggccaggcttcatcacatggtgaccagacagggtaccaagagcatgaagagaagcgtgcctgggcttagagccaccatgccttcacttgtgtgacattctgttggctaaagcctggattttcagaatgaagatgcagctccacctctggatggggaacactgtgaaatcatactgtggagcgtgttcatgtagggaggggaagaatagagggctgtctctcccaggaggcagggtgtggcgggcggcagcatcagccgtagagcaggttcttgcgttcagtgacaacactcttccccccagcatggcagcctcattcgtggagcagtcttgtgtccctcacctatgccatgccatgtattggcccaggtgttcaaccctgtctgaagaaagccatgcatggaaagggtggctatttcaaatggaaacggtgatttcttccttttttccctttggaagtgttgatttttgtcacatcaagctccttcttgttctttgtgcaggagtgccaaagctctggagcaatttgccatcgaggcattgaggatgcttgtgtctagtgtgtgcttgggtctagagttccagcatgcctttgaaagcaagcctatctggcagtttttagtggaacaatatttttgcatgagtgggcattctacatctaaaaaggcacaaaatagttttgacatgtgcctgtcatcccaactactcaggaggcggaggcaggaggatcacttgagcccaggagttcaggacgagcttaggcggcatagtgagaccccatctctaaaaaaataaatcaggccaggcgcggtggctcccctctgtaatcccaacactttgggaggctgaggcgagtggatcacctgaggtcaagagttcgagaccagcctggccaacatggtgaaaccccatctctactaaaaatgcaaaaattagttgggcatggtggcatacacctgtagtcccagctattcgggaggctgaggcaggagaatcgcttgaacccgggagaaggaggttgcagtgaactgagatcacgccactgtattccagactgggcgacagagcaacattccgtctcaaaaaataataagaaataaataaataaataaataaataaaattaattaaaaggcatacatgaattgacttcaacaaacaaacaaaaatgccaagtgcctcgtctgtgcaaatcctggccttggatgtcttcagtggtaaaatgtggttgacaagcttggctctttgtgaaaacagaattacttcctaaggtttttttttctttttttttaaattaagtttctcttttttttctgtgaatacaagggtgggaagggacgtgatggagaagttactagatagatgcaaaagttattgcagtttttgtcattactttcaatggcaaaaaccgcaataacttttggaccaacctaatatttaagcagttttcctgcagccatgtttttttctcggatgagcttgctttttctccactcctgcaggcaatatggtagcaaaaatcgtgtctcccatcgtatccgtggtggtggtgacactgctgggagcagcagccagttatttcaaactaaacaataggagaaattgtttcaggacccatggtaagtttggctctaaacattgttttgcttgttactaagcctgatttaaaaaaaaaaattactttcagatgtctgtcactagcaaggttatttctggttaagttcaatatacataacttgcctaataatgtgattttttaaaatttatttttattctttttgagacagagttacactgtgttgcccaggctggactgcagtggcaggacctcggctcactgcaacctctacctcctgggttcaagagattctcttgcctcagcctcccgaacagctgggactacaggcatgcaccaccacgcctggctaatttttgtatttttagtagagatggggtttcaccatgttggccaggctggtcttgaactcctgacctcaagtgagctgcccgccttggcctcccaaagttctgagattacaggcgtgagccaccgtgcctggccaacaattgggttttcatggtcaggtgtgagctgtaccttcctctaaaccttgttacaatgaggctggcacattatctgtctaatgtaaaagaggaggagaaaaaaaggaaagaaaaagaaacaaacaaacaaaaattaccaacctacattgcaagactataagcatgacggttggtttaactacctgttctgttttgtattcagtgaaattttcgtcacaggcgagtcaggaaaaatacctgggttgaatgtgaatgttttgcccagaaccccacccgcaaagaaaactaccgaaacactgaattataagcctctctgaaattccgaaggtgcgctcagaccataggggagaggaaagatctgctgtggcttcctggttcaatgccggctccacactcctgggtttgaagaatcacttgggatttgagagcagaggatgccctaaagaaatctctgaaacaacagtcagggattgttttatagcctaaagagtgactcagatctttaactgggtgtctctggaggcttggtttaaacctcaggccacccacgtcagaatctgtctggagtttgcccagggccctctaactcataccttctttgtgtccccgaaggaaaccagaaaggggtgcccattcctacggtgtttgctttaggatttgcatttggcctcaaaaatcctaaaaccttcccatgcgctccctctgctggtgaatgggcagtatcaaccgttagctaatgaacctccgtttggggtgagcctccgtctacattacgccccgtcctgaaattttaggaggaaactgagtttctgaaaaactgccttattttcctggcaacctgagagcagattcttgggttcagtgacaacactctttcacccaacatggcagccatcattaacgaacaccacgtgttaacttcagtagcttttgtggcagtgatttgtaagcctttgttaaccaagggctgaaactgagtaagcagagagaggcacccatctccacaagcacaaaatgtaagggcggggtacaggggtcccccacaaactcaataatcaaggcaaatatattttagtgcaatattttagaaggaaaatcattggaatgggggccagttgagtttctgaaataggtgtagttttaaaaacgtggatgatgcctgccccatttatctgaggtggaaggaagcacgtttttgctaaagaggtataatgtcttgaagctctttcatgccttttggctgcctggtaagtatttttgtctactttctccattgtacttcgatgataccctcaccaggtattcccaagcaccaagtttatcttcccctcccttaaagttcctgagatcagaaaggaggatgtagacagagtgagctgatgttagggagatctcttcaagggtgagcagtgacatttatgtggatcctgggcctatatcacctcgctggctgtaaagcctttatactatctaggaaatatgtgcatgacagcaaatacgtatgggtttggtatcaaatggggctcagagctctgcgaacttgactctaaagttccaggctgctgctaatggtacccagctgtccacctctccttagttaggtcattaattttctctgtctcctaaaggatgacgtacatggtatactaaccatatccatggtgatgtggtgcagtgcacaacctgtggaactgtgtacctgctgaggccatacactgaagcttgcacactttgtagagaaagagttgtagtaacagagctacacagatagaagcagatgtctgtcacttgatgtggacttttaagaatcatactttgcttttattttataaagtggagcaaatgacaacatcacttcagaagttataaagaccaacaaggccatattcgaaaaaagaagttcctacaaatattagttttaaccaaaaaggaagttactcaattcatttaagatcatcaaaatccttaacaaatggcaaaatgtcaaaaacaatgttttcaaaacgaatatttgtttccagatatgattttaacagtttttaaatattttctatttttaatttttcctgctttattgaggtatagttgacaaataaacattgtatatatttaagatgtacaacttcatttctgcatcatttatttgttctaatctatctccttctgccgaatgtaaagcaggtgtcatgtagacagcacatagtctgatcttggttttcttttttttaaaatagatttttcattcttctagctttattaaagtatgatagacaaacattgtatatatttaagatgtgcaacttcatttctgcttcatttttttctgttctaatcttccttctcctaaatctagagcaagagtctcttgtaacagcatagaattggatcttggttttctttttctctgtttaataagacttttttttttgcccccacaatgacatttgtttctaatcttcctttcagaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattgaatgtgatgtggttataaagataagttaggcagctagaccctgcgttctaaaaaaggattgcttgcaatgttggtttggctattcatttgcacaaagagactgtggctctctgttgtgagatcttcagctacctcatggtgcaataacacacacacgcttaaccatgttgatggcacaaagcggtgagcagtagggaggtagaatatcttggtggggaggggatgttatcagcttctgggagatgaagaatattgttgaggttccaaagatgctggacctgtgctaaattcttcagtgatatgaaaaaatcattgagcattcattattgcgaatgaagtggggatgcattatttctgacacccacaagcagggtttgatcatcctttcagctttgagatatctgcacataaaattattattacctgaagaaaataaggctgcattttgaaatgttaagtgcaaaatgactgatgttaaaaccatctgggggaaatcttgggatgctttttcctaggaaatcatatggttgtgatatgttttggcgcataggagacagaaatagtgattatcaggcgttgagcctttttgtagtatttttagtctttgatactctgtaagtgctagttcctaaggcaccaacattgcattccttggtttatactttttctattcatcagggtaggaagtcttaaatccttaggcatccaagaagtatactagctttttgcttctcttttagaaatacttgtggggagagaaaaaaggatggtttgggcatattggtatagtttgagtaaactaaggttaatgttcatataacatttagactttgccataaatatcagaaccaaagatcaagacattcatgtacagtctggaatgtatatatggggcccataaaaattcccagtatgcatgttttatgctcaccattatgaattggggtcttcaaagagagaaggttgaaagtggaaagcacttgaaagggctccccggtttgtaaaatatctttaatcattcacattaggtacctcggagttgcgggtctcaaatgtggattcatgcatcatttgtgcagtttgaagatagtccatatttcctatttcagtattaggtcctgcaacacttttcaattcttgtagaaggtttttttcaggagtggtgatgtctgatgctcaattactattttccctataagagtttcagcatgagcttaattaaattcttgtgaaaaaacctgtgtttttagttacacacacacacacacacacacctacttaaatggaatctaaacatttttagcctttaatccattccattttctaaaactgtcataaactatttttaatcattttaaataaatgtaaaagaaaaataactggatttgattattgaatagtttttttctatatttcacaaataaattgtatgaaatgactgtagaagtggccccaaaattatgaaccttcgtagctgtgaatatgatgccataaatctcttttaaagctcaagatagactatgaacatatgaaatacatagttacctaatcatgagactaaattcacctgggtgacaaggctaacgttcaagctacttaagatgaaaatatttgaatcatgattgcttgggggaacctctctttgaggggtcatgaggaccacctgctgggcattctgttttcatgctgagaaggtgagaattgaacagatgagaaaagccttgataaaacgtcatctccatgtaatttagagaaggataaccttgactgtacagctgacccttgaacaacacagggctgaactgcacatgtccacctgtatgtgagtttgcttctggctctgccattactgagacagcaggaccaaccctccatctactcaatgggaagatgataaggatgaagacctttatggtgatccgcttccacttaataaatagtaaattcattaattttatcttccttatgattttcttcataacattttctttcctctagcttactttattgtaataatatggtatgtaatacatatacaaaatacgtgttcaactgttaccagtaaggctttcagtcaaccagtatgctatgagtagttaagtttttggagagtcaattcatacagcccttgatttttttttttttttcaattaagttcatttagatggtcagaaatgtcagttaagcgtcatttgaaggtaataactaaccttgaaaaactagtggcttgggtatagttttccaaaaagttaggctgggcgtagtggctcacacctgtaatcccagcactttgggaggcctaggtgaggggattgcttgagcctaggagttcaagaccaggctgggcaacatagtgagacccccatctctagtaacgatttaaaaattagctgggcgtcgtagtgcacacctgtagtcccagctacgtgggaggatcacttgaacacagaaattcaagaccatagtgagctgcgatagcaccactgcactccagcttgggcaacagagtgagactctcaaagaaagaaggaaggaaggaagggagggagggagagagggaggaaggaaggaagaaaggaaggaaggaaggagagacagagaaggagggagggaggaagggaaggaaggaaggaaggaaggaaggaaggaaggaaataaatttgattcttttcgcccataaatttgtgatgaagcaccagttttggaaagcttccctgctttggtagaaatagcagatggcaagattctgatatcttctactatgaagttcaaagcagtcagaagtgggcagcttggtttttctgaaatttatcattctgacatcggactgagacctagaggagattttttaatgccatctgacagatctaaaatacatcttctaagagtactatgcaaaagtggcagctgtcctgtttgcttggcttcattgatccaaaccacagggttgacaattttccttcacatggatacagtgagggattctgcagttatatgaggcatttgagtcaaggtgatacttgcttcttgattccacagatgccactttttgcctttgaggacttgctaaagagttcagacttttcctactgtatgttttctgtgcagaagtcatgttgtgtggtgaggaccatggattttatttcatttcttaacctttctatgcaaatgagaccttgaggctgcagagaacaaaattattgggatgcacaaatccaaatggaaataggctcagtttagctaaggaggacacttgtgttatcttgtgattctaatgacgttcaagctttaatcacaacattttcgtgcaaaaggaaaaatacatatattatatacgtgtgtgtgtatctcctgtaaaataaaaacaatatattgtattaaggaggccttgcagctgttgtccttatagcttcagaaattttatttttttcaatatattattcttaggtctgtagtatgaaagttcttttaaaataaactgtacaacaatttcacaaaatattcaaaataaaaaagagggagtgtttggatattaattgtcactaaatttaataattaaaatactaaaaattttacaaaggggtgaccacactaaaattcatatatccccaaagatctcttaaaaattagatttttcaggctgggtgcagtggctcatgtctgtaatcccagcactttgggaggccaagatggggggatcacttgaggccagaggttggagaccagcctgggcaacagagcaagaccccatctgtacaaaaattttgtaaaaattagctggatgcagtggtgtgtgcctgtagttatagctacttaggaggttgaggcaggaagatcacttgagcccaggagttcaaggctgtagtgagttatgattgtgccactgcattccagcctgaggaacagagtgagagcttgtctctaaaaaagaaaaaaaatagatattttgaacattgcaaaagcctacaatctttttaatattgattactttagttaaattcttctccatttaatgtgattttagaagtaatccttttacatctggaaaatggagaataatttattatttcacccagagaatgataaatcaatcaatcaaaatatagcaatctagaaagctaataaataatgttctaattagggagacctactgccagtaggagtaatagataataacaatactatttgctgaatcattttattttagtagaaaaataagctttcaaagtaatttatttacttatttatttatttttgagatggaggctcactctgtcgcccaggctggagtgcagtggcacgacctcggctcactgcaacctccgcctcccgggttcaggcgattctccctgcctcagcctcctgagcagctgggattacaggcacccaccatcatgcccagctaatttttgtatttttagtagagacggggttttgccatgttggccaggctggtcttgaactcctgacctcaggtgatctgcccgcctcagcctcccaaagtgctgggattacaggcgtgagccactgcgcccagccttttaaaataatttacatactttacacatgtacacataaaaatggatgttggttggatgtggtggctcatacctgtaatcccagcactttgggaggtcgaggtgggtggatcacttgagcacttgagccttggagtttgagaccaagcttggcgacatatcgagactctgtctctacaaaaaaattaaaaaattagctgggcgtggtagtacatgcctatggtcctagctacttcggaggctgagacaggagaattgcttgagcctgggaggttgaagcagcagtgagctctgattgcacaattgcactgaagcccaggtgacagagcaagaccctgtcaaaaaaaaaggatgtcagtgataatgagttgtttataaagatagaattagagttccagggatgactggagaggtatagtgtattataacccctaccatgtgcccgtcagggactggtacttaaaagtcaaaacagtaactgcagaatttgagaggtgtacaaagatagtctctcaaatagtgctcagttattagttcagcgatggtcagtttgtgcatagctatgaaactagcttatcacggtaaaaagtgtgtacgcttcactatcttgtagcatttagtttcccagcagggccatgcgacacccagtggacatttctaaattgtacattcaaa

SEQ ID NO: 511 - DNA, 107257 bp, Homo sapiens
tcggttggaatctgttgaatgattggataaagtaaaagataagtatagggaattattaggtagcattaaatgtgtaataaatgtaaagagagggagcaagtgcatacaaggaagtgtgcgctactgggtttctgttgaattgttcatggaagaccatcagcagttcaaatccaaaagcctgtcttaaaattagctgagtgtggtggcgtgtgcctgtaattccagctacttgggaggctgaggcaggagaatcacttgaacccaggaagcggcgattgcagtgagccaagatcgcaccactgtactccagcctggtgatagagcgatactccgactcaaaaaaaaaaaaaacttgtcttgagggactatgccaggctttacagctacaaacatcatggaggaagctgtctgcccattagaagcccagagcccggagggacagactagagcaaatcctctccctcgttggagctagatgggaacacaaatctatctgataactaacatgcaattttacatctcttaccttgtttaatcctcacaaccaccctgatgagtagtagtattatccccattttgtagatgaagaaacaagttcttcaaggggaagggatcctcagagtagcatatgaatgagaggcagaaccagagtcaggacctatatcttgtcttctccttcctaaaactagaaaagtacccacaaccaggcaatgcttttggtgcagaaaaagcagtagtgaacaaaataggcaaaaatgtctgcctttagtgctcacattgttgtggagaaagacaaacaataagcacagtagagaagtaaaaattagaatgttttgctaaaaagtccataaaattgaatattattcagccataagaagggatgaagtaccgttatatgctacaacatggatgaaccttgacaccattatgctaaatgaaagaagccagtcataaaaggtcacatatttcattattccatttgaatgaaatctccagaataggcagctacttcctatccacagaggtagaaagtagatgaatggtaaccaggggctaggggaagaggggaatggggagtgactctttattgggtacagagtttcttttttgggtgatgaaaatgatctagaattagataactgtgatggtgacaaaactttgttaatatactaaaaaccactgaattggctttaaaccaattgaattttaaagtatactttgaaagggtggatattatggtatgggaattatatctgataatgaaaatatgattacattgttcaaaagcatagggaagcagctacaaaaaatatgaatcataaattgtggctctttttattctgaagtgtagaaattgaatattatagctcaaaatataaaacaaaaacaaagaaagctaaaagcccttccatttggccatcttggagtaagacctaccacagtccagtgccttttactcagccccacagcctagcctattgtttacatgaaaccctgtagcttccactcctgtttggtgggtgtaaagttatgagtgaccatattgggggaagggaggaaaactccccataaacgtgtatcctgggggcctaaggagagacgatggcccaggtatcagaacatgatatgcctacttgtccctatctccttgtccacacataaggcttggaaggcagccatgttgtatatcacgtgatctccaaccaatgagctgattggcttcttcaacaagagcccaggtagagattggtgtctagaggagcccatcagattctagagaatcaggcctttggcagtggaaactcccctgggaggatgtcatagggtcctcagggtcagacacagagagaaggagacattgggacagagagaagaggcaagaaaaaaacatatcttgcagtctgtgaggaacagagtggcccccaggggcctccacctcaggttctggatcaaagctcctcaaagtttaaggtgcatttggatcacctgaggatcttatgaaaataaactctgtctgattcagtaggtctgggtttgggggtgggagcctgttagtatatttctaacaagctcccaggcaaggctgctactgctgctgatctaatgaccacagtttgaggctggacagagtggctcacacctgtaatcccaacactttgggaggacaaggcaggagggtctcttgagggtagaactttgagaccagcctgggcaacacagcaggacctcgtctctaaaaaacaagagagaagaagaaaaaggaaacaacaagaagactcaactagagtaggaagcagttaggccacatatctcttcaatggagaaaagagctttttcttgagtaaattggagtgtacccatgttccttgtcaatgatggtaactttaaatgtcaagaatgtgagagaggccaggggtggtggatcacacctataatcccagcactgtggggggctgaggtgggaggatcacttgagccaaggaattcgggagcaccctgggaaacaaagtgcgaccccgtctctacaaagtcaaaaaattagcccagactggtggcatgcgcatgtggtctgagctacatgggagggtgaggcagaaggattgtttgagcccaggttgaggctgcagtaagctaagtttgtaccactgcactcattccagcctgggcaacagcaagaccctgtctcgaaaaaaaaaaaaaaaaaagaatagtagagcccaggggaaggtgtggccctggggtaggcgctgggagactggagaacaactgttagtggtcccatcactgcccagagcagacagtgccctgtccaccctcatgagatctttgaactccttggacaggactggctataaatgaaaatgtggggacccttatttttaacttgttaagaatgttaagatggcaacagcaaagctttaaaccaagtgcatggcccttctgcgttgtaggcccacaaggccgacactgctattcacatccttgtatggtcccctaccctggagcgtggctggggcctgtgctctactgcttggaagcaaggcttatccctaagccttattttcgggaaggtggatttgagagctactatcccacatccttgcttggtgccctgtgaataaatcttttctcttttgcaaaactcgtgtcatggtgattaatttactgtgcaatgccaggcactgttggaaacctctggataggcctcacagggcctcagccatctcggggaggcgttagctagagtgtaacaaatatgaccccagcaactggggagggacagctcattccttcatgaggtgtggggctggcagccccgcaggcagtcagccacccttcctctctggcctccgtcctgggcactgggcccaggcactgggcaaggaggctgctgcacctcctttctcctcttcctttttttttattttttgagacggagtatggctctgccgcccaggctggagtgcagtggcgtgagctcggctcactgcaagctccgcctcccgggttcacgccattctcctgccccagcctcccgagtagctgggactacaggcgcccgccaccccgcccggctaattttttgtatttttagtagagacgggtttcaccgttttagccagtatggtctcgatctcctgacctcgtgatccgcccccctcggtatcccaaagtgctgggattacaggcgtgagccaccgcgcccagcctctcctcttcccttttagtgggaaatatacctgcagcctagattcccagaaaggggtggtgagagagcagacacgccactgattgacccgaagttctaggagccaagggatgagtgaagagggcgtggccggactcggggctcctggtgaggtgcaccgctgcaggctcggtgacccagcagttcctgcccaaccctcacctacccccagccgttcctgtccgccgcccccaaccagccattcctgcccgcagttcctgttcccgggcctgtccccgggtttgtccccagggcccgtcccctgggtttaggtctgccctcccacgccccaccccattgcccccgccatgggtctgctgtcccagccctgccgttcagtctacatcttcgccaagaatggcatccccttcgagcttcgcacagtggagctgaccaaagctgggctgggcaggcaggcccaggggatattggccgcggatccctgcctgtccccgctgctttgcagttgggccaagaatgcagactaacacgaagaatcagactctccggtgtggaaactattacataattatctatgttattatttttactttttggagacagcatctaactctgtcactcaggctggagtgcagtggcacaatcatggctcactgcagcctcgaccttccaggcttaagcgatcctcccgcctcagcccctcaagtagctgggactacaggtgcccaccgacatgcctggccaatttattattattattattattgagaggaggtcttgctgtgtttccgaggctggcctagaactcctgggctcaagtgatcctcttgccttggcctcccaaagtgttgggattacaagcatgagccgccatgccccactggttgtctattttaatagaggcttgatctttgcttgtgaatacaaaacattcttcaaaatacaggtttagagagggcacagcaggcacagaacgagggtagggaaatggagtggggcaagaatatcttcaccccatgtgcttggaaaaaacaatgaaactgcctcgttgtttcctaagtaaaatagtccctgtctacccctgcctgtgtctcttccacttttgtattatttgtttgtttatttatttatttatttatttatttatttatttatttatttattacagtgtctcaatctgcagcccaggctagagggcagtggcatgatcccggctcactgcagccttgacctctcaggatcaagtgatcctcccaacttactcctcctaagtagaatagttgggactacaggcacgtccccgtgcccagctacttttttctttggtgtgtgtagacgcatgattttgccatgtagaccaggctgaccttgaactcctgagctcaagtgatcctcctgcctcctccttctaaagtgttgagatcacagacatgcaccaccatgtctggccctgggtctcttccacttttatgtatttcttggcattcttctgccttttccttttcctgcatctgacttgctctatcccatggggcttctcacccagctgaaggggctactcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagagggaggaccctgctcagctgactcttcccaactgctgcccttggtacaaccagcttgagtcacctgctacagaacaggggctggacacagaagcagtctgtggagggagaatgggcaggggtgtgtatgtccattcagtagaagggcaaagaggcccacatgtaggcctatgatcagactggagcctggcttgactgaggtcctctgatccaaacaccaggcacctaatgcggcctctagcactggcctagagtgctaaagtgagtcagacctgggaacccccactggggagggagccttgagagtttggcataagaaagcaagaagagctgagccaccggaggctaagtagctgaatggggcagggattcccagcaagaatgaggttggtctgagggttgggaacatgtttggctgggactctggggtattgacaggtcacccagcctggccagtagggcctaagtccccagctgggataggaagctgaatcagagggggcaagcctagagcccagggaggaggctggaggggtctgacctatggatggaactggctgggggtggggtgtgaattacagctccagggaattgtccttgagccatgcttcaaggagctggacacaggaaagatggccctctgatggggtcaaggtctgtgacccagtgactagcagagaggcttcctcttccctgatgcctcccagataggggcctcagaaagctgctgctgggattttggggtgggggtgggcagagacctcagagaactctgggttatccccactcacctctctgatctttcctgcaggccagcagcacagcgatgcctttgcccaggtgaaccccctgaggaaggtgccgggccttgaaggatggggacttcaccttggctgagaggtaaccggtccgtgggctgctgccgggccttgtggggccagtcggctgtctgttcactgttgatggcttggatcatggactgtgggccctgcaccagccccagggtgaagaatgggtggaggcaggcagaggtgcccagtgttgacaagggttatagaagtcccctcctgcattgtacaagtgaggaaactgaggctggaggaggggagggacttgcacaaggccacagggcccagtctgcttccgggcctcctcaccgccagccttcccctccgaaaaaaggagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctgcgtccttctcctcatggatctcacattccattaatagaagggggagctgacagtaacccatgtaaacatggaacatatcggatgttgatggatgccatggaaaaaataaacagggtaagagtgggggtgtgtgtcattatgagtaggatgctgagggaagactccctggaggaggtggcatctgagcagggagctgtaggaatgtgcaaggcatgaggagaagggtgttctcactggagggaagagtgagggcgaaggctccaggtgggacaatgcatggggttcagactggagagcaacgggccagggtgggtgcagtgagcaggaagagcaggaggtcacgacagaggggagcatgggacactgggaaggctttggctcttaccgcaggtggattgagttgttggagagttttgagcagaggagaactgtgatctgacttacgtcgtaaaggatccccctggcaggggtgagaaagccactgcagtcatctggcatgcagcgctggagccccagaccaaggtggtggtggtgcagggttgcgggggattgtggtcagttctgacttttattgaaatctaactgcagggtttgctgaagggttggaggtgggtgggaaaaatgaaagccaaaaccagcctccaggttggtggccgcatggtggcgtcctttaccgaggccacatagtgcctccttggtggagctggattcacattcagagcctgggatcactggatggtccaacacccataaaggcatgatgagctctgagggtcagactgcacaacccttcaccataggtgaacgggagttgggacagggtgggaagcaatgctgccatgtcacctggaaggctctgtccctgctggccttgctcctggccctgtccacactttggatatgttggggagatatccaacatgctctcgttcttcagactcacactgggtgccccttcctcctggaagccttccctgagcccctgctgaagttcatgacattttgtttcttccttgctgcccttagttgagatgacagtctggccccgtgtagggctgtgtgaccctgggtagttacctaacctctctgagcctcacatccctcctctgcatcatggggatagtgaaaatgccccagaaaacggttgaagagtgttcagggcatgtcttctgcccctgccatgtccccccagtgtggctagcttgctctatatgagctgcatgtacaaagcacctgaccactggtacctccaggacctgcaggcccgcgcccatggggatcagtacctgtcatggcagcacatggccctgcagagtagctgctgctgggccatgtggcagacggtgagccatggagggcagggacacctcccgggatgcccaagggatgctgctttcactttacaaaattctgtttagacctgagaccaaatcctggaatgccagagactgcctaattcacccaacttgtttcataggagggaaaccaaggaccagagccaaggaaggattcccctaatgtgccttaattccacagctaccacctgcacacttacactcacacactgttcgacacacagccacactcacacacacatccacccacgtccacccacagtcacacgatgtatcacattcacacgtatacacccacacacacaatcataacatttacacacagtcacacagttaactcctatacacacatatacacccacacaatcacacaactcactcatattcaacaaagtcacacaactcactcacattgacacacatacacaccaaccccacacacaattcacatacatacacacacatatacacccacatacacaaccacaccattcactgacattaatacaaagtcatcacacagttcactcccacacacacacatacacctcacacacacaggcacacaattcacaccaacaaaatcacacagttcactcattcacacacatacacccacatacacaaattcacactgctcagtcacatttacacaccattcaaattcacacacatatacacctacatacacacagttcactcacatcacacacatatacacccacatacacacagttcactcacatcacacacatatacacccacacataaacacagtcacacaattcactcacgttcacacacacagttcactgacattcgcacacatacacacacaccacacacaggcaattcagtcacatggccgaaagccagtccttaccttcctatagttcctttcccagtgtcacctcagcctttggccctcagcgtccccttcccatgcctggactgcggaagagccctgaacacaccccatcttcatgcctccagcgctagcccgagcccttccctctgccaagagcactaagtgcaactcaagatcacttctagggacccttccctgcccctgctgccaggtgacctgaggatcctgctggtcccgcttgacaatgatgcacagcatggttagttcagctgaggtcgctctcccagacttactgccacctacacagcactaggactgactgtttaactttattctttatttcgtgtactttattggagtgtctgttgaaagcaaaaccatccaataaggaacaatcccaaggcagccagcatggatcaagaaggcacaggctgtggccgccatccccagtgcctgatggggagagggggtggtaatggaaaaggcccaggaaagcaggccagagtgtccctcaaaatatgagaaatcactggaagagagagccagaatgggacctaagacagaagccaccaccaggcacccttaaggcaggacagttgcaatggttacttggaatacttccggctaggagtggtgttgcgggaagtcagggaccccaaacagagggaccggctgaagccatgacagaaaaacgtggattgtgaagattttatggacatttattagttccccaaattaatacttttataatttcttatacctgtctttactgcaatctctaaacataaattgtaaagatttcatggacacttatcacttccccaatcaataccgttgtgatttcctatgcctgtctttactttaatctcttaatcctgtcaaccaaggaggatgtatatggcctcaggaccctgtaataattgcattaactgcacacattgtacaggatgtgtgtttgagcaatatgaaatgtgggcaccttgaaaaaagaacaggataacagcaattgttcagggaataagagagataaccttaaactctgactgctggtgagccaggcggaacagagccacatttctcttctttcaaaagcaaataggagaaatatcgctgaattctttttctcagcatggaacgtccctgagaaagagaatacgcaccaggaggtatcagcttataaacagcacccctgggcgtggcctgtctcttatggtcgagactgcagagatgaaatatactccagtctcccatagcactcccaggcttattaggaagaggaaattcccacctaataaattttggtcagaccagttggtctcaaaaccctgtctcctgataagatgttatcaatgacaatggtgcccgaaacttcattagcaattttaattttgcctcggtcctgtggtcctgtgatcttgccctgcctccacttgccttgtgatattctattaccctcttaagtacttgatgtctgtcactcacacctgttcgcacactccctccccttttgaaaatccctaataaaaacttgctggtttttgtggcttgtggggcatcacggatcctaccaacgtgtgacgtctcccccggatgcccagctttacaatttctctcttttgtactctctccctttatttctcaagccggctgacggttaggaaaaataggaaagaacctacgtgattattggggcaggtcccccgatagagtggcacatgatgggcacagggcaggcttgggaaatggggggccgtaaggccacaagacatgtgggcaggtagcccagagtgtgtctggaacatcctgtttattggtcggcagtgacatctactgtcacatttgagaactgcatccacagccacatgacctcctgtgaagacctcagggcaaactggggaaacctgcccttcttggaaggtgatactaggggggatgagcaacacctttcttggaggtttgaattcttcagggcccctccagcatcttggtcttcctaattcctcccttgatcccccagccctaggggtggtagcttcttgcagtgtttacctccgtgttaatctggattctctctgtcttcggagttctctaatgcctggttaccaattctttatatcaagttctctccgttaaaatcattgtggtggggtccatcccatggatatacatggaggtctgtgtgacaatgtataatcttactatttgcagttattacaaaactgtcctagaagacatgaatgcttgttaaaagaaatcttttaagtttcctagacttcaaagaccgttgctatgccctgtgaaacatcgcctatatcctttaacagtttgcaattcgaattggttacttacttaacattttgttgccctggtgatacaattatgttgactcgttattgtgaggttactttgttattaaccatgatgaggattactagcacatacttttactccatatgtataacacaacaatgtagtaaaaccaataactcttggttctctattcaaagtgtttggaatctttattctgtttaaaacactgatgacatttgccaatttttgagtgttcttcatgttactgatttgtaggagctctttatatattgcagatttagtctcttactggttatgtatgctgcacctgaggagtagcagcactgccaaggacactgagtgtcttgtctgtgcagagcttcacatgaagctggagagaagggactggggcaagagggaaagataaaaaggggcaagtaagtaacagaatgaatccttgttgctaatctcctggcccccatcccagacccttcaggggatcctggcgattcgaagcagcatagcctgataggcctctggtgagggtgttgggagggttttcttggccgcctgttccaggatgctcaagatgatgctgtgggcctcctggcatagctcagcacccaggaaagcctccactcgtccacgccatgctgccagtcgtggccgtccctcaaacagttcatagccgagagccaccggctgtagggacaaggatgaaaaagttgtgggcatacaactttcccagttgtcactgccgacccgaatgctggaaccatgggcagaagtatcagagacatggtccattccccagcccctaagtgaatggaccacaggggcccaggcagtatgttcagccttagagcccaagagcagccagggtgagaccccacacccaggcaggaggcagaagttcagggttctggccccagatcatccagagacttgctctatgattctgggcaaagttctggctttctccaggcctcagtgtttctgtctgcctcatgggtgtgacacgaagagggacactgcccacaggctgagctcacacctgcatcagctcctccagggccatgagatcagccagtgtcacctgctggccagcgaggaagggcctgtcccccaggaacttgtcctccagccattgcagggcctggtccatggcagtcctgttgcgttccaccttctcctcgggcacctggaccccaatgaggggccccaacacctgatgggggcagagagtgggtcagtctatggccccggcctactgccaactactccctgatggccaatcactctccagatggctctcctcacctggacccacaggggtataccaaaggtgccacggatgcagtcggcatgccagcccaggtactcatgaacacgggcacgagcctgcaggtcagatggataccagtggtccggcgtctggtacttacagctcaggtaaatcaggatggccgagctgggaacaaatgggcagtggctataaggacactggcaccaggcatttacccctaactgctcccatctgccagtggggcccgggggcttctctgcatttgaaggactgccctccagcctcgccctccatctccagctccccaacaccaccccctcctcctacgagtctcctcctgtctttgttgccttgggcaccgactcttggctggaccttctgctttgcattttgagaacctcatctctgtgatatgccagcagccgccctgtgaggtagacactcctgttagccttttagcacaagagaaaactcaaggtcagaatggtcaagtgacttgtccgaggcggtgcagctcagaataggctccctggacccctggaaccctgcatggggctggcacacagtggatgctccgtggagtcccttgcatgtccacgcgcttgggtcagggatcacgaggggaggaatgtctttggcccccgtctgacaggcccccagccatcacttctgcagccacctgacctcttgtccttttcctgcccagcagctggacctcaccatgagctgtgcccttgggccatggcattggcctctaggcccggcctgggtagattgggtagtctgcgacaagtcactagaggctcttttcagctagcatttgttgaacaaatgcgcaacagtggaaaaatgttcccttgtcttctcttctaatacccttcagtctgggagtggagaggccctgcggctcagaaaaggctggaagatgagaggtggggggacatgttctgtcagcccctgctcatcccggtcacaccccaagctgtaccttctccccagatacctctcctttctttctttcctttttttttgagacggagtctccctctgtcgcccaggctggagtgggctccctctgtcacccaggctggagtgcagtggtgctatctctgctcattgcaagctccgcctcctgggttcacgccattctcctgcctcagcctccccagtagctgggactacaggcggccgccaccacgccctgctaatgttttgtatttttagtagagacagggtttcaccgtgttacccaggatggtctcgatctcctgacctcgtgatccgcccacctcggcctcccaaagtgctgggattacaggcgtaaaccaccgcgcccggcctttttgagacggagtctagctctgtcgcccaggctggagtgcagtggcgcgatctcagcacactgcaagctccgcctcctgggttcacaccattctcctgcctcagcctccagagtagctgggactacaggcgcccgccaccacgcccggttaactttttttccatttttagtagagacggtgtttcacggtgttagccaggatggtctcggtctcctgacctcgtgatccgcccgccttggcctcccgaagtgccgggatgacaggcgtgagccaccgcgcccggccagatccctcgcctttcccctccctcgctgccccatggggtatgggagggccactggggcccggggccagtggggagagccaaggtcacatgggctccggatgcggtgaggggtgagggaaggagggcacctttcagtcaagatgaaatcaccatccttgagcgtcggcagtttccccaggctgttgatctgcaagaactccttgctcttgtgctgccctgaagaggaagaagtcagaaaaggtcttcagaataaaaacgctgcacctctacaccctccctcctcctccccaagcggagccccacagccctgagaaacagcaaggtctgggactagaggcctggatcagcctcactccctggctgggcctccctgccctgccacattccggggcagctggggggttttggtgggtggggccaggtgcagcaggtggataaagagaagttttctagccggactctggtgggccaggggaggggaggcaaactggggtggctcatctcttcccatctcttaattctcacaacagtatgtccttcttcccgaggtcttctgggctttgtgaatttatatgcgtgcattccacgcaagaactctgtcaactccattcagtattttctttccatccctacagagcagaaggtaacgttatcctccttttcagaaggcaagctaaggttcagagaggctgtgatcccttcaaggccactcagtccacagcattctctggtggcagacgctgcaggaggaggtgagggggctgtgcgggcggcgagacgctcagggcagagcagggcgggggcctgggggtgcactgggtttgtggacacgcggggaaacgggctgggcccacctttgaccaaatccacggtgcgcagctctaaggggatgccattcttcttggcgaagatgtagacggcgcggctgggctgggacaccaggtcaagaaacagctctaggcccatggcgggggcggcaaggacagcggggatggcagtgaaggcgctgagcgcggtgtgggcagcagctgtggcaggatcccggcgcgccgggaaataggggatcaggccccaccccctggggacagcacccaattggagcgcaccacccccggacccgcctcgccccttcggttcctgtccagtcctgccggccaagactccaccaccagatccgtgcgtccctacagggagggcggtcgctatgaacgcacagctgggagggtggagttggagctggggaccctcgactggcagggaggacgcggatgcagggggccgactgcaaggggaaggggaaccggctggacagggagaagcaggtctgcttttcgggatcccggtgccagggaccctgcccagttccaggcgtcgccctgacccagaaacgactgggcgccgccgtcctggaaaggccccagcgcacggacatctgagggttcgttcagagctctgtttctcggcgctgcatggtggcggaagggagggagcgaatgggatcccctaaaagggatcttagagtttcacccagtgggatgtgacacttgcaggtgtcccaaactggtgggaaccttgactggaaggctggggttaaggatgaactttctgccgtccagactgtcccctgcagagcagctgctgccagacagcgggagctgccagacagcgggagctcccacttcgtgcacaggatgggggcagggagcccgcagccgcgggaggcaggaatgactgtccgggaacctcctttcttctccctgaatcccagccctggcatctcaccagggggcacagtgatggtccagggctgggcccgggactctagctgaatctttcagagtatcccatccctctggccagtggcccaagcgagtgaaccagaatgcttccttgggagttttgaaactggaactggagagaggagctccctatggggaggtaaacgggagctggggccacctgtagtgacatttcctgagttcgaggagtagacgagactgagagagaaaagctgactcagagaaagggagtgataacagggcatgctggcccacacctgcaatcccagttactctcacgggatctgtttctctgatgtctgggtatgaaaggactttctaagcctcagaacagtgggagaactcaacaaagaaaaaaccaatacatatacaaggttactttgtggaggaaaaaatggattaaccttaagcaaaaaactgggaaggatctcggtaaaagatacgtcagaaggaagtaatgtcctttaagatgttcttagaaacccatcagacaggtggggtgtggtggttcacgcctgtaatccctgtactttgggaggcagagatgggcggatcagttgaggtcaggagtttgagaccagcctgggcaacacggtgaagccccgtctctactaaaaatacaaaaattagctgggtgcggtggcacactcgggaggctgagacaggagaatcacttgaaccttggaggcagaggtttcagtgagctgagatcataccactgcactccagccgggccactgagcgagactgtctcaaaacaaacaaacgaacaaacaaaaagaagagaaactcatcagacgaagacacaggaaaaaaatgagcgaaggaaatcagcagaggtttcattgaaggacaaagagaaatggtcaatacatggatgaaaacatgtttaacttcagtaataatcaaggaagcacacaccaacacaacatgcacatactgtttttatttatcaaaggcacacatatttttgaaatgagtactcctaattaatatgtacagagcacttacccagtgcccagcacaggggtggcaccctgtgtgtgagacagcatgaaacaggtagacacgcgccctgctgaaagtaagggaccgcctctctggaggatccatcgggcaataaggaggtttccacaccttaactgtgtctgccttgacctctggggcctgggagcagagccccctccagctggtggggaaggaagcgtggtgtgtttgaggacagaatggagagaagttgagtagagcaagtgtagactcttcctatccaaagtgtggtcaatggactgggagtatcagcatcaccagggagcttgttggaaatgcagaggctcaggccccactctgaccttactgattgggagcataaactgtaaccagattccagggaggattcatacacacattcccgtttgataagtggggggtagtaggaggtgaggtgaaaagtggggaggggatggctaccgcactggagaaggctggctttgtgttgaggcctttctcatgagggcagtggggagccatggaaggctttatgcaagagagggtacgggcagattgagattacagaaggatcccactggttgccttgtgtgaggacccagggagaagggggaggctgtccctgtttgagtaggagatgagagctactggtggctatgagtggaaagaagtgagcagaggtgagcagaaatcccaaggactggtgatgataggatgatggtgggaaccaggatgggctttgggcagaccctgacccctctctctgcctgtcggcccaccagataataatccctgtgttcctgggcgagtcagtgccacccgagatgttggcggccactttggctgagctggacggatgcctgcagctgctcgaggacaagttcctgcgggaccaggccttccttactgggccccgtatctctgtggctggcttggtggcaatcacggagctgaggcatgagagtgccatggggtgcggtggcccgctgggcagtggtgtatccgggaagggagctgacatcccagctcatgttgtcttttctggctgtgggaccctgtgtgagtcacttctccttctgagcctcagtgtcctcatctataaaatggggctttacaaacccctcaccgcagctatattaagaggcttccaagtgtccccagggagggggacatcctagcccatcacacacatggtggaggagggaaaatccaatcagagaacccctaaagcaggtcatgctgccttacacttggctatgcccagcccctccgctgactctgtcttcccctagcccatcagtgctggctgctgagtctttgaaagcggacccacggtggcagcatggtgcccaacacgtggaggctgcagtgcgggaggacctcttccaggaggccctcccagctgtcctgaaggccaaggacctgcctccagtagaacctgctgttaaagagaatctgaagaccttaatgcagcttttcttgctgtgagtgcgtgtcccacacttgctgagccactgaggggatgctgtgttggtagaataaagacatggagctgtccgtctccttggttgaagagaagacatatctgcaaaggctctggtccacagttcctccagatatcatgcctgcattccttttgtctcctaccccattccattctagcttccatgtgacctctgaaaagagcttgggcaaacgcttacttgaccctgaccttctgtgtggaactttgtatggttcctcactgcccagaagctaaagtacaagtcattgaactttgcattcaaggccttgctcccactcctccaggtggccccttctgcctgcacactcctaacccctctctgggctcccaccttggcctcttggcctccgctcatgctgttccctcctcatcttcgcctggtgcccttcctggtcttttggcatttggcaccctgtctcttctccagggagacttccctgacctccccagccccagtccaggtcaggcgacctctctgggctcctcagccccagtgtttccttgcgggggatacccccggactgagcatgtatcatcgatgaggggtgacctggtggaaagatgtctgaatcaggatcagccttggtctcctcggtctctctcctcactgtggggcgatgttgtgttccacaagtggggtgcagggctggttcatgaacctccttgcaggaagggaagtccctggttatttcctggccctctcccatgcctcctcataaccttgaccacagtcttctctacaccccactcccggaccactggcttgtccatgccccacacctggtcccagacttgccacctgtccctgccctctccccttaggactgtcatatttacctgtcgtgtgtctcagaccttctgatatctgagtcatctaataaacaaactgctaataggacaagatcatgacagacagagactctgtcggcctttcagtggaggctcctttaagtatgcacacttatagagaattttatacacgtagttgaaattgtacatataaacttgcaaattttttctttcttttttgtgggggaggggggagcctgggtctcactctgtcatctagggtggagtgcagtggcacagtcatagctccctgcagcctagatctcctgcgctcaagcaatcctcctgcctcagccgcccaggtagctaggactacaggcacacaccacagcacccagatttctttctttttttttttttttttgtagaaaataaagaagagaatcttgctatgttgcctagcctgatctttaactcctgggctcaagcaatcctcccttcttagcctcccaaagtgctgagattacaggtgtgagccacattgctcgaccacaacttcagtcatatttgtaatgtacaattcaagtgattttgccacactgaccacactcatgtttaagccacgccaacagagttccatgttttctgatgttttttcgagatggagtctcgctctgtcacccaggctggagtgcaatggcgcgatctcggctcactgcaacctccacctccccggttcaagcgattctcctgcctcagcctcccgagcagctgggattacaacgtctgccaccacgcccggctaatttttgtatctttagtagagacggggtttcgtcatgttggccaggctggtctcaaactcctgacctcaggtgatccgcccgcctggacctcgcaaagtgctgggattacaggcgtgagctaccgtgcccggcctttccatgttttaaagaacatattttgccaccccctggtggacagtggctcaccaccggcacaagaggctacacaggcagatgtcaatggggaccaggcagggacaggtattgtcgtgagcctagccctacccgcgcccccgcgagtaaccacatctcctgactgcccaagcgcagatttccatactgaacatgaaattgcctgacttcgaaatggtggcaaatcattcaaaaaaactttaagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggacgtaagcgtgggccgggcagcacggggcgaggggaggttggtgggccaggggtccggccctgtccctgctccgcctccccgacagtgaccccgaatcttttccccagggaccactccccactcctttcctcacgccaagctctgactttccgtgctccacgatcccgcggctccccctccgcacgtctttcccttgtcgccctccccagtcatgacccgggcgtgaccttcagggaccgcggcccgtatcgggatccctgccccgcgaacactgcgcgtttcggctttcgcgcgctcgggtcccgtccccagaggtagcccggccggctccaacttcgggcaaaacttttcatgtccccctcagcgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggtgcgtaggggtagtaggggatccatgtgggactgccgcagactggagccactgatcctgcctcagggggaaaaacccatttcttgccctgcccagtaaggacacatcagggtctggagctttggggccccctgaccccttaggttcctgctgttaggaccatcttcaaagtgcgagcaggattgaatgaatttctggctctgctcctcagtgtgtaagtctgtgaaccgggaaggctctcttttaacacccccggggcagtgcaagggtcatgtgggattgtctgtgtgctgtacctgccttggcacctgacagggtaggtacacgtggctgaagtgtgattttctagaacttttccaggctggtcagaaggaattctgggtatgttctgaagttacgtattttggacctgtgtcccagccaggttccaggtgaagttcacgggagactcacagagtagtgaaagaccattggcctggatgtctagacatctgctttctgggtcctgcatagctgggggaccccagacaaacttggaaatgaaccatctccagttggcaacctcctcttctgtgaatacaggggaaaagacctccctcccccacaagaagcgtctgcaacccaaacctggcgttctgtgaccgagttaaagtttcctcttgggtaaaagatattcttgagccacatccatgtctaggaggaagtaagggcatgagaagcttgaaaggacactgtccaggcacggtggctcatgcctgtaatcccagcactttgggagaccaaggcgggaggttcatttgacccaggagttgtagaccagtctgggtaacatagtgagatgccatcccccaaaacagttttaaaaattaaccggacatggtggtgtgcacatgtagtctcacttagttggcaggctgaagtgggaggatggtttcagcccaggaggttgaggctgcagtgagctatgattgcgcattgcactccatcctgtgtgacagtgagaccttggctcacaaaaaaagaccttctgaaatggagcctttgttagtccatgaaggtcgatgaggaatggctgatcctgctgggtcctccctcaagctacagaggaataatacagtcagccccctgtatcactgggttacgcatctgttgattcaaacaaccatggattgaaatattagaggaaaaaaaattgataattgcatctatactgaaaatacgtatagactttattccttgtcattattccctaaacaatacaactatttacatagtacgtacattatattaggtattataagtaacccagagattatttaaagtatatgagaggatgtgtgtaggttacatgcaaatattacaccattttatgtaagggacttgagcaaatgtagattctggtttcctctggggattctagaacaaatctcccacggatactcagggaaaactgttactctaacaacaagtgttatacacttaccatgtgctaggtcctctacaggtactttacactcatgatcccatttgatccttacaatccctatccactctccctttgctcagacaagacatgctatccccatgaggtagataatctccattatgccaattttatgatgagaagactaaggctcttcatactcccccgccctcagccaggctgtcccaagctgtggcgctcctcactgaaaactgctgtcacctctgagaggggcatgttggcttatggcacagacattagtggtgggggggccaccctgtgcccaacctttgagaaaacaggtgtctgaggtactgtgtccttagggagtctgcaattaggaggaggcagattgcccctcagcccacagactgacagagatgatggagtgtgcagcacacacgatgaggctactgtgttgagtgtctgtcctaggtgggtcatgctgatgtgcagccaccattccacacctgagtgtcccactgccctgctgggggttggggaatgctcattaccgggatgagcacttttgcaaaatgggctgaggtgggaggatcacttaagcccaggaattcaagaccaccctgggaaacaaagtgcgaccccatctctacaaagtcatacaattagcccagcatggtggcatgagcctgtgatccaaactacatgggaggctgaggcagaaggtttgtttaggcccaggaggtcgaggctgcaataatctgagtttccaccactgcactcactccatgctggctgcctttggattgttcctaattggatggttttgctttcaacagacactccaataaagtacacgaaataaagaataaagttaaacagtcagtcccagtgctgtgtaggtggcagtaagtctgggagagcgacctcggctgaactaactgtggtgtgcatcattgttaagcagggccagcaggatcctcatgtcacctggcaggaggagggacagggaagggtccctagaagtgaccttgagttgcacttagtgctcttggcagagggaagggcttgggctagtgctggaggcatgaagatggggtgtgttcagggctctccagcagtccaggcatgggaaggggacgctgagggccaaaggcggaggtgacactgggaagggaactagcaaggtgaggactggcttttggccatgtgactgaattgcctgtgtggtgcgtgtgtatgtgtgcgaatgtcagtgaactgtgtgtgagtgaattgtgtgtttatgtgtgggtgtatatgtgtgtgatgtgagtgaactgtgtacatgggtgtatacgtgaattttagtgaattgtgtgtaaatgtgagcagtgtgaatttgagtatgtgggtggataagtgaattgtgattttgttggtgtgaattgtgtgcctgtgtgtgacggggagtatgtgtgtgtgtgagtgaactgtgtgatgactatgaatgtcagtgaatgctgtgattgtgtgtgtgtgtgtacgtgtgtggggatttggtctatatgtgtgaatttgagttgtgtgactttgttggatgtgagtgaattatgtgactgggtgtatatgtgtgtgtacacgagttaactgtgtgtaaatggtatgattgtatatgtgtgtgaatgtgatgaatcgtgactagatgcgggtggatgtgtgtatgtgcatggtgtgtccatgagtgtgtaagtgtgcaggtggcacagttgcaacaggagagaagacacaggaagccttacctgccattcatccccccagctgtcctcccagcctggggacccctgggctggaaaggttatgaaaagtggtgctactgccaggaaggggtgatggggcagctgggaggacggtttgagtcttgccaaagggagggagtcgaagcttgcaaccctggggaggaggaggggcagactggggaccctgcttctggaaaaccagcgaccaacccccaaagggacacaggcaacccctgcctccactctacagtggggaaaaggggagagtggcgtggcaggctgcccagccagtcatggagggagtagacttcaggaggagtacagaggtctggtcccattttggggctgaggacaggagcctcaggtcagcagtctgcaggaaggccccagctggaccagctgctcacaccttcccacaggcctgcagatgggtgtggagagcagagcctccaggctgagtctcccagccccagatctgagcagtctaaatcatccccctccaggttccctacggtcttatccaccagccctgctgcccatggtggccccagatgcccaggagagataatagaaggtaagaagtcatgtttgaatgaggaagctctcttcatttatttcatatgaggatgaagaagaggattatgtgatcacaggaatgttgcatgcgggataatccaaagctggttatctccaggccctcactctgccaagagatctctctggaagaagcagccagttcacagatgccctggatccctccgtgcccaatcataaaaaagtcatgaccgtccctatcttgccaatctgccaggactccaaggggaaaaagcggataagtatccttcaggagacagagaaaaagatatcatcagctccttggctaataccacatcttgcaagacccctgccaggtactcccactgtgggtactcaggacagcctgcctcagtccaccaggcattttgcaaacctgctcatcccaataatgattttccccaacccccagcagggcagtgggacactcaggtgtgggaggtagccgcacatcatgacccagctaggacagacacacaatacagtagcctcggtgtgtgtgccgtacactctatcatctccatcagtttgtgtactgaggggtaccctgcctcctaattgcaggctccctaagggcacagtacctcagccacctgttttctcaaaggctgagcacagggtgaccccccaccccaccaaccccgccactaatgtctgggccataagtgaacatgcccctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatgcaattatcaattttttttcctctaatatttcaatccatggttgtttgaatcaacagatgcgtaacccagtgatacagggggctgactgtattattcctctgtagcttgagggaggacccagcaggatcagccattcctcatcgaccttcatggactaacaaaggctccatttcagaaggtctttttttgtgagccaaggtctcactgtcacacaggatggagtgcaatgcgcaatcatagctcactgcagcctcaacctcctgggctgaaaccatcctcccacttcagcctgccaactaagtgagactacatgtgcacaccaccatgtccggttaatttttaaaactgttttgggggatggcatctcactatgttacccagactggtctacaactcctgggtcaaatgaacctcccgccttggtctcccaaagtgctgggattacaggcatgagccaccgtgcctggacagtgtcctttcaagcttctcatgcccttacttcctcctagacatggatgtggctcaagaatatcttttacccaagaggaaactttaactcggtcacagaacgccaggtttgggttgcagacgcttcttgtgggggagggaggtcttttcccctgtattcacagaagaggaggttgccaactggagatggttcatttccaagtttgtctggggtcccccagctatgcaggacccagaaagcagatgtctagacatccaggccaatggtctttcactactctgtgagtctcccgtgaacttcacctggaacctggctgggacacaggtccaaaatacgtaacttcagaacatacccagaattccttctgaccagcctggaaaagttctagaaaatcacacttcagccacgtgtacctaccctgtcaggtgccaaggcaggtacagcacacagacaatcccacatgacccttgcactgccccgggggtgttaaaagagagccttcccggttcacagacttacacactgaggagcagagccagaaattcattcaatcctgctcgcactttgaagatggtcctaacagcaggaacctaaggggtcagggggccccaaagctccagaccctgatgtgtccttactgggcagggcaagaaatgggtttttccccctgaggcaggatcagtggctccagtctgcggcagtcccacatggatcccctactacccctacgcaccggtcctggcccagggctagctccttggtgagaaactcaaagaagtgggcgctgtggctgcggttgtcctcggcggtgcccactacgccgatggaggagatggacagctgcgcgcagggctcggtggacccgctcagcgccatggccaggcccggccgtaccgtcacgttcacgcgctgagggggacatgaaaagttttgcccgaagttggagccggccgggctacctctggggacgggacccgagcgcgcgaaagccgaaacgcgcagtgttcgcggggcagggatcccgatacgggccgcggtccctgaaggtcacgcccgggtcatgactggggagggcgacaagggaaagacgtgcggagggggagccgcgggatcgtggagcacggaaagtcagagcttggcgtgaggaaaggagtggggagtggtccctggggaaaagattcggggtcactgtcggggaggcggagcagggacagggccggacccctggcccaccaacctcccctcgccccgtgctgcccggcccacgcttacgtccgcaggtttgcccaggatggaggcagcggcggcgcagagtcgtttctccagccccgcgggcactcggttggcgggcaaattcgtgtccagctccaggaacggcatggcgggcagaggaacggaaacagctctggcggaagaaaagctgggggtacccaaggctcgcggaccagggaggaggggcgaggcgccacagcaacctggcttctcattggctggacagagactcggcgctccccgattggctgcctagggtacctcccgcttctgcaaacaaaagtcacgtgtgccggctgatttccggaagtcccatcgtctccgccctacgtgtagccccacccactacaggtctttaacccggtagtggacccaccctgtctcccccgaccctcctgcctggcgccaggtgggtttccctctcaagcttccgcgctgtggtcgcccggttcctagccctattagaggtctgaacaccacacccccgacacacaaggacacacacacacctataggggtcttccccaggctcgaccctaataaccaatacaacgggagcttaaagtttttttgaatgatttgccaccatttcgaagtcaggcaatttcatgttcagtatggaaatctgcgcttgggcagtcaggagatgtggttactcgcgggggcgcgggtagggctaggctcacgacaatacctgtccctgcctggtccccattgacatctgcctgtgtagcctcttgtgccggtggtgagccactgtccaccagggggtggcaaaatatgttctttaaaacatggaaaggccgggcacggtagctcacgcctgtaatcccagcactttgcgaggtccaggcgggcggatcacctgaggtcaggagtttgagaccagcctggccaacatgacgaaaccccgtctctactaaagatacaaaaattagccgggcgtggtggcagacgttgtaatcccagctgctcgggaggctgaggcaggagaatcgcttgaaccggggaggtggaggttgcagtgagccgagatcgcgccattgcactccagcctgggtgacagagcgagactccatctcgaaaaaacatcagaaaacatggaactctgttggcgtggcttaaacatgagtgtggtcagtgtggcaaaatcacttgaattgtacattacaaatatgactgaagttgtggtcgagcaatgtggctcacacctgtaatctcagcactttgggaggctaagaagggaggattgcttgagcccaggagttaaagatcaggctaggcaacatagcaagattctcttctttattttctacaaaaaaaaaaaaaaaaaagaaagaaatctgggtgctgtggtgtgtgcctgtagtcctagctacctgggcggctgaggcaggaggattgcttgagcgcaggagatctaggctgcagggagctatgactgtgccactgcactccaccctagatgacagagtgagacccaggctcccccctcccccacaaaaaagaaagaaaaaatttgcaagtttatatgtacaatttcaactacgtgtataaaattctctataagtgtgcatacttaaaggagcctccactgaaaggccgacagagtctctgtctgtcatgatcttgtcctattagcagtttgtttattagatgactcagatatcagaaggtctgagacacacgacaggtaaatatgacagtcctaaggggagagggcagggacaggtggcaagtctgggaccaggtgtggggcatggacaagccagtggtccgggagtggggtgtagagaagactgtggtcaaggttatgaggaggcatgggagagggccaggaaataaccagggacttcccttcctgcaaggaggttcatgaaccagccctgcaccccacttgtggaacacaacatcgccccacagtgaggagagagaccgaggagaccaaggctgatcctgattcagacatctttccaccaggtcacccctcatcgatgatacatgctcagtccgggggtatcccccgcaaggaaacactggggctgaggagcccagagaggtcgcctgacctggactggggctggggaggtcagggaagtctccctggagaagagacagggtgccaaatgccaaaagaccaggaagggcaccaggcgaagatgaggagggaacagcatgagcggaggccaagaggccaaggtgggagcccagagaggggttaggagtgtgcaggcagaaggggccacctggaggagtgggagcaaggccttgaatgcaaagttcaatgacttgtactttagcttctgggcagtgaggaaccatacaaagttccacacagaaggtcagggtcaagtaagcgtttgcccaagctcttttcagaggtcacatggaagctagaatggaatggggtaggagacaaaaggaatgcaggcatgatatctggaggaactgtggaccagagcctttgcagatatgtcttctcttcaaccaaggagacggacagctccatgtctttattctaccaacacagcatcccctcagtggctcagcaagtgtgggacacgcactcacagcaagaaaagctgcattaaggtcttcagattctctttaacagcaggttctactggaggcaggtccttggccttcaggacagctgggagggcctcctggaagaggtcctcccgcactgcagcctccacgtgttgggcaccatgctgccaccgtgggtccgctttcaaagactcagcagccagcactgatgggctaggggaagacagagtcagcggaggggctgggcatagccaagtgtaaggcagcatgacctgctttaggggttctctgattggattttccctcctccaccatgtgtgtgatgggctaggatgtccccctccctggggacacttggaagcctcttaatatagctgcggtgaggggtttgtaaagccccattttatagatgaggacactgaggctcagaaggagaagtgactcacacagggtcccacagccagaaaagacaacatgagctgggatgtcagctcccttcccggatacaccactgcccagcgggccaccgcaccccatggcactctcatgcctcagctccgtgattgccaccaagccagccacagagatacggggcccagtaaggaaggcctggtcccgcaggaacttgtcctcgagcagctgcaggcatccgtccagctcagccaaagtggccgccaacatctcgggtggcactgactcgcccaggaacacagggattattatctggtgggccgacaggcagagagaggggtcagggtctgcccaaagcccatcctggttcccaccatcatcctatcatcaccagtccttgggatttctgctcacctctgctcacttctttccactcatagccaccagtagctctcatctcctactcaaacagggacagcctcccccttctccctgggtcctcacacaaggcaaccagtgggatccttctgtaatctcaatctgcccgtaccctctcttgcataaagccttccatggctccccactgccctcatgagaaaggcctcaacacaaagccagccttctccagtgcggtagccatcccctccccacttttcacctcacctcctactaccccccacttatcaaacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaaggcagacacagttaaggtgtggaaacctccttattgcccgatggatcctccagagaggcggtcccttactttcagcagggcgcgtgtctacctgtttcatgctgtctcacacacagggtgccacccctgtgctgggcactgggtaagtgctctgtacatattaattaggagtactcatttcaaaaatatgtgtgcctttgataaataaaaacagtatgtgcatgttgtgttggtgtgtgcttccttgattattactgaagttaaacatgttttcatccatgtattgaccatttctctttgtccttcaatgaaacctctgctgatttccttcgctcatttttttcctgtgtcttcgtctgatgagtttctcttctttttgtttgttcgtttgtttgttttgagacagtctcgctcagtggcccggctggagtgcagtggtatgatctcagctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtgagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttaaccccagccttccagtcaaggttcccaccagtttgggacacctgcaagtgtcacatcccactgggtgaaactctaagatcccttttaggggatcccattcgctccctcccttccgccaccatgcagcgccgagaaacagagctctgaacgaaccctcagatgtccgtgcgctggggcctttccaggacggcggcgcccagtcgtttctgggtcagggcgacgcctggaactgggcagggtccctggcaccgggatcccgaaaagcagacctgcttctccctgtccagccggttccccttccccttgcagtcggccccctgcatccgcgtcctccctgccagtcgagggtccccagctccaactccaccctcccagctgtgcgttcatagcgaccgccctccctgtagggacgcacggatctggtggtggagtcttggccggcaggactggacaggaaccgaaggggcgaggcgggtccgggggtggtgcgctccaattgggtgctgtccccagggggtggggcctgatcccctatttcccggcgcgccgggatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaaggtgggcccagcccgtttccccgcgtgtccacaaacccagtgcacccccaggcccccgccctgctctgccctgagcgtctcgccgcccgcacagccccctcacctcctcctgcagcgtctgccaccagagaatgctgtggactgagtggccttgaagggatcacagcctctctgaaccttagcttgccttctgaaaaggaggataacgttaccttctgctctgtagggatggaaagaaaatactgaatggagttgacagagttcttgcgtggaatgcacgcatataaattcacaaagcccagaagacctcgggaagaaggacatactgttgtgagaattaagagatgggaagagatgagccaccccagtttgcctcccctcccctggcccaccagagtccggctagaaaacttctctttatccacctgctgcacctggccccacccaccaaaaccccccagctgccccggaatgtggcagggcagggaggcccagccagggagtgaggctgatccaggcctctagtcccagaccttgctgtttctcagggctgtggggctccgcttggggaggaggagggagggtgtagaggtgcagcgtttttactctgaagaccttttctgacttcttcctcttcagggcagcacaagagcaaggagttcttgcagatcaacagcctggggaaactgccgacgctcaaggatggtgatttcatcttgaccgaaaggtgccctccttccctcacccctcaccgcatccggagcccatgtgaccttggctctccccactggccccgggccccagtggccctcccataccccatggggcagcgagggaggggaaaggcgagggatctggccgggcgcggtggctcacgcctgtcatcccggcacttcgggaggccaaggcgggcggatcacgaggtcaggagaccgagaccatcctggctaacaccgtgaaacaccgtctctactaaaaatggaaaaaaaagttaaccgggcgtggtggcgggcgcctgtagtcccagctactctggaggctgaggcaggagaatggtgtgaacccaggaggcggagcttgcagtgtgctgagatcgcgccactgcactccagcctgggcgacagagctagactccgtctcaaaaaggccgggcgcggtggctcacgcctgtaatcccagcactttgggaggccgaggtgggcggatcacgaggtcaggagatcgagaccatcctggctaacacggtgaaaccctgtctctactaaaaatacaaaacattagcagggcgtggtggcggccgcctgtagtcccagctactggggaggctgaggcaggagaatggcgtgaactcaggaggcggagcttgcaatgagcagaggtcgcgccactgcactccagcctgggtgacagagggagcccactccagcctgggcgacagagggagactccgtctcaaaaaaaaaggaaagaaagaaaggagaggtatctggggagaaggtacagcttggggtgtgtccgggatgagcaggggctgacagaacatgtccccccacctctcatcttcagccttttctgagccgcagggcctctccactcccagactgaagggtattagaagagaagacaagggaacatttttccactgttgcgcatttgttcaacaaatgctagctgaaaagagcctctagtgacttgtcgcagactacccaatctacccaggccgggcctagaggccaatgccatggcccaagggcacagctcatggtgaggtccagctgctgggcaggaaaaggacaagaggtcaggtggctgcagaggtgatggctgggggcctgtcagacgggggccaaagacattcctcccctcgtgatccctgacccaagcgcgtggacatgcaagggactccacggagcatccactgtgtgccagccccatgcagggttccaggggtccagggagcctattctgagctgcaccgcctcggacaagtcacttgaccattctgaccttgagttttctcttgtgctaaaaggctaacaggagtgtctacctcacagggcggctgctggcatatcacagagatgaggttctcaaaatgcaaagcagaaggtccagccaagagtcggtgcccaaggcaacaaagacaggaggagactcgtaggaggagggggtggtgttggggagctggagatggagggcgaggctggagggcagtccttcaaatgcagagaagcccccgggccccactggcagatgggagcagttaggggtaaatgcctggtgccagtgtccttatagccactgcccatttgttcccagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgaggagagccatctggagagtgattggccatcagggagtagttggcagtaggccggggccatagactgacccactctctgcccccatcaggtgttggggccactcattggggtccaggtgcccaaggagaaggtggaacgcaacaggactgccatggaccaggccctgcaatggctggaggacaagttcctgggggacaggcccttcctcgctggccagcaggtgacactggctgatctcatggccctggaggagctgatgcaggtgtgagctcagcctgtgggcagtgtccctcttcgtgtcacacccatgaggcagacagaaacactgaggactggagaaagccagaactttgcccagaatcatagagcaagtctctggatgatctggggccagaaccctgaacttctgcctcctgcctgggtgtggggtctcaccctggctgctcttgggctctaaggctgaacatactgcctgggcccctgtggtccattcacttaggggctggggaatggaccatgtctctgatacttctgcccatggttccagcattcgggtcggcagtgacaactgggaaagttgtatgcccacaactttttcatccttgtccctacagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaaccaagagttattggttttactacattgttgtgttatacatatggagtaaaagtatgtgctagtaatcctcatcatggttaataacaaagtaacctcacaataacgagtcaacataattgtatcaccagggcaacaaaatgttaagtaagtaaccaattcgaattgcaaactgttaaaggatataggcgatgtttcacagggcatagcaacggtctttgaagtctaggaaacttaaaagatttcttttaacaagcattcatgtcttctaggacagttttgtaataactgcaaatagtaagattatacattgtcacacagacctccatgtatatccatgggatggaccccaccacaatgattttaacggagagaacttgatataaagaattggtaaccaggcattagagaactccgaagacagagagaatccagattaacacggaggtaaacactgcaagaagctaccacccctagggctgggggatcaagggaggaattaggaagaccaagatgctggaggggccctgaagaattcaaacctccaagaaaggtgttgctcatcccccctagcatcaccttccaagaagggcaggtttccccagtttgccctgaggtcttcacaggaggccatgtggctgtggatgcagttctcaaatgtgacagtagatgtcactgctgaccaataaacaggatgttccagacacactctgcgctacctgcccacatgtcttgtggctttggggcctatttcccatgcctgacctgtgcccaccatgtgccactctattgggggacctgccccaataatcacgtagattgtttcctatttttcctaagtgtcggccggcttgagaaataaagggacagagtacaaaagagagaaattgtaaagctgtgcatccgggggagacgtcacacgttagtaggatctgtgatgccccacaagccacaaaaaccagcaagtttttattagggattttcaaaaggggagggagtgtgcaaataggtgtgagtgacagacatcaagtacttaacagggtaatagaatatcacaaggcaagtggaggcagggcgagatcacaggatcacaggaccgaggcaaaattaaaattgctaatgaagtttcgggcaccattgtcattgataacatcttatcaggagacagggttttgagaccaaccggtctcaccaaaatttattaggcgggaatttcctcttcctaataagcctgggagcactatgggagactggagtctatctcacctctgcagtctcgaccataagagagaggccacgcccggggggctgtttataagccgatacctccaggtgcgtattctctttctcagggacattccatgctgagaaaaagaattcagcgatatttctcccatttgcttttgaaagaagagaaatatggctgtgttctgcccggctcaccggtggtcagagtttaaggttatctctcttattccctgaacaattgctgttatcctcttcttttttcaaggtgctcagatttcatattgctcaaacacacatcctgtacaatttgtgcagttaatgcaattattaaagggtcctgaggcgacatacatcttcctcagctgacaggattaagagattaaagacaggtataggaaatcataagggtgttgattggggaagtgataagtgtccatgaaatctttacaatttatgtttagagattgcagtaaagacaggcataagaaactataatagtattaatttggggaactaataaatgtccataaaatcttcacactccacgttcttctgtcatggcttcagccggtccctctgtttggggtcactgacttcctgtaacaccactcctagccggaagtattccaagtaaccattgcaactgtcctgccttaagggtgcctggtgatggcttctgtcttaggtcccattctggctctctcttccagtgatttctcatactttgggggacactctggcctgctttcctgggccttttccattaccaccccctctccccatcaggcactggggatggcggccacagcctatgccttcttgatccatgctggctgccttgggattgttccttattggatggttttgctttcaacagacactccaataaagtacacgaaataaagaataaagttaaacagtcagtccccgtgctgtgtaggtggcagtaagtctgggagagcgacctcagctgaactaaccatgctgtgcatcattgtcaagcgggaccagcaggatccttaggtcacctggcaggaggaggggcagggaagggtccctagaagtgatcttgagttgcacttagtgctcttggcagagggaagggcttgggctagtgctggaggcatgaagatggggtgtgttcagggctctccagcagtccaggcatgggaaggggacgctgagggccaaaggctaaggtgacactgggaagggaaccatagcaaggtgaggaatggctttcggccatgtgactgaattgcctgtgtgtggtgcgtgtgtacgtgtgtgaatgtcagtgaactgtgtgtgtgaacgtgagtgaattgtgtaactttgtttatgtgtgggtgtatatgtgtgtgatgtgagtgaactgtgtgtatgtgggtgtatatgtgtgtgatgtgagtgaactgtgtgtatgtgggtgtatatgtgtgtggtgtgagtgaactgtgtgtaagtaggtgtatatgtgtgtgaatttgaatggtgtgtaaatgtgactgagcagtgtgaatttgtgtatgtgggtgtatgtgtgtgagtgaactgtgtgattttgttggtgtgaattgtgtgcctgtgtgtgtgaggtgtgtgtgtgtgtgtgactgaactgtgtgatgactttgtattaatgtcagtgaatggtgtggttgtgtatgtgggtgtatatgtgtgtgtatgtatgtgaattgtgtgtggggttggtgtgtatgtgtgtcaatgtgagtgagttgtgtgactgttgaatatgagtgaattatgtgattgtgtgggtgtatatgtgtgtacaggagttaactgtgtgactgtgtgtaaatgttatgattgtgtgtgtgggtgtatatgtgtgaatgtgatacatcgtgtgactgtgggtggacgtgggtggatgtgtgtgtgagtgtgcgtggctgtgtgtcgaacagtgtgtgagtgtaagtgtgcaggtggtagctgtggaattaaggcacattaggggaatccttccttggctctggtccttggtttccctcctatgaaacaagttgggtgaattaggcagtctctggcattccaggatttggtctcaggtctaaacaggattttgtaaagtgaaagcagcatcccttgggcatcccgggaggtgtccctgccctccatggctcaccttctgccacatggcccagcagcagctactctgcagggccatgtgctgccatgacaggtactgatccccatgggcgcgggcctgcaggtcctggaggtaccagtggtcaggtgctttgtacatgcagctcatatagagcaagctagccacactggggggacatggcaggggcagaagacatgccctgaacactcttcagccattttctggggcattttcactatccccatgatgcagaggagggatgtgaggctcagagaggttaggtaactgcccagggtcacacagccctacacggggccagattatcatctcaactaatggcagcaaggaagaaacaaaatgtcatgaacttcagcaggggctcagggaaggcttccaggaggaaggggcacccagtgtgagtctgaagaatgagagcaagttgggtatctccccaacatatccaaagcatggacagggccaggagcaaggccagcagggagagagccttccaggtgacatggcagcattgctccccaccccgtcccatctcctgttcacctatggtgaagggttgtgcagtctgacccccagagctcatcatgcctctatgggtgttggaccatccagtgatcccaggctctgaatgtgaatccagctccaccaaggaggcactatgtggcctcggtaaaggacgccaccatgcggccaccaacctggaggctggttttggctttcatttttcccacccacctccaacccttcagcacaccctgcagttagagtttcaagaaaagtcagaaccgaccatcaccccaccaaccctgcaccaccaccaccttggtctggggctccagcgctgcatgccagatgactgcagtggctttctcacccctgccagggggatcctttatgacgtaagtcagatcacagttctcctctgctcaaaatactccagcgactcaatccccctgcggtaagagccaaagccttcccagtgtcccatgctcccctctgtcgtgacctcctgctcttcctgctcactacacccaccctggcccgttgctctccagtctgaaccccatgcattgtcccacctggagccttcgccctcactcttccctccagccagaacacccttctcctcatgccttgcacattcctacagctctctgctcagatgccacttcctccagggagtcttccctcaacatcctactcacacacccccaatcttaccctgtttattttttccatggcatccatcaacatccgatatgttccatgtttacatgggttactgtcagctcccccttctattaatggaatgtgagatccatgaggagaaggacgtagacacgttcactgctcaagccccagggcttaaatggggtctggccctggtggatgtttagcaaatagccactgaagctcgctgagtggtccctcgactctccagggaaacagcacttgccccacaggatttgtgggcaaaatggtagcactaagatgcctggtacagccgctcctcgaaacttagcactctccttttttcggaggggaaggctggcggtgaggaggcccggaagcagactgggccctgtggccttgtgcaagtccctcccctcctccagcctcagtttcctcacttgtacaatgcaggaggggacttctataacccttgtcaacactgggcaccactgcctgcctccacccattcttcaccctggggctggtgcagggcccacagtccatgatccaagccatcaacagtgaacagacagccgactggccccacaaggcccggcagcagcccacggaccggttacctctcagccaaggtgaagtccccatccttcaaggcccggcaccttcctcagggggttcacctgggcaaaggcatcgctgtgctgctggcctgcaggagagatcagagaggtgagtggggataacccagagttctctgaggtctctgcccacccccaccccaaaatcccagcagcagctttctgaggcccctatctgggaggcatcagggaagaggaagcctctctgctagtcactgggtcacagaccttgaccccatcagagggccatctttcctgtgtccagctccttgaagcatggctcaaggacaattccctggagctgtaattcacaccccacccccagccagttccatccataggtcagacccctccagcctcctccctgggctctaggcttgccccctctgattcagcttcctatcccagctggggacttaggccctactggccaggctgggtgacctgtcaataccccagagtcccagccaaacatgttcccaaccctcagaccaacctcattcttgctgggaatccctgccccattcagccactcagcccccggtggctcagctcttcttcctttcttatgccaaactctcaaggctccctccccactgggggttcccaggtctgactcactttagcattctaggccagtgctagaggccgcattaggtgcctggtgtttggatcagaggacctcagtcaagccaggctccagtctgatcataggcctacatgtgggcctctttgcccttctactgaatggacatgcacacccctgcccattctccctccacagactgcttctgtgtccagcccctgttctgtagcaggtgactcaagctggttgtaccaagggcagcagttgggaagagtcagctgagcagggtcctccctctggcctgcccagggggctctggctctgctctctgccctactgcttagttatagccctgcctcctccactgaattgtgctccagctgcatctctgtatgccagccagaccagcaaacgctggagctcagggtgagggtgctggcctcccccactgccctgccacagggccctccagcctctagcctctaggagtagccccttcagctgggtgagaagccccatgggatagagcaagtcagatgcaggaaaaagaaaagacagaagaatgccaagaaatacataaaagtggaagagacccagggccagacatggtggtgcatgtctgtgatctcaacactttagaaggaggaggcaggaggatcacttgagctcaggagctcaaggtcagcctggtctacatggcaaaatcacgcgtctacacacaccaaaaaaaaaaaaaaaaaaagtagctgggcacggggacgtgcctgtagtcccaactattctacttaggaggagtaagttgggaggatcacttgatcctgagaggtcaaggctgcagtgagccgggatcatgccactgccctctagcctgggctgcagattgagacactgtaataaataaataaataaataaataaataaataaataaacaaacaataaaaaagtggaagagacacaggcaggggtagacagggactattttacttaggaaacaacgaggcagtttgttttttccaagcacatggggtgaagatattcttgccccactccatttccctaccctcgttctgtgcctgctgtgccctctctaaacctgtattttgaagaatgttttgtattcacaagcaaagatcaagcctctattaaaatagacaaccagtggggcatggcggctcatgcctgtaatcccaacactttgggaggccaaggcaagaggatcacttgagcccaggagttctaggccagcctcggaaacacagcaagacctcctctcaataataataataataataataaattggccaggcatgtcggtgggcacctgtagtcccagctacttgaggggctgaggcgggaggatcgcttaagcctggaaggtcgaggctgcagtgagccatgattgtgccactgcactccagcctgagtgacagagttagatgctgtctccaaaaagtaaaaataataacatagataattatgtaatagtttccacaccggagagtctgattcttcgtgttagtctgcattcttggcccgactgcaaagcagcggggacaggcagggattcgtggccaatatcccctgggcctgcctgcccagcccagctttggtcagctccactgtgcgaagctcgaaggggatgccattcttggcgaagatgtagactgaacggcagggctgggacagcagacccatggcgggggcaatggggtggggcgtcggagggcagacctaaacccaggggacgggccctggggacaaacccggggacaggcccgggaacaggaactgcgggcaggaatggctggttgggggcggcggacaggaacggctgggggtaggtgagggatgggcaggaactgctgggtcaccgagcctgcagcggtgcacctcaccaggagccccgagtccggccacgccctcttcactcatcccttggctcctagaactttgggtcaatcagtggcgtgtctgctctctcaccacccctttctgggaatctaggctgcaggtatatttcccactaaaagggaagaggagaggctgggcgcggtggctcacgcctgtaatcccagcactttgggagaccgaggggggtggatcacgaggtcaggagatcgagaccatactggctaaaacggtgaaacccgtctctactaaaaatacaaaaaattagccgggcggggtggcgggcgcctgtagtcccagctacttgggaggctggggcaggagaatggcgtgaacccgggaggcggagcttgcagtgagccgagctcacgccactgcactccagcctgggcgacagagccatactccgtctcaaaaaaaaaaaaaaaaaaaaggaagaggagaaaggaggtgcagcagcctccttgcccagtgcctgggcccagtgcccaggacggaggccagagaggaagggtggctgactgcctgcggggctgccagccccacacctcatgaaggaatgagctgtccctccccagttgctggggtcatatttgttacactctagctaacgcctccccgagatggctgaggccctgtgaggcctatccagaggtttccaacagtgcctggcattgcacagtaaattaatcaccatgacacgagttttgcaaaagagaaaagatttattcacagggcaccaagcaaggatgtgggatagtagctctcaaatccaccttcccgaaaataaggcttagggataagccttgcttccaagcagtagagcacaggccccagccacgctccagggtaggggaccatacaaggatgtgaatagcagtgtcggccttgtgggcctacaacgcagaagggccatgcacttggtttaaagctttgctgttgccatcttaacattcttaacaagttaaaaataagggtccccacattttcatttatagccagtcctgtccaaggagttcaaagatctcatgagggtggacagggcactgtctgctctgggcagtgatgggaccactaacagttgttctccagtctcccagcgcctaccccagggacacaccttcccctggtctctactattctttttttttttcgagacagggtcttgctgttgcccaggctggaatgagtgcagtggtacaaacttagcttactgcagcctcgacctgggctcaaacaatccttctgcctcaccctcccatgtagctcagaccacatgcgcatgccaccaatctgggctaattttttgactttgtagagacggggtcgcactttgtttcccagggtgctcttgaattccttggctcaagtgatcctcccacctcagcctcccaaagtgctgggattataggtgtgatccaccacccctggcctctctcacattcttgacatttaaagttaccatcattgacaaggaacatgggtacactccaatttactcaagaaaaagctcttttctccattgaagacatatgtggcctagctgcttcatattctagttgaggtcttcttgttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagtagcagccttgcctgggagcttgttagaaatatactaacaggctcccacccccaaacccagacctactgaatcagacagagtttattttcataagatcctcaggtgatccaaatgcaccttaaactttgaggagctttgattcagaacctgggctggaggcccctaggggccaccttgttcctcacagactgcaaggtatgtttttttcttgcctcttctctctgtcccaatgtctccttctctctgtgtctgaccctgaggaccctgtgacatcctcccaggggagtttccactgccaaaggcctgattctctagaaactgatgggctcctctagacaccaatctctacctgggctcttgttgaagaagccaatcagctcattggttggcgatcacgtgatatacaacatggctgccttccaagccttatgtgtggacaaggagatagggacaagtaggcatatcatgttctgctacctggtccatcgtctctcctcaggcccccaggatacacgtttatggggagttttcctcccttcccccaatatggtcactcataactttacacccaacagtcaaacaggggtggaagctacagggtttcatgtaaacaataggctaggctgtggggctgagtaaaaggcactggactgtggtaggtcttactccaagatggccaaatggaagggcttttagctttctttgtttttgttttatattttgagatataatgttcaaatttacacttcagaataaaaaagagccacaatttatgcttcatattttttgtagcttcttccctatgcttttgaacaatgtaatcatattttcattatcagatataattcccataccataatatccaccctttcaaagtatactttaaaattcaattggtttaaagccaattcagtggtttttagtatattaacaaagttttgtcaccatcacagttatctaattctagatcattttcatcacccaaaaagaaactctgtacccaataaagagtcactccccattcccctcttcccctagcccctggttaccattcatctactttctacctctgtggataggaagtagctgcctattctggagatttcattcaaatgtaataatgaaatatgtggccttttatgactggcttctttcatttagcataatggtgtcaaggttcatccatgttgtagcatataacggtacttcatcccttcttatggctgaataatattcaattttatggactttttagcaaaacattctaatttttacttctctactgtgcttattgtttgtctttctccacaacaatgtgagcactaaaggcagacatttttgcctattttgttcactactgctttttctgcaccaaacgcattgcctggttgtgggtacttttctagttttaggaaggagaagacaagatataggtcctgactctggttctgcctctcattcatatgctacccttccccttgaagaacttgtttcttcatctacaaaatgggcataatactactactcatcagggtggttgtgaggattaaacaaggtaagagatgtaaaattgcatgttagttatcagatagatttgtgttcccatctagctccaatgagggagaggatttgctctagtctgtccctctgggctctgggcttctaatgggcagacagcttcctccatgatgtttgtagctgttaaggctggcgtagtccctcaagacaagttttttttttgtttgtttgttttttttttgagtcagagtatcgctctgtcaccaggctggagtacagtggtgcgatcttggctcactgcaatctctgcttcccggattcaagcgattctcctgcctcagcctcctgagtagctgggattacaggcatacgccaccacacccagctaattttaagacaagcttttggaattgaactgctgatggtcttccatgaacaattcaacagaaacccagtagcgtacacttccttgtatgcacttgcaccctctctttacatttattacacatttaatgctacctaataattccctatacttttactttatccaatcgttcaacagattccaaccgaaatacatagaagagtgatattccaacttcatcagaccctgagattctatttttaacatttcttccatggattgttgaatgtttccaatgattgatccaccttcccttggccttttctacattacagatttggtggcatgtccatgtctatgttgccaaacttgcctcatagacccagcttgaacacaagatgggtgcttgctgaagagcaggactcattctgttgaacctgcatgttttctcaggtcagattgcttggtggcgcttctttaatttctttcaacagcacattgtagtttgctgtgttgaaatgttgcttttctttggttaaatttattctattttattctttttgatggtattataaatggaagtgtggttttaattttgtttttcatcctttattgcaaatgtatactattgatttttgtgtattaatcttgtaccctgcaaccttgctgaacttattttattttattgagatggagtctcagtcagtcacccaggctggagtgcagtggcttgatcttggcacactgcaacctccacctcctgggctctggtgattctcctgcctttgcctcctgagtagctgggactacaggcatgcgccaccacgcccggctaatttttgtatttttagtagagacggggtttcaccatattggacaggctggtctcaaacttctgacctcatgatctgcccgccttggcctcccaaagtgctgggattacaggtgtgagccaccgtgcccagccttgaacttgtttattagctctaatggtttttaagtgagttaagaatttctgtaatgtcatctgtgaatagagatggttttacttctttctttctgatctagattccaccttgttcctttttcttgcctaattgccctaataagtagaagtagtgtgaatgaacattcttgtcctgttcctgatcttaggggggaaacgcttgatctttcacaatggatgaagtatggtgttagttataggtttttcatagatgctttttgtcaagttgaggaagttcctttctcgtcttcatctgctgagtaattttatcgtaaaaggatgttaggttttgtcaaatgccttctgtgcattaggatgatcatgtgactttctattaacatggtatgctacactgattgatttttgtatgttgaactgcatttgtactcctgggataaatcctacctggtcaaggtgtatgatccttttaatatgctgctggatttgatttgctaatattttgctgaggatttttacatctatatttataaggatattgctttgtaactttattttcttgtaatgtctttttctgtctttggtatcagagtaattctggcctcatagtatgagttgaaaaatatttcttcctgttttatttttttggaagagtttgtgaaggctttgtgttagttcttcaagcttttggttgaattcaccagggaagccatctggtcctgggcttttctttgtggaatttttaaaaataattaatattttaatctctttatttgttacaggcctattaaaattttatctttcttcttaagtcagttttggtagattgtgtgtttctaaaattttcccatttcatctaggttgtctaaattgtccacatatagttattcatagtatttctaaacttttgaatttctctatgaccaatgtgatgtctccattttctttctttctggtttccatttcattttttcatttttgtttttgtttgttttttgagataaggttcttctatgtgcccaggctggagtgcagtggtgcaatcatagctcggtgtaaccttgaactcttggactcgagtgatcctcccacctcggccacccagttagctaagactacaggcttgcaccaccacaccaagctaatttttttaaaaaatatattttttagaaaaaagtctcattgtgttacccaggctgttatcaatctcctggcctcaagtgatccttctgcctctgctttccaaagtgctgggattgcaggtgtgagccattgcacccagcctccactttctttcttggtgaataatttgacccttatttttttcacttggctattctaagtaaaggtttgccaattttgttgatctttgcaaagatccaatttttggttttattgattttattgcttttctattttctatttcatttatctccattctaatctttattatttcctgttttctagtggtgttgggttgagtttgctcttatttttctagttccttaaggtgtaaagttaggttattgattcaagatcattcttctttaacttatgtgtttacagctataaattttgctcttagaactgcttctgctgcatcctataaatctgggcatgttgtgttttcatttttatttgttcaggatactttttgatgtcccttgtgatttcttctttaacccatttgttgtttaagagtgtgctgtttaatttctatgtgcttgtgagttttctagttttccttctgttcttgatttttaactttattccactgtgtccagagaacatactttgtgtgatttcaatcatcttaaatttgagacttaggaccaaatatatgctctatactggagaatattccatgtgctctttagaagaatgcttattctgctcctgtcgggtggaacgttctgttcatgtctagtgtatgcgattggttaatcgtgcttttcaaattccctatttccttgatggtcttctgtagtttttctattactgaaagtggggtattgaagtcaccaactattattactcacaatgtaaccatatttaaccctttacttttaaaattctttttggaaactggaaggatctgtaaccaccacccactcccacatcagaccctatgcatatgccaactgtctgctgctcagcagctgtgatggttgttccagttctttattaggcaaagaacagttgtttttttgtttttttgtttttttttttttaacatttcctttaaggaaggtggctcagattgctaagccagccaggccctgcgggacaggctgcgcctagggtcacctgctcttcttcagcaactcagaaatattctccttgaccattgaatccaatgttgaaaagtcccagtcggccaactgcattagtcgatcatgggcctccctaaagaggccagagccaatattcagctccacctgcatacgccactcagctagcttggagctgttgaggaagacattatagttggctgccatgggctgtagatagacgaagacaaagacgtggtcagcctggggaccagccccacctgggtcctctcccacagcctcaggcccacgtccctaacatctacctatgcaaagaattaggctgctgacccccaaggcctgagcaaggggtcacagactatgtaatagatgtaggtggggatggaggatccagaatccctcagagtcctcagtcactggtcttcttgctccaagccttctgaaccatgctgagagggctcctggcccaggcacttcccacttctccagcctgcgacctcgcatgaatcctgccttcttccagggaaaccccttatcccaggtgtgtatatgtggatgagggagagaactcaggttttttcctccatgtttagcctcccactgtgatcaagctcaggggctaggatgggagacctggcgggcagtctaccctgcagtttcgctggcttactaagagtttggtttgcacccaagatctttgggaagcccaagaatgggtgtgtgtgggtgaaatgtaaggggtggggacgaagcatatggctgaacccttggggcaggccagaatgatttttcctggtgctggtctgccctgcaaacagaccaaggagactaattttcatatcagccagagatctctgggataaggaaaagaatactgcattttctggtcaatccaccaggaccccaggtccctcctctcgggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttcctcccctgttatctttgggatcagcaactggccagggttgggaagaggagggaagaggaggctgcactccagggccacctgccctgccaggtctctgtactcttgtctgctggatagatattgaacacttcccaggatataaagcagtttcacctcttttagcagttctgattggtggaagttgctgggaaccatgtgttcacaaggatttggggagctcagcaggcataagtcctgtgattgattagtgatgtctgtcacaggcatagaattcaaagtagagacacatgtactggttatttgtcatcttctaattttctataggccatactcttttttgtttttgttttttgagatggagtctcactctgtcgcccaggctggagtgcagtggcacaatcttggctcactgccaactccaactcctgggttcaagcaattgtcctgcctcagcgtcctgagtagctgggattacaggtgcccatcaccacacccagctaataattttgtatttttagtagagatggtgtttcacaatgttggcaaggtaggtcttgaactcctgacctcaagtgatctgcccgcctcggcctcccaaagtactgggattacagttgtgagccaccgtacccggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcaggtctggcgggcaccagtgcgatggtgcgctgtacttgcggcacaggtagtaaaggatggccgcgctgcagaaggggccggtcaggggcactgcccttgccttcctgagtgccactacgtcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacgtagggtagcccctggaggtgcagggaggttatggacttaatgcttaagattaggcattatataagccagggcatgaaaggatccatctctctggtgctggatggagggtgagcccgagggggcagaatggacaatgaggtggcgggccagcaactatcgggaaggttgtggtgtctggggatggtggaggccatggggacagagggaaggggacggaggggagacatgcttcggaggggatgtcctaggccttgctgattgatggctggtgtgggaacctccgcagcacaagggctcctttatcatcaccaacagcaaccatgccaaggtaaaaaggtcagggcatggagagagctatcggttaaaaagtggcaggagagacagcaactggctgcaagactcagaacttctttggatcctgatccaaacaaactgccaagaaaatatttaggagataatcagagagttttgaacaggagccacgtattagatgaaatccaggaattactgttaattttatgaggtatcttaatggtatcgtagtgatgctacgctctatcctagcccaggctggagtgcagtggcacaatcagagttcactgcagtcgtgaactcctggcctcaagcgatcctcccgtgtcagcctctcaaagtgctgggattacaggcatgagccaccgcgcccagcctgttgctttttttttttttttttttttttttttaaagaacgcttatctctaagaggtatgttcctgaacgtttattgatttatttacttacttatttttatttttgagatggggtctcactctgttgcccaggctgaagctcaatctttgctcactgcaacctctgcctcccgggctccagcaatccctccacctcagcctcctgagtagctgggactacaggtgcggaccaccatgctggctaacttttgtattttttgtagagatgggggttttgccatgttgtctaggctaggctggtcttgaacacgtgagctcaggccatcccctcacttcagcctctcaaagtgctagaattacaggcatgagctggcccctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgctcgcactgaacctcccaggaggagcagagacagatggtgcaagggccccagggaagacttacctttcacttaagataaatttcccatctttgaggctgggaagcttcctgagggggttgatgtcaatgtattctttgctgtggtggtgacctgggaggagcagggaaggtctgaggctgtgggactccaggggagagagaactgagactcccagagacacaaacgcctccctctctattttctcaagaagagaggactgaggcccggagggacatggcggctcaccccaggtcacagggcaaggcagttgcagaaccggactgggatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagttttggagtccctctgtgctcgggatggagttggagcccacccctctgaccctcactcgggagcagtggagccctgagcctttctgaacactggggaggatgggtgtagacggactgtgcacttctgccccctttgccaacctggtgggcaggtgctgagttcacaaggtcctagaatcccacaacgaagccagggtgcctggtgggagcccagggagtcccagctgctgttcattcccccttctcctcaaaaagcctgttcatctgtggcgtggggactatcattagtggggagtggctaaggtaggctaggcagggacgcagcctacaagccccgtggcatcttttccttccctgtggacctctggggtgattcccttgtctctgtccctgcttctcagaaatgcccctatcaatctgagcgtggtggctcacgcctgtaatcccagcactttggaggctgaggcggggcagatcacttttggtcaggggttcgagaccagcctggccaacatggtgaaactccatctcgactaaaaatacaaaaaatgagccgggcatggtggcgtttgcctataaacccagcaactcgggaggctgagctgggagaatcacttgaacccagtggagattgcagtgagccaagatagcaccactgcactccagcctgggtgacaaagtgaggctctaccaaaaagaaaaagaaaaaaaaagctccaatctgtgtgtcctgcctccccccaggaccaggcctgccaggcagcagtgggagctgacctttcagcagatccacaaactgaaagttgaactggatgtcatgcttcttcgagaagatgtagacggcacggcagggtgctgacagcaggtccatgtagagctccagggccatgttgagacacatgccaggccccacagctgcagctggccagccacagacctgggcctatgtctggccagagtccctggccctgtgccctctccgatctgggcccaggaccctgcattctggaacctcttgtttccctttgtgttgtcataaggccaggaagcctgcaattctcacagcatcaaggattctaaggaggcccaggagtaggctggcagaggcccgtggcaaaggtgtggcagccgtgaccctactctccccctctcacgtgtgtctgtgtcccgtggcgccacctcacagacaccctgtctgagaagggattatgcctgggaattcccagggccggactttgattgcagaacctgacgaaaggggctttgcagggtccagaatgaggaggaggcaatgagaattatccctggaggattctagaagtagaggctgggagcatccacaggtgaatggagcctgaactatgactagaaaggaattgggagaaagagacacaggaacctgggagcttcgggagcagtggggacaccaccaccaggaagtcagggggcactcggcaatgaaagtggcagatgcaataaaacttttaacatattgttgtataatgtacaataatgtaataaaaatacaccccctatacattattgttccaactctagctctatctattgccctcctcatatgaatccctctccccataccccattctctagttaatcttaactaggcctcctgtttatattagccacatcaagcctagctgtctactctatcctgtgatcaggatgagcatctaatttgaaatatgcactcatcggtgcactatgtacagtggcccaaacagtctcatatgaagtcactctagctattatcctcctatcagtcctattaataagtggttcatttaatttgtatatactcattggaacagaagaatttctctggctgctcctaccatcatgacctctggccataatatgacttatttccacactagcagaaaccagccgagcctctttagacctaacagagggggaatcagaattaatctcgggctttaacgtcgaatatgctgcaggcccatttgccctgttctttatagcagactatataaatatcattataataaatgccctgaaggccgcaagaggttcgtgggtgcagtgcacaggagaccatatctggggacagcagctgcagcagaccccaagctgggccatccctgccacttgccaggtggtgcttggcgaaggcaagcagctcccacccgcccggggaatacagcgcgacccccggcggcatgctcttcagcaccaccccaggaggtaccaggatcatctaccactggaaattcctgatggagtgttgaaacttacccgtgaccaaaacactcccaagggatctgcccaccattcccggggtcaccagccctgccagtgatgatccccccaacggaagccagccagagccacctgagcaatagtccagaagataagcagggcgggcagtgaagaagcacagttttgagatggacatttaaagcaccagccatcgcatggagcactgccaagggacccctcaggcccttcctggaggagtcccaccagccaggccttatgaaagtgatcatactaggcaggcattggtgtggggccagtcaccccagccctctctccctcactcgcggcacctgccccctcctctttgtgaacaccagcaggtacctccttgtgcctccgctgatgcaggagcagctgccccaaggggagtaacccctgccagcacaccctgcagctgagggccaggaagtggacaagaatgaaccctttcttccaaatgatcagctcttccagcccctgctgggggccccacgaccccttccttaggttgacgtgcctgggaaagctcacctccccctcttccctaagagaggaaataaaagccaccttcgccctagggcaaaaaataaataaataataaatcccgtaatcactattgtcttcctaggagcactgcataacatatatataccagaactctataccacaaatttcgtcacccaaactctcattttaacaagtctttttttatgaattcgaacatcatattcctgattccattatgatcagctcatatatctccttgaaaaaattttctaccactcacactagtactttcatatgacatatcttcatgccagtcctaacctccagcatcccaccccaaacataagaaatatgtctcacaaaagagttactttgatagaataaattacagaggtttaaacccttttgtttctagaattacaggaattgaacctacccatgagaatccaaaattctccgtgctacataatacaccacatcctatcacaccccacagtaaggacagctaagtaagctattgggcccataccctgaaaatgttggttatacccttcctatactaattaatcctccagtgtatgccatgcagaggagcccagaaacttcctggcctgggttggggctgcagtggccagactgtgcacctggtggcccaggaaggtaactagagccccacgtagaggactgagtgccactcactctatgctttgtgatttaataggtctaggctcagaaatgggactgatcccacttccagtgacagagtaagcctggagacaagcgaagagcatgcagtgtgtttattgcagacagcagggtgcagtgcagtgggctgtacccactcagtggagccactcctgcagcaactgcacctgcttctgggccagctgggggtcctgccgagcctcactgtggttcagaggctggagtatgagcttgtgggcctccaggaagagctcagtaccaagggcagccttcatatgggcctgtcacactgccagccagggccagtcttggaagaggtcgcagccaacggcagtgggctgggaagacagggcagctggggttggggctcagccccatgcccagagtccccccgagggcaggtgggtaggaaagcttcacctgcatcacctccgtcagcaccaagtcttccagggagatctgctccattgccaggaagggcctggccaccaggacccccccatccaggtgctgcagggctggcgtcagcctccccaacagccgctccagctgtgcagcatctgcaggctgtctggagaagtggggcaggagagactgggctgtgaggagaggagcaacttaacccagactcttggaagcctcttgggcctcctctccatcccttcccggctgccattcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtaccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatctgggtgacctacgtcctttccccatctgggcagctccagctggcttagactctagccaggttccagcctccagctttagcccaaaggtgcccctgggtccagcctctgcatcggagctacacaggctgaaatgaggaaggggccacagtgatttggaaagatctccaacccaaggaaagatctcccctctcgcctctgcctccccctacaactctgagccccagaacccaggcagatcctggctctgaccctgggtgggcaccaggtcaccattacctctctgctagtaggaagtcgccatctctgagggcaggcaccttccccagggggttcaccttcaggaactcaggcttcaggtgctcccctggtgggcagaaaggagagaaggctcagtgcagggcctggtccttggcacccactccatggggcccagcccagccacctggctcaccccaagccaactccactgtctgcagctgaaaagggatgtcattctgcctggcaaaagtggatagcatggcagggggctgagtgcatgtccaggaacagcttgggccccattgctgctcctcccacctgccctccccagaggtctgtacctccaggagttgctcagcccttctcggccagtgccttcccccaaaatggggccagaactctgtactcctcctgaagcctattccctccatgactggctgggaggcctgccaagcccctctccccttttctccacctctgtagagtggaggcaggggtggccagtgtccctttgggggtttcagatagaaactcaatgacaattggcttagcaaaaacaaacaaacaaaaaaaaaacaacaaaaaaaaaacaaagggagtggggtgggtggggagatttctcagaaaacttctccagtcataggaggggaggggtgtagaagccactaagagaactggaatcagaacctgtttctgtctccccacttttcctcccctctcctcctctcccctccttcccctcctgtcccctcccctcctctcccctcccctcccttccctttccttccttcccttcctcctttcctcccttctttctttgagacaggatctctgtctccctacacttttttcttttaattctctgtctctttcttgacatagaatcttgctctgtcacccagcctggagttcagtggcacgatcatggcttactgcaatctccaagtcctgtgctccagcagtcattccactacagcctctggagtacctaggactacaggtgcacatgaccataccccactagttaaaaaaaacaaaaacaaaaacaaaaaaacccttgggcctggcagggcggctcgtgcctacaatcccagccctttgggaggccaagatgggctgatcacatgagcccaggacatcaagacgagcctgggcaacgtgccgaaacccagtctctacaaaaaatacaaaaattagctgggcatggtggcgcatgcctgtagtcccagctactcaagagactgaggtggcaggatcacttgagcccaggaggcagaggttgcagtgagccaagatcacgccactgcgctccagcctaggcaacagagccagactctgtctcaaaaaaaaaaaaaagagagagagacagatagggtctcactatgttgtccaagctgatcacaaactcctggcctaaagtgatccttgggtctcagcctcccgagctgattagctgggattgcaggtgtgggctaccacgccctgttatcactccctttctctgagtcagcttttctctctcagactagcctactccatgaactcaggaaatgtcactacaggtggccccagctcccatttacctccccatagggagctcctctctccagttccaatttcaaaactcccaaggaagcattctggttcactcgcttgggccactggccagagggatgggatactctgaaagattcagctagagtcccgggcccagccctggaccatcactgtgcaccctggttagatgccagggctgggattcagggagaagaaaggaggttcccggacagtcattcctgcctcctgcggctgcgggctccctgcacagtcattcctgcctcctgcggctgcgggctccctgcccccatcctgtgcacgaagtgggagctcccgctgtctggcagcagctgctctgcaggggacagtctggacggcagaaagttcatccttaaccccagccttccagtcaaggttcccacaagtctgggacacctgcaagtgtcatatcccgctgggtgaaagtctgagatcccttttagaggatcccattcgctccctcccttctgccaccttccagctccgagaaacagagctctgaacgaaccctcagatgtccatgcgctggggcctttccaggacggcggggcgcagtcctttctgggttggggtgacacctggaaacatgtaaggtccctggcacagggacccctcccagtttcaagcgattctcctgcctcagtctcccgagtagctgggattacaggcgcccaccactgcacccagctaattttttgtgtttttagtagagatggggtttcaccgtgttagccaggatggtcgcgatctcctgacctcgtgactagcccgcctcagcctcccaaagtgctgggattacaggcgtgagccaccatgcagggccaatttttgtattttcagtagagacagggttttaccatattggacaggttggtctcgaactcctgacctcaggtgatctgcctgcattggcctcccaaagtgctgggattacaggcgtgagccaccaagcctggtggtaatttataaggggtggacatttgttggctcatggtcctgaaggctggaaagtccaagatcgaggggccagcatctggccagagctttcttgctgtatcatcccctggtgaaaggataaagagagggtaagagagagcaagaggctgaactcacagcctcaaagtccttttataatccacatcaatccatctgtaacggtggaggcctcatgagataaacacctctcattaggccccacctcccaacactgttgcattggggattacatttccaacacatgctttgtgggggacccattcaaaccacagcacagggacaccttctctttccttcctgtgatatgctgaataatgacccctaaggatatacaagtcctgatctctggaacctgtgaatattaccttctgtggcaaaagggactttgcagaattgattaagaatgttgagatggaggcattgtcttggattatctgagtgagccctaaatgcagtcacaagtatctgtgtaagaggagacagacggagatttgaaacagaagacaggagaagatggaagcagagagatttgaagatgctacattgtgggctttgaagatggaagaaggggctacatgacccaagacaggcagctccaaaagctggaaaaattgaggaaaccaattcccctctcagagcctctggagggtgtgcaaccctattggcacctgggttttggcccagagaaatagattataaagttctggtctccataactgtaagagaatagatttatgttgttttaagccaccaaggtggtggtaatttgttataccatccagaggagaggaacacagattttggtgccaggaagcagggtgctgctataaaaaagaaaatctaggctgggcacagtggctcatgtctgtaatttcaacattttcggatgccaaggtgggtggattacttgagccctggagtttgagactagcctgggcaacatggcaaaaccccgtctctactaaaaatatataaattagctggggatgggccgggagcagtggctcacgcctataatcccagcactttgggtggcaaaggcaggcggatcacgaggtcagaaggttgagaccatcctggcgaacatggtgaaacccagtctctactaaaaatacaaaaaattaaccaggcgtggtggcgggtgcctgttgtcccagctactcaggaggctgaggtagcagaatggcatgaacccaggaggcggagcttgcagagagccaagatcgtgccactgcactccagcctggggaacaaagcgcgactccgtctcaaaaaaaaaaaaaattagttggggatggtagtgcatgcttgtagtcccagctactggggagaccgaggtgggaggattgcttgaggctgggaagtctaggctgcagtgacctgtgactgtgacactgcactccagcctgggcaacagagtcagaccctgtctcaaacaaacaaacaaacaaaaatctaaaaatgtggaagtagctttaaatttgggtgatgtgcagaggccagaaaaattatgaggcccatgatagagaaaacctagattgccttgcacagattgttggtagaaatatggatgttaaagactatagggagggctcacgagtatcaactaaacatggtcagagcaagtctacattgccttacagcatacctaagtcatcataggcagctgtaggtagatatatagatattggctgggtgcagtggctcacgcctgtaatgccagcactttgggaggctgaggtgggtggatcacctgaggtcaggagttcaaaccagcctggccaacatagtgaaaccccgtctctactaaaaatacaaaaattagctaggcgtggtggcatcccagctactagggaggcggaagcaggagaattgctcgaacctgggagacggaggttgcagtgagccaagattgcgccactatactccatcctgggcgaccaagcgagaatctgcctcaaaaaaagaaaaaatagatattaaaaatcctgctgctgaggactctgaagaaatgaggaacgtgtttctggaaactggaggaaggaggatcatttcccagaaaaggagcccgtagggaggtagaaagcttagttgaattgtgtccgatagttatatggtgggtgaacttaaagcaacgaagttggatatttagctgaggagacttccaagcaaagcgttgaaggtgaagcctcatttcttcttgctgtttatggtgaaaagcaagaggaaagtgataaaatgaggaaaaagctgttaagcaaaaagaaaccaaggtttgatgatttgggaaattatcagcctgtgcagattgcaaaagatgctaaaattagaagattcgctgtttggaaaacacaactctatccctgtcctggggatcactcaagacttgtatccatagacaaccagatttctatgggcttgaactctgtgtgtgtgtgtgtgtgtgtgtgtgtgtgtgtgtgtgtgtgtgtgtgtgtgtgtgtagcaaggttgggggagcacagtggaaagaccttgaatttatttgtttattttttagacggagtcttgctctgtcgcccaggctggagtgcaatggcacgatctcagctcactgcaacctccacctccagggtggttcgagcgattctcctgcctcagcctcccgagtagctgggactacaggcgtataccactatgcccagctaatttttgtattgttagtagagatggggtttcaccatgttggtcaggctggcctcaaattcctgacctcaggtgatcaggctggtctcaaactcctgacatcaggagatccaccagcctcggccttccaaggtgctgggattacaggcatgagccaccatgcccagccttattatttatttatttatttttgagacaaagtctccctctgtcacccagactggagtgcagtggcgcaatctctgctcactgcaacctctgtctcccaggttcaagtgattctcccagctcaacctctcaagtagctgggactacaggtgcgcaccaccatgacctgctaatttttgtatttttatttatttatgtattattttattttatttttccataagttattggggtatgggtggtatttggttacatgagtaagttcttttgtagcaatttgtgagattttggtgcacctgtcaccccagcagtatacactgcaccatatttgtagtcttttatccctcaccctcctcccactcttcccctcaagtccccaaagtccattcttatgcctttgcgtcctcatagcttagctcccacatatcagtgaaaacataagatgtttggttttccattcctcagttacttcacttagaataatagtctccaaactcatccaggtcactgcaaatgctgttaattaattccttttcatgactgagtagtattccacatatacatattccatatatattcattccatatatatattccatatatgctcattccatatacatattccatatatgctcattccatatacatattccatatatactcattccatatacgtattccatacgtatgtactccatatacgtattccatacgtatgtactccatatacgtattccatgtatgtattccatacgtatgtattccatgtatgtattccatgtatattttccatatgtatatattccatgtatatattccatatgtatatattccatatatattccttatgtatatattctgtatgtatatactccatgtatatattccgtatatctatattccatatatgtattccgtatgtatatattccatatgtactccatatgtattccatatgttccatatatattccatatattccatataaattccatatattccatatatatcccatatacattccatatattccacatatattccatatacattccatatattccacatatattccgtatattccatatagattccatacatttattccatatatattccatatagattccatatatattcagatatattccatatttatattccatatatggaatatatatgtattccatatatatgtattccgtatatgtatgtattccacatatatattccatatatgtatgtattccacatatatattccatatacgtatattccagatatatactccatatgtatatcccagatatatatattccagatgtatatattccacatatatattccagatgtatatattccatgtgtgtatattccatatatgtatattccatgtgtgtatattccatgtgtattccatatatatattccatgtgtgtattccatatatatagtccatgtgtgtattccctatatatattccctatatatatattccctatatatattccccatgtacattccatatatatattccccatgtacattccatatatattccccatatatattccatatatattccccatatatattccatatatatattccccatatatattccatatatatattccccatatatattccatatatatattccccatatatattccatatatatattccctatatatatattccctatatatattccctatatattccatatatatatatatatatatatatatatatacaccctatatatatattccctatatattccatatatatatggagtctcgctctgttgcccaggctggagtgcagtggcgcgatctctgctcattgcaagctccacctcccaggttcacgccattctcctgcctcagcctcctgagtagctgggactacaggtgccagccaccatgcccagctaattttgttttcgtatttgtagtagagacggggtttcaccatgttagataggatggtctcgatctcccgacctcgtgatccgcccacctcggcctcccaaagtgctaggattacaggcttgagcctccgcgcccggcctctgaattctttttcaggtaaatcagggatttcttcttggtttggatccgttgctggtgaactagtgtgatatttgggggtgttgacgacccttgttttgtcatgttaccacagttggttttctggttccttctcattggggtaggctctgtcagagggaaggtatagggctgaaggttgttgttaagattttttttgtcccagggctattcccttgatgtagtctctcccccttttcctgtggatgtggcttcctgtgagccaaactgcagtgattgttgtttctcttctgggtctagctgcccagtgagtctagtcagctccaggctggtactgggggttgtctgcacagagtcctgtgatgtgaaccgtctatgggtctctcagccatggataccagcacctattctggtggaggcggcggacggtgcagtgcactccgtgagctttggtggtttaatgctctatttttgtgctggttggcctcctgccaggaggtggctctctccagaaagcatcaactgtagtagtgtggagaggggccagtggtgggtggggccctaggactcccaagattatgcgtcctttgtctaccactactagggtgggtaggaaaggaccctcaggtgaggacggtgctaggcatgtctgagatcagactcttcttgggcaggtgttgctgtagctgctgtggaggatgggggtgagatgcccaggtcattggagttgtgtgcctaggagaattatggctgcctctgctgagtcatgcaggttgtcagggaagtgggggaaagccggaagtcacaggcctcatccagctcccatgcaaactgaaggggcggtctcactcccaccatgtcctgcaaacagccctccatctggaaacagcaaacagtgtgtttccagatggagggccagacgaattgaaaacttgcctgaggctttccacctcccagctgccaaagaaaagggctttagttcttcctccgcctgtgaaatctgcaagccagattcacaccctcccctgggttctggcccagaggcttctcaccccattcaaattgttacaaagttcagctagagaattccttctccctgtggagctgtggagttttaccccttgctttctggccaccctcctgatggatccctgtggtgccaggcaggaatgggctgcttggggatccagtgagctcccagggcctttctgctgcttcctctgaccctgtattttgctcggctgagttttgtaacttgactcagctccaggaaaagtcggaaacttcttccacaaacaggccttcagcttctccagtgggggtgtgtgctcaggagaagcgggtctccctttcccacttccacagctggggcactcacagtatttggggtgtctcctgggccctacaggagcaagtctgcttccttcagagggtctgtggatcctctcaggattgctggtttgttctttcagtggatctgcagctaaaattcacaatgcaagcctccacatgctgctctgtccggagctgcaatctggctatgcctcccgtctgccatgatcccgaaatccctctccaatttttatatttttagtagagttggggttttgccatgttggccaggctggtattgaacttctgacctcaagttatctgcccatctcggcctcccaaagtgttggtgtaccaggacaagctgcagacaaaacctctgagacaccaagttaaagaaggaagggctttattcggccgggaacttcagcaagactcacgtctccaacaaccgagctccctgagtgagcaattcttgtcccttttaagggcttacaattctaaggggtctgtgtgagagggtcatgatcaattgagcaagcagggggtacacgactgggggctgcatgcaccagtaattagaatggaacagaacaggacagggattttcacaatgcttttccatacaatgtctggagtctatagataacataactggttaggtcaggggtggatctttaaccaagcccaaggtgcagcgccgggctgtctgcctgtggatttcatttctgccttttagtttttacctctttctttggaagcagaaattgggcataagacaatatgaggggtggtctcctaccttattggggttacaggcatgagccaccgtgcccagccaagaccctgaatttaaatcctgactctgtcattcattagctcctgacctcaagtatgccattaactactttgaatcctggtatccttgctgtcaaaggagatgagagttctgacacttataggtccactgtaagacataatttttaaaatatctgtaaaaactgggccgggcatggtggctcatacctgtaatcccaatactttgggaggtcaaggaaggcagattgcttgagcccaggagtttgagaccagcctgggcaacatgatgaaaccccgtctttaccaaaaattcaaaaaaatttagctaggcattggcacgtgtctgttagtcccatctgctcgggaggctgaagtgggaggatcactggagcccaggaggcagaggttgcagtgagccgagattgtgccactgcactccagcctggcagagtgagaccctgtctctacaaaaatgtaaaataaacttaaaaaatgtcaaagcatgataaagtacaggacataaagaccatgattaatctaacacccatcactacaatctttgcctctgttctggcattcccctatgtgtcttcgcatcaccctccttctgggtgactcctttatgttgtatttttttgtttggtttggtttttttggttagtttgttctgagacagagtcttgctctgttgctcaggctggagtgtagtggtgtgatcttggctcactgctacctctgcctcccaagtttgtacctcagcctcccgagtagttgggattacaggcatgcgccaccatgccctgctaatttttgtatttttagtagagacggggttttgccatgttggccaggctggtctcagactcctggctcaagtgacctgcccacctcagcctcctaaagtgttgggactacaggcatgagccaccacgcccggccaccccactcattttgaatgtaagtagattaccaattctgaaatgggttttgagcagtagcaacattgacacaaatttataatattttcaagaagatacttccttcaatatgtaaaatgcaacagatatcatttgcaatcatacatatgtacatatatacatacacacatataatatatatatctcaccatggaataagtctgagctgaaacatgcattacttaaaaaagaaaacacttacagacaggatcttgctccgtcatccaggctgaagtacagtggcacgattgtggctcactgcagcctcgacctcctgggctcaagtgatcctcccacctcagcctcccaagtagctgggactacaggcatgagctacctcgcctggcctgcatgatctttatgaagaatgtcatagaaagtttttgaaagcgattaaagttcacctaaacaagcagggatctatgctgtatgccatgctattattggggaggaaaaaaattctcctctacattcttagggtctctggagatctggaactaagaataaaactgaaataagacagattaacagaagaaaatcattcaagttttgctaaattttcagtgtacatgggtactttcacaagagaatgaaggcctaaagaagtcactaaagtagaaaaacaataccttttttttttttttttttaagacaaggacgggtgcggtggctcatgcctataatcccagcactttgggaggccaaggcgggcagatcacaaggtcaggagattgagaccatcctggccaacatggtgaaaccccatctctactaaaaatacaaaaaaattagccaggtgcggtggcgggcacctgtagtcccagctactcaggaggctgaggcaggagaatggcatgaatcctggaggcggagcttgcagtgagcggagatcgcaccactgcactccagcctgggtgacagagcaagactctgcctcaaaaaaaaaaaatgacaagacaaagcggcttggattatagggagtaaattgtggagaagggactaggacatacatgcggagcaaaattagaagataaggattatttttagtcgtgtgtttatacagatccattggaaccttgattcacagtcacttgtgatgacaatgttcttctcttcctggtaaagggagggtgctttcttatgggaaattgtgtggcctattcttagatagaaaagggcaggtcagagagtctttcctgcatgtgctatttctcaagtgccttcaactcaaaataattaatactccaaagcagcatatttggggtgacgtgtttttaattccttcatttcccctgctgcagactttcctagaagtttcagatattaaaagctgagttggtggctatggagataagagccagattcataacgagggatctacaaatggggagaagaacatagataagaataggaatgaataagctgaaaggaacaggtctgagcacatttccccttatcctgttaaacacacatcccattgctgggacaaggtcagtacagcagaaggaatgcacctcttttgtttgatggagagtgtttagcttgttctttaacaggtgcagcttaggcactatttgtcccagtggatttacacagaccagccttatccaccaatgatcacacaaactcctccttttgaggctgtcagtgtgtccagggtgcaacaattttggaatacagcagaagctaagctattaacttcttttgttgtggttgctgttgttgttttgagacagaatctcactttgttgagtgcaggctggagtgcagtggtgcgatcatggcttgctgcatccccagcctcctgggctcaagtgatcctcccacctcagcccccagagtagctggaactactactatgccctactaatttttaaactttttgtagagacagtctcactatgctgcccaggctggcctcgaacttctgggctcaagtgatcctccctcctcagactttcaaagtgctgggattagaggcctcagccaccatgcccagattgctttgacatcttgaggccttactgatccaggagagactgcccctccctgggccagctaattcctacagagaataaatgatttgcttatggtgtgccttcgatgggccaatcaaccgattcgtatctccaacataactttaccagccacctttcagcaggttcctgccccaaatcactccagggacaggtaccaggtaacaaaggaccactcctataacccagagcccatcacaattattaaaactagccagtcctaagtctgtttaccctgtcttgccttcttgcaaaaaacacagtaaagccttttgtccaccttttgccctcactcattctgccacctgactgaccctggtgcttccccatggccctgcatggtgtggcatgtcccccctattgtcttgggaactgtgagtaacaaactttcttttacatggctatcacctctgatctgtggcctcgccatacctgaataaagccaaaatcccaggtacattttaaaacaagtctacaagtcaaggaataccaaggatttccagcaacaccagagaggccggcccacgcccggcctgactcttactgttaatcactagttttgcatttctcttgaggaactagtcaggaggagaaaacctagacagcagctctcctggtcaagacccagtcattcagaagcctaaatggcatgcctaggtgcttggctttaaactgttagcaggtatggagtgctctgattgtgttttagaataatattctgggctgggcacggtggctcacgcctgtaatcccagcactttgggaggcggaggcaggcggatcacgaggtcaggagattgagaccatcctggctaagatggtgaaaccccgtctctactaaaaatagaaaaaattagccgggcgtggtggtgggcgcctgtcgtcccagctactcgggaggctgaggcaggagaatggcgtaaacccaggagtcggagcttgcagtgagccgagattgcgccactcattccagcctgggcaacagagcgagactccatctcaaaaaaaaaaaaaaaaaaaaaaagaataatattctggctgctgctggaaggcagccagggaggaagcaaggacattggatactgcagtaatcctggccaaaggcgacttgtgaaaaggggtgggcaactgaaggggcaggagaatgtggcccctctcagtctggagagagctgcagcactaggccaggaaggcactcttctgcggggggataggtcttaaatggggaccatgggattgggtgcagtggctcatgcctgtaatctcaacacttcaggagtctgaggcaggaagaccacttgagcccaggagttggagaccagcctgggcaacatagtgagaccctgtctcaaaaaaaaaaaaaaagacaatttaaaaactagccagatgtgatgcctgtggtcccagctacttgggaggctgaggtgagatgatcacttgatcacttgagccctggaggtcaaggctacactgagccatgatcatcccactgcactccagcctgcgcaacaaagtgagactcttatctcaaaaaaggcgacaggtgggaaccatggggaaccagagaagcaaagctattctcaagttttccagtaaccatcctcttgccaatggtctttctctgaatcttggatttgggaataggattttcctgccttgggaggctcccttgggaaatgggagtgtcacagccacaggcatcaaaagccctagagttgcacttgaatagtgggtagaaagttctgtgcaatgccaggcactgttggaaacctctgggtagggcttacagggccttagccatctgtgggaggcattagctggagtgtaataaatatgaccctcaggactggggagaaacagctcattccttcatgaggtgtggggctggcagccttgcaggcagccagccacccttcccctctggcctccatcctgggcactgagccaggcactgggtaagaaggctgctgcacctcctttctcctcttcccttttagagagaaagatacccccagccgaggatcccagaaaggcgagagcagacgcgccattgattggcccaaagttctccggagccaacctttgagcaaggagggcgtggctgggctccagtctcctagtgaggtgcaccactgcaggcttggtgacccagccgttcctgcccgctgcccccaaccagccgttcctgcccacagttcctgttcccgggcctgtccccgggtttgtccccagggcccgtcccctgggtttaggtctaccctccctcgccccaccccatcgccctcgccatgggtctggagctgtacctggacctgctgtcccagccctgccgttcagtctacatcttcaccaagaacggcatccccttcgagcttcgcaaagtggagctgaccaaagctgggctgggcaggcaggcccaggggatattggctgcggatccccacctgtccccactgctttgcagtcgggccgagaatgcagactaacatgaagaatcagactctctggtgtggaaactattacgtaattatctatgttattatttttactttttggagacaggagctaactctgtcactcaggctggagtgcagtggcacaatcatggctcactgcagcctcgaccttccaggctcaagcgatcctcccatctcagcccctcaagtagctgggactacagatgcccaccgatatgcccggccaatttattattattattattattattattactattgagaggaggtcttcctgtgttgcccaggcaggtctcaaactcctgagctcaggcgatcctctttccttggcctcccaaagtgctgggattacaggcatcagctgtcatgccctgctggttgtttattttaaaagaggcttcatctttgcttagtgaatacaaagcattcttcaaaatacaggttaagagggggcagagcagatgcagcaggagggcagggaaatggagtggggctagaatatcttcaccccatgtgcttggaaaaaacaatgaaactacctccttgtttcctaagtggagtagtccttgtttacctctgcctgggtctcttcccttcttgcctcttctttttttgacacggtctcactctgcagcccaggtagagggcagtggcatgatcccggctcactgcagccttgacctctcaggctcaagtgatcctcccacttcctcctctcaagtagagtagttgggaccacaggcacgcaaccacatccagcaatttcttttttttcctttttttttttttttttggtatttgtggagacgggattttgccatgtagaccaggctgaccttgaactccagagctcaagtgatcctcctgcctcctccttctaaagtgttgagattacagacatgcactaccatgtctggccctgggtctcttccacttttatgtatttcttggcattcttctgccttttcttttcctgcatctgacttgctctatcccatggggcttctcacccagctgaaggggctgctcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagaaggaggaacctgctcagctgactcttcccaactgctgcccttggtacaaccagcttgagtcacctgctacagaacaggggctggacacagaagcagtctgtggagggagaatgggcaggggtgtgcatgtccattcagtagaaggccagagaggcccacatgtaggcctatgatcagactggagcctggcttgactgatgccctctgatccaaacaccaggcacctaatgcggcctctagcactggcctagagtgctaaagtgagtcagacctgggaacccccagtggggagggagccttgagagtttggcacaagaaaggaagaagagctgagccaccgggggctgagtggctgaatggggcagggattcccagcaagaatgaggttggtctgagggttgggaacatgtttggctgggactctggggtattgacaggtcacccagcctggccagtagggcctaaggccccagctgggataggaagctgaatcagagggggcaagcctagagcccagggaggaggctggaggggtctgacctatggatggaactggctgggggtggggtgtgaattacagctccagggaattgtccttgagccatgcttcaaggaactggacacaggaaaggtggccctctgatagggtcagggtctgtgacccagtgactaacagagaggcttcctcttccctgatgcctcccagataggggcctcagaaagctgctgctgggagtttggagtgggggtgggcagagacatcagagaactcagggttctccccactcacctctctgatctcgcctgcaggccagcagcacagtgatgcctttgcccaggtgaatgccctgaggaaggtgccaggccttgaaggatggggacttcaccttggctgagaggtaaccggtccctgggctgctgccgggccttgtggggccagtcagtcagctgtctgtttactgctgatggcttggatcatggactgtgggccctgcaccagccccagggtgaagaatgggtggaggcaggcagaggtgcccagtgttgacaagggctatagaagtcccctcctgcattgtacaagtgaggaaactgaggctggaggaggggagggacttgcacaaggccacagggcccagtctgcttccgggcctcctcaccgccagtcttcccctccgaaaaaaagagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctacgtccttctcctcatggagctcacattccattaatagaagggggagctgacagtaacccatgtaaacatggaacatatcggatgttgatggatgccatggaaaaaataaacagggtaagagtgggggtgtgtgtcattatgagtaggatgttgagggaagactccctggaggaggtggcatctgagcagagagctgtaggaatgtgcaaggcatgaggggaagggtgttctcactggagggaagagtgagggcgaaggctccaggtgggacaatgcatggggttcagactggagagcaacgggccagggtgggtgcagtgagcaggaagagcaggaggtcatgacagaggggagcatgggacactgggaaggctttggctcttaccacaggtagattgagtcgctggagggttttgagcagaggagaactgtgatctgacttacgtcataaaggatccccctggcaggggtgagaaagccactgcagtcatctggcatgcagcgctggagccccagaccaaggtggtggtggtgcagggttggtggggattgtggtcagttctgacttttattgaaatctaactgcagggtttgctgaagggttggaggtgggtgggaaaaatgaaagccaaaaccagcctctaggttggtggctgcatggtggcgtcctttaccgaggccaaatagtgcctccttggtggagctggattcacattcagagcctgggatcactggatggtccaacacccatagaggcatgatgagctctgggggtcagactgcacaacccttcaccataggtgaacaggagatgggacagggtggggagcaatgctgccatgtcacctggaaggctctctccctgctggccttgctcctggccctgtccacgctttggatatgttggggagatatccaacatgctctcgttcttcagactcacagtggatgccccttcctcctggaagccttccctgagcccctgctgaagttcatgacattttgtttcttacttgctgcccttagttgagatgatagtctggccccgtgtagggctgtgtgaccctgggcacttacctaacctctctgagcctcacatccctcctctgcatcatggggatagtgaaaatgccccagaaaatggctgaagagtgttcagggcatgttttctgcccctgccatgtccccccagtgtggctagcttgctgtgtatgaactgcatgtacaaagcacctgaccactggtacccccaggacctgcaggcccgcgcccgtggggatgagtacctgtcatggcagcacatggccctgcagagtagctgctgctgggccatgtggcagaaggcgagccatggagggcagggacatctcccaagatgccaagggatgctgctttcactttacaaaatcctgtttagacctgagaccaaatcctggaatgccagagactgcctaattcacccaacttgtttcctaggagggaaaccaaggaccagagccaaggaaggattcccctaatatgccttaattccagagctatgagcagttaatcctatgctcttttgcatactccaggttgcctgggaatcttgcctttagggggagaaaataaacaaaccctcactttgctacacacataattcgtagatggagaagtatgaagtgaaaaaagtcaaactaggaagaagtgaggagacatttcaataaacgtttgtctgatgtctcggtatgaaaggactttctaaccctcagaacagtgggagaactcaacaaagaaataaccactacatgccagctgcggtagcatctgtaatgagcacacctgtaatcccagcactttgggaggccgaggcaggcagatcacctgagattgggagtttgagaccagcgtgaccaacatggagaaaccccgtctctaccaaaaatgcaaaattagccgggtatggtggcgcatgcctgtaatcccagctactcgggaggctgagtcaggagaattgcttgaatctgggaggcagagattgcagtcagctgagatcacgccattgaactccagccttggcaacaagagcaaaactctgtctcaaaaaacaaacaaacaaaaaaacatatacaaggacatgttgtgtaagaaaaaatggattaaacataaaacaagcaaaaaaccgggaaggatcttgataaaagatatgtcagaaggaggtaatgttctttaagatgctcttagaaacccttaagagaggcctggtatggtggctcacccctgtaatcccagcattttgggaggccaaggtgggcagatcacttgaggtcaggagtttgagaccaccctgggcaacatgatgaaaccccatctatattaaaaatacaaaaattagttgggtgcggtggcacactcaggagactgagacaggagaatcacttgaacctgggaggcggaggttgcagtgagctgacatcataccactgcactcaagctccacttagagcgagactgtctcaaaagcaaacaaagaaaaataagagaaacccatcagacaagagacaggaaaaaaatgagtcatagctcactgcattctagatctcctgggctcaagcgatcctcctgcctccgcccaggtagctagaactacaggtgcacaccacaacactgggattctttttttttttctttttttttgtagaaaacaacgaagggaatcttgctatgttgcctagcctggtcttgaactcctgggctcaagcaatcctcccttcttggcctcccaaagagctgagattacaggtgtcagccactttgcgtgaccacaatttcaatcatatttaaaatgtacaattcaagtgattttgccacactaaccacagactcatgtttaagccacaccaacggatttccatgttttaaataacatattttgccaccccctagtggacagtggctcaccaccggcacaaggggctacataggcagtcaatgggaaccaggcggggacgggaaatgtcgtgaacccaacggtccctgcccagccccacccgcgtccgcaacgtgtaaccacatctcctgactgcccaagagaagcgcagatttccatactgaacatgaaattgcctgacttcgaaatggtggcaaatcattaaaaaaaattttaaactcactttgcattggttattagggtcgaacttggggaagacccctacaggtgtgtgtgtgtctgtatgttaggggtgttcagacctttaatagggctagaaaccaggcaaccacaccgcggaaagcttgaggagagggaaatccaccagacgccaagcaggagggtcagggaagagacagggtggggccactaccgggttaaagacttgtagtgggtggggctacacgtagggccgagacgaccggatttccggaaatcagagccggcacacgtgacttttgtttgcagaagtgggaaggtaccctaggcagccaatcggggagcgctgagtctctgtccagccaatgagaagccaggttgttttagcgcctcgcccctcctctccggtccgcgagccttgggtatctccagcttttttccgccagagctgtttccgttcctctgcccgccatgccgttcctagagctgcacacgaatttccccgccaaccgagtgcccgcggggctggagaaacggctgtgcgccgtcgctgcctccatcttgggcaaacctgcagacgtgagcgtgggccgggcagcactgggcgaggggaagttggtgggccaggggtccggccttgtccctgctctgcctccgcaacagcgaccccgatccctttccccagggaccaccccccaccccattccgcaggccaagctctgactttccgtgcttcacgatcccgcggctccccctccgcacgtctttcccttgtcgccctccccagtcatgacccggacgtgaccttcagggacctcggcctgtactgggatccctgtccccgcgaacactgcgcgtttcggctttcgcgcgctcgggtcgggaccccagacgtagcccgactggctccagcttcgggtaaaacttttcatgttcccctcagcttgtgaacgtgacggtacggccgggcctggccagggcgctgagcgggtccaccgagccctgcgcgcagctgtccatctcctccatcggcgtagtgggcaccgccgaggacaaccgcagccacagtgcccacttctttgagtttctcaccaaggagctagccctgggccaggaccggtgcgcaggggtagtaggcccggaatattattctaaaacacaatcagagtactccattcctgctaacagtttaaagccaaacacctaggcaggccatttaggcttctgaatgactgggtcttgaccaggagagctgctgtctaggttttctcttcctgaccagttcctcaagagaaatgcaaaactagtgattaacagtaagagtcaggcagggcgcggtggctcacgcctgtaatcccagcactttgggaggccgaggcgggcggattatgaggtcaggagatcgagaccatcctgactaacacggtgaaactccgtctctactaaaaatacaaaaaactagccggacgtggtgggcgcctgtagtccccgctactcgggaggctgaggcaggagaatggcgtgaacccgggaggcggagcttgcagtgagccgaaattgcgctactgcacaccagccggggcgacaaagcgagactgtctcaaaaaaataccaaaaaacaagcaaaagaaaacaaaacaaaaacagtaagagtcgtcccaacgcagtggcttatgcctgtaattccagcactttgggaggccgaggcaggcagatcacctgtggttgggagttcgagaccagcctgaccaacatggagaaaccctgtctctactacaaatacaaaattagctgggcgtggtggtgcatgcctgtaatcccagctactcagaaggctgaggcaggagaatcactttaacccgggaggcggaggttgtggtgagctgagattttgccactgaactccagcctgggcaaaaagagcaaaactccttctcaaaaaaacaaacaaacaaacaaaaaaaaaaaacacacacacacacaatccaaaaaccagtaagggtcatgtcctgggaggctaactcagccgactgttaggtcaccatgcttatagccaagaaatgtgggatgctgctgggccctgagcggtcagataaactactttctctgataattagaaggctacaggaaatgttttgttttgttttgttttgggtttctttgtgtgtttttagagacaggatcttgttctgttgccccaggctggagtgctatggctcaatcagagctcactgcagcctcgaactcctgggctcaagcaatcctcccacctcagcctcccaagtagctagaactacaggtatgcatcaccacgcctgactaattaaaaaaaaaatttcttttggttgcgtgtggtgtcttggcacccgtaatcccagcactttgggaggtagaggtgggagcatctcttgagcacaggagtgcagggctagcctgggcaacatggcaagaccctgtctctacaaaaataaaaaagaaatgagctgggcgtggtggggtgcacctgttgtcccagcttcttaggaggctgaggtgggaatattgcttgagcctgggatgtcaaggctgcagtgagccatgactgtgccactgcactccaggctgggcaacagagtgagaccccatctctgaaaaaatatttttttggggagccaggcacagtggctcatggtaatcccagcactttcagaggtggaggtgcacagatcatttgaggtacagagtttgacaccagcctggacaacacggtgaaaccctgtttctactaaaaacacaaaaattagccaggtgtgatagtgcgtgcctataatcccagcttctggggagactgaggcaagagaatcgcttgaacctgggaggtggaggttgcagtgagctgtgatcatgccattgcactccagcctgggcaacagagcaagacactatctcaaaaaaaaaaaaaaaaaagtttgttttgaaatcctggactcaagcaatccccccaacctggacctcccaaagtactaggattataagtatgagctaccacactcagccactttttttttttttgagatggagtctcgctcggttgcccaggctggagtgcagtggcgcgatctcggctcattgcaaggtccgcctcctgggttcatgccattctcctgcctcagcctcccgagtagctgggactacaggcacccaccaccacgcccggctaattttttgtatttttagtagagacggggtttcaccgtgttagccaggatggtctcgatctcctgacctcgtgatccccctgccccggcctcccaaagtgctgggattacaagcgtgagccaccgcacgcggcctcagccacatttattaatttcactcttggcaaacatcagggggaagctgacccacacggcctgggaagggggttgtcttttgcatagagaccatgaccaggtctgggacagaggaaagtcaaataaatcacacattagagttagaagcagaggctcaggctgagcccaggtttattatccaaaatcaaaatgaaatgcagtgattaaaggacacaaggcctcagtgtgcatcattctcattgtggctttcaggcggctgtggaagacagggtggggatggtggcttcgggaggtgaggtgctctgggacttgggcaagtcttaggcaagccattcctgctttctgggcctggctcccatgggccattagaaatgaaaatgctttgtggactgctgaggacggtgcaagggtgaggtttcccagctcaccggatcatggccagcacccagggcatcagcttctgctttatggtggggtctgcaggtgggaagtccttggccttcagaatgacctcatgggcctcctggaagaggtcctcccccactgctgcctccacgcgctgccgccatgtggccagcttgggtcggccttcgaagacttggcagccagcacccacgggctgtggggaaaagggtacagactggggatggatggttgtgagggcagggatgggcagcatctgatttggggaccacagatctccaggaggtgtttgcacacacacttaagcacagtgccatagcccggtgtggcagcataagcaggacttcagcaactagccagggccccctgcctagtgggttcacctgcccacagcactcacatgcatcagctccgtgatggctacgaggtcagctaaggagatgtgaggaccagtaaggaaggccttgttctggaggaacttgtcctcgagcaactgcagggtcacatccaactctgccagggtggctgccagtgtctggggagatactggctcacccaggaaaacagggaacatcacctggggattgggcaggcaaagtcgggagttactggagtagggagttagttttgatttgcatttccctaatgattagtgatgctgagcatcttttcttttttttttttttttgagactgagtcttgctctctcgcccaggctggagtgcagtggggtgatctcggctcactgcaagctccgcctcctgggttcacgccattctcctgcctcagcctcccgagtagctgggactacaggtgcccgccaccacgcccagctaattttttttttatttttagtagagacagggtttcactgtgttagccaggatggtctcaatctcctgaccttgtgatctgcctgcctccgcctcccaaagtgctgggattacaggcgtgagccaccgcgcccggccaagcatcttttcttgtacttgttggccaaaatgataatattctcaacacattgggttaagtaaaatatatcaatttccttttactttttttttttcttttgagacagtgttcagctctgtcacccaggctggagtgaagtggcaccatctcggcacactgccaactttgccccctgggttcaagcaattctcctgcctcagcatcctgagtagctgggattataggcacaggccaccaagcctggctaatttttgtggttttagtagagacaaggtttccccatgttgaccaggctggtctcgaactcctgacctcaggtgatccactgccttggcctcccaaagtgctaggattattggcatgagccactgtgcctggactctttttactttttaaatgtgcctactagaaaatttaaaattacgtatgtggctcactttatacttctatcggacagcacttgactaaatgaactaaattccagagaggcataagccgttcctagatgagctactttcattccaatttcatttccttgggcccaagcaggctgggagaaagactgtcacaggcatgggcttttctgactgagcagcagtttgggaactgggggcagggatgaaaagcagagagatcttacaggcaacatcgtagttggtgattagattccaaagccatgctagactgagctagtgacctgatctcacattcaagatatttgaaaccaaagataaactgaaaccaactaaacctgcaacccagcccacctcctgattagcttagaagagaacagcctcacatcctggctacctgacacagggaagtgcaagccctttcttgggggtgtttattatgcaattcaatctctgctcttcttttatcataatgtctggcacacaaggatacatcatgaggccgggcatggtggctcatgcctacaatcccagcactttgggaggccgagatgggaggatcacctgaggtcaggagttcaagaccagcctggccaacatggtgaaaccctgtctctacaaaaatacaaaaattagccaggcatgatggcaggtgcctgtaattctagctacttgggaggctgaggtgggagaatcgcttgaacccaggaggcggaggttgcagtgagccaagatcgtgccattgcacgccagcctgggcaatggagtgagagtccgtctcaaaaaaataaaaaataatgataatacatcatgagacatgcaaagaagcaggcaaatgtgacccataatcaagagggagaaaacaacaatcaatagaaatagacccgtaggctgggtatggtggctcatgcctgtaatcccaacactttgggaagccaaggaggacgaatcacttcaggtggagagttcgaaaccagcctggccaacatggtgaaacccggtctccactacaaataacaaaagttagccaggtgtgctggtgggtgcctgtaatcccagctacgcaggaggctgaggcaggagaatcgcttgagcctgggaggtggaggttgcagtgagctgagatcgcaccattgcactcagcctgggtgacagagtgagaccccatctcaaaaacaaaacaaaacaaaaaaaccagacccacagaacacctacgtgttgaaattagttgacaaagatttttaggtaacagtgataaatatgttaaagaatttacaagaaaagacagataaaatggatgaacagatggtgaatttcatcagagaagtggaaattctaaaaaacaaccaaatggaatttccagagctgaaaaatacatatctcaaacaaagaatgtattggatgggcttaatagcaatttggcacaacagaggaaagaatctgtgaaggcaaagacaggtcagtagaaataatccaaaactgaaaagaagagactggtgcctgaacacctttggggaatgctctcgctgccgccccccacattcccagcctcaccttatgccacaaggcccggaggcagcttctccgcagagtcgtgtgctgccatgccaggtactcatccacacgggcacgggcctgcaggtcctgagggtaccagtagtcagggaccttatatttgcgcgtcaggtagagcaggatggccacactgtgggtgtgggggtcatgatgggtaagggaagggcactgtgctgggtatttcatacatagtcgcttttttttttttttgatacggagtctcgctctgtcgctcaggctggagtgcagtggtgcgatcttggctcactgcaacctccacctcccgggttcaagtgattctcctgcctcagcctcccaagtagctggaactacaggtgcgtgccaccatgcctggctaattttttgtagttttagtagagatggggtttcaccatattagccaggatggtctcgaactcctgaccttgtgatctgcctgcctcggcctcccaaagtgctgtgattacacgtataagcaaccgcacctggccttttttttttttttttttttttttttttttggagacaaggtcttcctcagtcacccaggctggagtgcagtggtgcagtctcagctcactgcagcttcaatttttataggagtgcaccaccatgcctggctaccttttttcttttttgtagagatgggatctcactgtattgccaggctggtcttaaactcctatcctcaagcaatcctccagccttggcatcccaaagcgctggcattataggcatgaaccactgtgcccagcacacttctttaacctttctgacaatttgccaaagtattagcctcattttccagagaagaaaaccaggcttagaaaggcagagacttgccctagggcacacagctcttaatggcagagctgagaatctttctgaggctaatacccaagcttttcctaccaccaggcaaaatcccacaacagaatgtcttgccaaatgtttagagacagtttctgatcagagaaccagagagagcttccaggagaacggggcatcaaagctgagctttaaagaagctcagttctttccattcggtatccactctcatctgctgggattccgaccagcctctgatggcctgactgttcaaaaaggcttccgtgtccctttgttctttctgtcattctttctgccaagaatcagctcctatctaagctgactggggtagtttggcttcctaaagtaccactcaggaagcactcctgcagctgcaggatcctagaacaacagaacagacaaggccccctggcactctcctccttccctgggttttgagggccgccatggtgatgagatgagcatggacctggaaggacacaggatgtgtccatttggagacacagaaaagctttcaggaacttggggtttcccaaaggttgggcatgcaggccaaaagggcagaaaacctctgtatctgccacgggcctatattctcttttaagctggggctacacacgtgtcccagcttaacgactccgttgtctgtgcagggtgcccaggagctccttttgctcccagccaattgttcaagccacctctgaggagggctgcaggtctctgtgagccacagacctgaaggtgagagtagtgacagaggcagagattgcacattgactctggctggtacctgggggtcacaacgctgagtgacacaaggactcaggacacctggggcaccagggaggaagacgggccctggcagaatgtcagaggaattcatcggaggtgcgtccatcctgagatttcagagatgagctttaaagcacaaactccaggttcttgttaggggaagggtgactctggtgacaaaaggggcagaactggggaaagattggcttttcctgaagaggattcaacttcttgggaccagctgtgatgtaagacgtccatatctggtggctcttccatggggaagacccatcctgggaagctgcagcccagagatggagccaccgggcagcccagatgccactgagccatcgccacacaagcttggccagaggcctgccccacggtgggcaaagctgccatcgtcctctggcctaccctgtctcaaggatactctcaccactcaccagcaaccaaagcactggtgtggaagtaaagtagatatttgcttttctaatcatcagggtgaactggaatagcaggaaggcaagggcctggggtccagtactgactctctgcaggatgcggggcacagagactctctgcctctgaagactttagtttccttgtctatgaaatagagggttagaacaggatggttccagcaggcctggcagcagtcctagggtcccagttacctctccgtcaaggtgaagtccccgtccttcaaggctggcaccttcttgagggggttcacctgggcaaaggcatcgcttaagtgctgacctgggaagagtccagcatggtgggtggtgggaggagaacgctgagcccgccatggcctgtgcccctccctgcaatgctctggccccagtttcacagttcttcttcccaccagtctgcactcctggttggcaaagactggaagggcccctgcgggaggaggaggagaccactccaccggctggtacaaaatagacaacaccccttgctaagtcctgtaggcacagcctcctcccacaggctgcccctctgcaacagagctcactgtgcagggtgtggttcctggacctttgcatgcaccctacccatctcctctttccactattgccagcttcatgaactcacaatcagagcaccccaagctgcacgataggtcacctgaggggactgactaccttgtcccttccaccattaattctaaggcagggtcatgaaacacagagaagtggtctttttctggtatctacctacttagaagcaacttctactggccccaccatgtccctttgttcaccctgccctgggcactgtggagctgtgtgtagcatacctgctaccaccccctgtgccccaaacttttattccccttacagttggggtctcactatgttgcccaggctggtcttgaactactggcctcaagtaatcttcctacttcggcctcccaaagtgctgggattacaggtgtgagccaccatgcccagcctgctaccctctcttcaccctcccttcagactgttccttcaccaggaaaaccctcctctgtctcctgggaaaacacacttccctctgcaccactacatttgacaaccagcttggacgtcctcttgtcccccattccctttcctctactccacactctgcagaggaagtccttgcgcaggacagtgggcagtttgcagaagagattatgtggagaagtttcaggcagagggccagccatggagtgggagccctgggcagaaggcttagccaagtagagtcgccttacttgccccaccagccatacctggattctgcttccaacccctcctactaccccaccctgcactgggcctgggcctgggcctgccagctgagtcctcaagggccttggaggcatgctagagaaacaaaacagggtgtagggctcatcaagccccagggtccccctgctgcttccagcatcagcagcctggggcaacctacctccccagcaggaacaagaggcagaggacaaggtttcgggcggcagaggttgcagtgagctgtgatcctgccactgcactccagcctgggcgacagagcgagactccgtctcaaaaacaaacaaacaaataaacaaaatgccttgggccaggcacagtggctcatgcctgtaatcccagcactttgggaggctaagccggcagatcatttgatgtcaggagttcgagaacagcctgaccaaaattgtgaaatcccatctctgttaaaaatacaaaaaaattagccagacatagtggcacacatttgtaatctagctactcaggaggctgaagcaggagaattgcttgaacccgggaggtggtggttgcagtgattcgagatccgtgccactgcactgcaacaaagcaaaagcaagactctgtctcaaaaaaaaaaggacaaggacaaggtcagaggcaaaacaggaggaacagaggaaggaagggacaaagagggaccccaatgcagactggacgagtgcagagggcagggatggaaagtcacgtcctgagctgtttgctgttgcagaatctcagcagctgggccataaagaagggacttgacgctgtcccagtctctacacttggcacccttgacctctctcatcccacctttccctaggccgaggtcacacctgctttcattttgtttttttttgttttttttttttaagacggggtctcgctagattgccctgacgggagtgcagtggctattcaagggcaccatgatagtgcactgcggcctggaattcctgggctcaagcgatcctcccaccccagcctctcgagttgctgggactacaggcgtgtgcccctgcacccagctgcgcccgtttttgtcctcctgtctggcttctcttcatgatccccacccctttattcggcctcaggggaaccccgtggtctattccgtgagaccgagcagagttttggggagccccgactcttggatctccctgctggctcacctttctctgttcggtctccaaaccagaccagcaatggccccaggaagaaggtggcgctgggagaagttccctaagctatgtatgcctacctgtccccttcctgacttttcggttccccaaacccgaggctggacctacctttaatcagatccacgatgcgcagctcgaagggaatgtcgttcttcttggcaaagatgtaaacagcgcggcagggctgggacagcaggtccaggtacagctccaggcccatagtggggaccgaccgacctgaccggaaaccagagggagtcagcaaactccagtgccaggactcgggtctcggacctcagaccacgcccctgcggctacgcaccccgaccgctgtgccccattgggcggcacggacgcctgggacactctttagtccaattgcgggcggcgggcggcctgtctcagggctgggcccgcctggctcctgtgggatcagggtgggtggccaagagaccgttgtctctcagggggacgcacagagaggccccagtcccatccctttcgtgcctggctcgctcatttcacttagcataatgtcttcaaggtgcatctgtgttgaagcgtgtgtcagaatttcccaccgtccgcattttagaggaggagacagacactgaatgattatagacccagaaagtctggctccaaagtccatcctcttggctcaacactgcagagtccttggtgccagcaagtggcaaagcctcagggcttacgttcagtgttttgtggtcactcgcttcactgcagtcgcactccctggaatgtcacagccttggtcttcctgcccctgccagcacagtgccatctatcgcattccctgggtttatttcttcctttctccaggcctgtgtttctccatctttaaaatgacagggaagctagagccctccagagtccttgcaagtccacccccctggattcatctgctgagccgtaagcccaggcctgccccttgctgccatggagcctgtcaaatagtatcagggtcacatgtcattttctaaaacgaatcccactgaaagtgtgtcagccaacgcataatgttttctagagaataaggaacatttctgcaaataaagtggaagtaacaactgttttattttatttagatagagtctcactctcttgcccagggtagaatgcagtggcatgatcacagctcactacagactccaactcctgggctcaagccatcctcccatctcagcctccccaagtagctgggactacaggtgcgcacaaagacgcccagctagttaaaaaaaatttttttctgtagaggcagggtctcactatgttgcctaggctgatcctcccacctctgccacctgctgggattacagatgtgagccactacaactggccagtaataatgatttttaactggaaaaaaaattaaggaaagatgagaaattcagatttccatgttaaagttttgaaaggaggtagacactcagagaaggcaatggctgccttatcctcacctctggataactccagtcagaggcccaaggaggagctgtcaggattctggttcaaggctcagcctgtcttttaagttcaaaacctaatttggggcgggagtggtggctcattcctataaccccagcaccttgggaggctgaggccggcggatcacctgagttcaggagtttgagaccagcctggccaacttggtgaaaccccatctctgctaaaaatataaaaattatctgggcgtggtggcatgcacctgtaattccagctactcaggaggctgaggcaggagaatcgttgaactctagaggcagaggttgccgtgtgccaagactgcgccattgcactccaggctgggcgacaagagagtaactccaactaaaaaacaaaacaactaatttggtccacgtttcaggattgatcattttctttgggtctgactcacataaaccaactcacaaaggctgtatttattaatttatagaaacaagataaaagtgagagtgtgtgggttggttcgtttgtttgttttttgactttgcccctctctgtcactcaggctgaagtgcagtggtgcaatctctgctcactgcaacctctgcctcctgggttcaagcgattctcgtgcctcagccacccgggtagctgggatttcaggcatgtgccaccatgctcagctaattgtatttttagtagagacagggtttcaccatgttggccaggctggtcttgaactcctggcctcaagtgacctgccagcctcggcctctcaaagtgctgggattacaggcgtgagccaccgtgcccggcctagaaagaagagaaaagtcatttagacagaatgctcccaaccattgctcagtgctctcttggcagtgtagtctcctaggaagcctcgtgggtgttactggccaggaccaggtccgttctgcccatgcacagtaaattaatcactgtgacatgagttttgcaaaagactaaagatttattcacaagggtgccaagcaaggaggtaggataatagctctcaaatccacctccccgaaaataaggcttagggataagccttgcttccaagcaataaagcacagaccccagtcacactcaaggggagggggctatacaaggatgtgaataccagtctgcctgcctcgtgggcctacaacgcagaagggccatgcacttggtttaaaactttgttgttgctgtcttgacattcttaacaatttaaaaataagggtccccacattttcatgtgtagccagtcctgtccaaggagtccaaagaggtcatgagggtggacaggtcactgtctcctctgggcagtgatggggccactagcagttgttctgtagtctcctagcccctaccccagggccacaccttccccatggtctctcacattcttttttttttttttttttttttttttgagacagggtcctgctgttgcccaggctggagtgagtgcagtgctgcaaactcagcttactatagcctcgacctcctgggctcaaacaatccttctgcctcaccctcctgtgtagttcggatcacaggcacatgccaccatgcttggctaattttttgactttgtagagagggcatcacactttgtttcccagggtggtcttgaattcctgggctcaagtgatcctcccacctcagcctcccaaagtgctaggattataaagatgtgatccgccgccccggcctctctcacattcttggcatttaaagttaccgtcattgacaaggaacatgggtacactccaatttactcaagaaaaaaactcttttctccattgaagagatatgtggcctggctgcttcctactctagttgaggtcttctttttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagcagcagccttgcctgggagcttgttagaaatatactaacaggctcccacccccaaacccagacctactgaatcagacagagtctgtattttcataagatcctcagatgatccaaatgcgccttaaactttgaggagctttgatccagaacctgggctggaggcccctgggggccactctgttcctcacagactgcaaggtatgtttttttcttgcctcttctctctgtcctaatgtctccttctctctgtgtctgaccctgaggaccctatgacatcttcccaggggagtttccactgtcaaagagctgattctctctctcttttttttttttttgagacggagtttcgctcttgttgcccaggctggagggcaatggcgtgatctcggcttaccgcgacctctgcctcccaggttgaagcgattctcctgcctcagcctcccgagtagctgggattacaggcatgcatcaccacgcccagctaattttttgtagttttagtagagacagggtttctccatgttggtcaggctggtctcgaactcctgaactcaggtgatctgcccacctcagcctcccaaaggcatgagccaccatgccctactgccagaggcctgattctctagaatctgatgggctcttctagacagcaatctctacctgggctcttgttgaagaagccaatcagctcattggttggaggtcacatgatataaaacatggccatcttccaagccctatgtgtggacaacgagatagggacaagtaggcatatcacgttctgatacctggacccacatctgtcgctgggcccacgtctgtcctcaggcccccaggatatacttttatggggagttttcctcccttcccccaatgtggtcactcataactttacacccaacagtcaaacaggagtggaagctacagagtttcacgcaaacaataggctaggctgtgggactgagtaaaaggcactggactgtggtaggtcttactccaagatggccaaatggaagggcttttagctttctttgtttttgttttatatcctgagacaaaatgttcaatttctacactttagaataaaaagagccatattttatgtttcatattttttgtatgcttcctttcatactcttttgaacaatgcaatcatattttcattatgaggtataattcacataccataatatccgctctttcaaaatatactttaaaattcaattggtttaaagccaattcattggtttttagtatattaacaaagttttgtcaccatcacaattatctaattctagatcattttcatcacccctaaaagaaactctgtacccattaaacagtcactccccatttccctcttctcctagcccctggtaaccattcatctactttctacctctgtggacagtaagtatctgcctattctggacatttcattcaaatttaataatgaaatatgtgagcttttatgactggcttctttcatttaacataatggtgtcaaggttcattcatggtgtagcatataacagtacttcatcccttcctgtggctgaattatattccattttatgtatacaccacattctgtttatccattcaccagttgatggacttttgcattgattctacttttcagctattgtgaatccccatgctgtgatgaacattcacgtacaagtttttgtctggacatatgtcttcagttgtcttgggtatacacctaggaatggaattgctggataatataattctatgttggccgggcacggtggcacatgcctgtaatcccagcactttggaaggctgaggtgggtggatcacctgaggtcaggagttcgagaccagcctggccaacatggcgaaaccccgtctctactaaaaatacaaaaactagctgggcatggtggtgcctgcctgtaattccagcctgtaattccagttactcaggaggctgaggcaggagaattgcttgaaaccaggagacggaggttgcagtgagccgagatggcaccactgcactctagcgtgggtgacagagcaagaatctgtctccaaaaaaaaaaaaaacaaaaaaaacaaaacaaaactaacccatatatatataatatgttatatatacataataatatattttatatatatgtgtatatatgtttaacttttggaggaactgcaagctgttttccaaagcggttatacattttacattctcagcagcagcacacaagggtttcaatttcttcacacatcctcaacaatacttttaatctgtcttttctgttatacccctcatagagtgtgtgaagtgatatctcattgtggtttgattggcaatgtcttgattatagtatctttgtactaagttttgaaattgggaagcatgagtcctacagctttttctttttcaaaattattttgaagattctgagtcactttaatttccaaatgaattttagggccaatttgtcagtttgtgcaaacaggccaagtggaattttaatgcagactgtgttgaatttgacatcttaacattactacaccttccaatcatgaacatgggatgtctttccatttattaaggtcttctttaagttttcccccaacttttaaattatgaaaacatttaaaatccagaaaatgaaaggactagtacaacagcactaatatatgcaaccccagtttcaacttactgttttttgaacataagataccaacatcatgacaccccacctaaggactttttagcaaaacattctaatttctctactgggattattgtttgttgtcttcctccacaataatgtgagcactaaaggtagagacttttgcgtactttgttcactactgcttcctctgcaccaaaaacactgcctggttgtgggtacttttctagttttaggaaggagaagacaagatataggtcctgactctggttctgcctctcattcatatgctactccgaggatcccttccccttgaagaacttgtttcttcatctacgaaatggggataatactactactcatcagggtggttgtgaggattaaacaaggtaagagatgtaaaattgcatgttagttatcagatagttttgttttcccatctagctccatgagggagaggatttgctctagtccgtccgtctgggctctgggcttctaatgggcagacaccttcctccatgatgtttgtagctgcaaagcctggcacagtccctcaagacaagctttttgacttgaactgctgatggtcttccatgcacaattcaacagaaacccagtagcatacacttccttgtatgcacttgcccctctttttacatttattacacattcattgctacctaataatccccgatacttatcttttactttatccaattattcaacagttttcaacagaaatacctagaagagagctattccgacttcattagaccctgagattctatttttaacatttcttccatggattgttgaatgtttccaatgattgatccaccttcccttggccttatctgcattccagatttggttgtgtgtccatctctgtgttgccagacttacctcacagacccagcttgaacacaagatgggtgcttgctgaagagcaggactcattctgttgaacctgcatgctttctcaggtcagattgcttggtggtgcttctttaatttctttcaacagcacattgtagtttgctgtgtttaagtgttgcttttctttggttaaagttattctaagtattttattctttttgatgctattgtaaatgaaagtgttgttttaattttgtttttgatcctttactgcaaatgtatactattgatttttgtgtattaatcttgtatcctgcaaccttgctgaacttgcttatgagctctaatggtttttaagtgagttccttaggagttcctataatgtcatctgtgactaaagatagttttacttctttctttccgatctggattccaccttgttcctttttcttgcctaattgccctaataaatagaagtagtatgaatgaacattcttgtcctgctcttgatcttgaggggaaacactcaatctttcacaaggaatgaagtatggtgtttataggtttttcatagatgctctttgtcaggctgaggaagttcctttctagtcttcatctgttgagtaattttatcataaaaggatgttagattttgtcaaatgccttctctgcattaggatgatcatgtgactttctattaatatgaagtgctatatggattggtttttgtacattgaaccacatttgtactcctgggataaatcctacctggtcaatgtgtataatcctcttaatatgctgctgaatttgatttgctaatattttgctgaggatatttacatctatatttataaggatattgctttgtaactttattttcttataatgtgtttttctgtctttggtatcagggtaatgctggcctcatagaatgagttgaaaaatatttcttcctgttctattttttagaagagtttttgaagggttggtgtcaattcttcaagcttttggttgaattcaccagtgaagctatctggtcctggacttttctttgtagggatttcatttattgatttattgatttattttttgagacggagtctcgctctgtcacccaggctggagtgcagtggtgcgatctcggctcactgcaagctccgccttcctggttcacaccattctcctgcctcagcctcccgagtagctgggactacaggtgcccaccaccacgccccatctaatttttttgtatttttagtagagatggggtttcactgcattagccaggatggtcttgatctcctgacctcgtgatccgcccacctcagcctcccaaagtgctgggattacaggcatgagccaccgcgcccggctttttggtaggattttaaaaaaattaatattttaatatctttacttttacaggtctattcaaattttatcttccttcttaagtccgttttggtagattgcatgtttctaaaattttctcatttcatcgaggttatctcatttgttcacatacaattattcatagtatttctttataaacctttgtacttctctaataccagtagtgatgtgtccattttctttctttctggtgtctggttttttggtttttgttttttttgtttttttttttgatataaggttttcctatgttacccagactagagtgcagtggtgcaatcacagctcaatgtaaccttgaattcctgggctaaagtgatcctcccaccttagccacccaatttgctaggactacaggcgcgcaccaacacactcagctaattttttctttcttttttttttttgagacgaaattttgctcttgtcacccagggtggagtgcagcagtgtgatcttggctcactgcaactctgcttcttgggttcaagcgattctcctgcctcagcctcccgagtagctgggattacaggcgcctgccaccatgcccagctagttttttatttttactagagatggtgtttcaccatgttggccaggctggtctgaaactcctgatatcaggtgatccgcccgtctcagcctcccaaagtgctgggattacaggcatgaaccactgggccttgcctcctagctaattaaaaaaaataaataactctttttgtagaaacaagtctcactatgttgcccaggctggtctcaatctcttggcctcaaatgatcctcctgcctcggcctcccaaagtcctgggattacaggtgtgagccattgcacccatcctccactttcttggtgaataatttgagtcttattttttcacttggccattctaactaaaggtttgccaagttttgttgatcttttcaaagatccaatttttggtttctttgattttctctattgtttttctgttttccatttcatttatctccattctaatctttattatttcctgtcttctattggtgttgggtttattttgctcttatttttctagttccttaaggtgtaaagttaggttattgattgaagattgttcttctttaacttaggtgtttacagctataaattttgctcttagcactgcttctgctgcatcctataaatttgggcatgttgtgttttcatttttattcattcaagatactttttaatttcccttgtggttttgtctttgacccattggttgtttaagagtgtgccgtttaatttctatgtgcttgtgagttttctagttttccttttgttcttgattttaaactttattccactgtgtccagagaacaccctttgtatgatttcaatcttcttaaatttgagacttaggaccaaatatatgctctatactggagaatattccatgtgctctttagaagaatgcttattctgctcctgtcgggtagaacgttctgttcatgtctagtgtgtgcaattggtttacagtgcttttcaagtcctctatttccttgatggtcttctgcagtttttctattactgaaagtgggggccaggtgtggtggctcacgccccgaatccctttggggattcagggtggctcagcactttgggaggctgaggcgggcgatttgcctgagctcaggagttcgagaccagcctgggcaatacaatgaaaccctgtctctactaaaatacagaaaaaaattagctgggcatggcggcatgtgcctgtaatcccagctactcaggaggctgaggcaggaggattgcttgaacctgggaggtggatgttgcagtgagctgagatcgcaccactgcactccagcctgagtgacagagtgagactccatctcaaaaaaaaaaaaaaaaaaaaaaaaaagtcaggtattgaagtcaccaactattattactgacaacgtaatcatatttaaccctttacttttaaaattctttttggaaactggaaggatctgtaaccaccacccacttccacatcagaccctatgcatacgccaactgtctgttgctcagcagctgtgatgttgttccagttctttattaggcaaagaacagttgtttttttagcatttcctttaaggaaggtggctcagatcattgagccagccaggccctgcaggatgggctgcgattagggtcacaagtacttctcccgaaactcacagattttcctcgtgaccattggatccaatgttgaaaagtcccagtcggccaactgcattagtcgatcatgggcctccctaaagaggccacagccaatattcagctccacccgcatacgccactcagctagcttggagctgttgaggaagacattatagttggctgccatgggctgtggatagacaaagacgaagatgtggtcagcctggggaccagccccacctgggtcctctcccacagcctctggcccacgtccctaacatctacctatggaaagaattaggctgctgacccccaaggcctgagcaaggggtcacagactatgtaatagatgtaggtggggatggaggatccagaatccctcagagtcctcagtcactggtcttcttgctccaagccttctgaaccacactgagagggctcctggcccaggcagctcccacttctccagcctgcgacctcgcatgaatcctgccttcttccagggaaaccccttatcccaggtgtgtatatgcggatgagggagagaactcaggttttttcctccatgtttagactcccactatgatcaagctcaggggctaagatgggagacctggcgggcagtctaccctgcagtttcgctggc

SEQ ID NO: 512 - DNA, 102147 bp, Homo sapiens
tcggttggaatctgttgaatgattggataaagtaaaagataagtatagggaattattaggtagcattaaatgtgtaataaatgtaaagagagggagcaagtgcatacaaggaagtgtgcgctactgggtttctgttgaattgttcatggaagaccatcagcagttcaaatccaaaagcctgtcttaaaattagctgagtgtggtggcgtgtgcctgtaattccagctacttgggaggctgaggcaggagaatcacttgaacccaggaagcggcgattgcagtgagccaagatcgcaccactgtactccagcctggtgatagagcgatactccgactcaaaaaaaaaaaaaacttgtcttgagggactatgccaggctttacagctacaaacatcatggaggaagctgtctgcccattagaagcccagagcccggagggacagactagagcaaatcctctccctcgttggagctagatgggaacacaaatctatctgataactaacatgcaattttacatctcttaccttgtttaatcctcacaaccaccctgatgagtagtagtattatccccattttgtagatgaagaaacaagttcttcaaggggaagggatcctcagagtagcatatgaatgagaggcagaaccagagtcaggacctatatcttgtcttctccttcctaaaactagaaaagtacccacaaccaggcaatgcttttggtgcagaaaaagcagtagtgaacaaaataggcaaaaatgtctgcctttagtgctcacattgttgtggagaaagacaaacaataagcacagtagagaagtaaaaattagaatgttttgctaaaaagtccataaaattgaatattattcagccataagaagggatgaagtaccgttatatgctacaacatggatgaaccttgacaccattatgctaaatgaaagaagccagtcataaaaggtcacatatttcattattccatttgaatgaaatctccagaataggcagctacttcctatccacagaggtagaaagtagatgaatggtaaccaggggctaggggaagaggggaatggggagtgactctttattgggtacagagtttcttttttgggtgatgaaaatgatctagaattagataactgtgatggtgacaaaactttgttaatatactaaaaaccactgaattggctttaaaccaattgaattttaaagtatactttgaaagggtggatattatggtatgggaattatatctgataatgaaaatatgattacattgttcaaaagcatagggaagcagctacaaaaaatatgaatcataaattgtggctctttttattctgaagtgtagaaattgaatattatagctcaaaatataaaacaaaaacaaagaaagctaaaagcccttccatttggccatcttggagtaagacctaccacagtccagtgccttttactcagccccacagcctagcctattgtttacatgaaaccctgtagcttccactcctgtttggtgggtgtaaagttatgagtgaccatattgggggaagggaggaaaactccccataaacgtgtatcctgggggcctaaggagagacgatggcccaggtatcagaacatgatatgcctacttgtccctatctccttgtccacacataaggcttggaaggcagccatgttgtatatcacgtgatctccaaccaatgagctgattggcttcttcaacaagagcccaggtagagattggtgtctagaggagcccatcagattctagagaatcaggcctttggcagtggaaactcccctgggaggatgtcatagggtcctcagggtcagacacagagagaaggagacattgggacagagagaagaggcaagaaaaaaacatatcttgcagtctgtgaggaacagagtggcccccaggggcctccacctcaggttctggatcaaagctcctcaaagtttaaggtgcatttggatcacctgaggatcttatgaaaataaactctgtctgattcagtaggtctgggtttgggggtgggagcctgttagtatatttctaacaagctcccaggcaaggctgctactgctgctgatctaatgaccacagtttgaggctggacagagtggctcacacctgtaatcccaacactttgggaggacaaggcaggagggtctcttgagggtagaactttgagaccagcctgggcaacacagcaggacctcgtctctaaaaaacaagagagaagaagaaaaaggaaacaacaagaagactcaactagagtaggaagcagttaggccacatatctcttcaatggagaaaagagctttttcttgagtaaattggagtgtacccatgttccttgtcaatgatggtaactttaaatgtcaagaatgtgagagaggccaggggtggtggatcacacctataatcccagcactgtggggggctgaggtgggaggatcacttgagccaaggaattcgggagcaccctgggaaacaaagtgcgaccccgtctctacaaagtcaaaaaattagcccagactggtggcatgcgcatgtggtctgagctacatgggagggtgaggcagaaggattgtttgagcccaggttgaggctgcagtaagctaagtttgtaccactgcactcattccagcctgggcaacagcaagaccctgtctcgaaaaaaaaaaaaaaaaaagaatagtagagcccaggggaaggtgtggccctggggtaggcgctgggagactggagaacaactgttagtggtcccatcactgcccagagcagacagtgccctgtccaccctcatgagatctttgaactccttggacaggactggctataaatgaaaatgtggggacccttatttttaacttgttaagaatgttaagatggcaacagcaaagctttaaaccaagtgcatggcccttctgcgttgtaggcccacaaggccgacactgctattcacatccttgtatggtcccctaccctggagcgtggctggggcctgtgctctactgcttggaagcaaggcttatccctaagccttattttcgggaaggtggatttgagagctactatcccacatccttgcttggtgccctgtgaataaatcttttctcttttgcaaaactcgtgtcatggtgattaatttactgtgcaatgccaggcactgttggaaacctctggataggcctcacagggcctcagccatctcggggaggcgttagctagagtgtaacaaatatgaccccagcaactggggagggacagctcattccttcatgaggtgtggggctggcagccccgcaggcagtcagccacccttcctctctggcctccgtcctgggcactgggcccaggcactgggcaaggaggctgctgcacctcctttctcctcttcctttttttttattttttgagacggagtatggctctgccgcccaggctggagtgcagtggcgtgagctcggctcactgcaagctccgcctcccgggttcacgccattctcctgccccagcctcccgagtagctgggactacaggcgcccgccaccccgcccggctaattttttgtatttttagtagagacgggtttcaccgttttagccagtatggtctcgatctcctgacctcgtgatccgcccccctcggtatcccaaagtgctgggattacaggcgtgagccaccgcgcccagcctctcctcttcccttttagtgggaaatatacctgcagcctagattcccagaaaggggtggtgagagagcagacacgccactgattgacccgaagttctaggagccaagggatgagtgaagagggcgtggccggactcggggctcctggtgaggtgcaccgctgcaggctcggtgacccagcagttcctgcccaaccctcacctacccccagccgttcctgtccgccgcccccaaccagccattcctgcccgcagttcctgttcccgggcctgtccccgggtttgtccccagggcccgtcccctgggtttaggtctgccctcccacgccccaccccattgcccccgccatgggtctgctgtcccagccctgccgttcagtctacatcttcgccaagaatggcatccccttcgagcttcgcacagtggagctgaccaaagctgggctgggcaggcaggcccaggggatattggccgcggatccctgcctgtccccgctgctttgcagttgggccaagaatgcagactaacacgaagaatcagactctccggtgtggaaactattacataattatctatgttattatttttactttttggagacagcatctaactctgtcactcaggctggagtgcagtggcacaatcatggctcactgcagcctcgaccttccaggcttaagcgatcctcccgcctcagcccctcaagtagctgggactacaggtgcccaccgacatgcctggccaatttattattattattattattgagaggaggtcttgctgtgtttccgaggctggcctagaactcctgggctcaagtgatcctcttgccttggcctcccaaagtgttgggattacaagcatgagccgccatgccccactggttgtctattttaatagaggcttgatctttgcttgtgaatacaaaacattcttcaaaatacaggtttagagagggcacagcaggcacagaacgagggtagggaaatggagtggggcaagaatatcttcaccccatgtgcttggaaaaaacaatgaaactgcctcgttgtttcctaagtaaaatagtccctgtctacccctgcctgtgtctcttccacttttgtattatttgtttgtttatttatttatttatttatttatttatttatttatttatttattacagtgtctcaatctgcagcccaggctagagggcagtggcatgatcccggctcactgcagccttgacctctcaggatcaagtgatcctcccaacttactcctcctaagtagaatagttgggactacaggcacgtccccgtgcccagctacttttttctttggtgtgtgtagacgcatgattttgccatgtagaccaggctgaccttgaactcctgagctcaagtgatcctcctgcctcctccttctaaagtgttgagatcacagacatgcaccaccatgtctggccctgggtctcttccacttttatgtatttcttggcattcttctgccttttccttttcctgcatctgacttgctctatcccatggggcttctcacccagctgaaggggctactcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagagggaggaccctgctcagctgactcttcccaactgctgcccttggtacaaccagcttgagtcacctgctacagaacaggggctggacacagaagcagtctgtggagggagaatgggcaggggtgtgtatgtccattcagtagaagggcaaagaggcccacatgtaggcctatgatcagactggagcctggcttgactgaggtcctctgatccaaacaccaggcacctaatgcggcctctagcactggcctagagtgctaaagtgagtcagacctgggaacccccactggggagggagccttgagagtttggcataagaaagcaagaagagctgagccaccggaggctaagtagctgaatggggcagggattcccagcaagaatgaggttggtctgagggttgggaacatgtttggctgggactctggggtattgacaggtcacccagcctggccagtagggcctaagtccccagctgggataggaagctgaatcagagggggcaagcctagagcccagggaggaggctggaggggtctgacctatggatggaactggctgggggtggggtgtgaattacagctccagggaattgtccttgagccatgcttcaaggagctggacacaggaaagatggccctctgatggggtcaaggtctgtgacccagtgactagcagagaggcttcctcttccctgatgcctcccagataggggcctcagaaagctgctgctgggattttggggtgggggtgggcagagacctcagagaactctgggttatccccactcacctctctgatctttcctgcaggccagcagcacagcgatgcctttgcccaggtgaaccccctgaggaaggtgccgggccttgaaggatggggacttcaccttggctgagaggtaaccggtccgtgggctgctgccgggccttgtggggccagtcggctgtctgttcactgttgatggcttggatcatggactgtgggccctgcaccagccccagggtgaagaatgggtggaggcaggcagaggtgcccagtgttgacaagggttatagaagtcccctcctgcattgtacaagtgaggaaactgaggctggaggaggggagggacttgcacaaggccacagggcccagtctgcttccgggcctcctcaccgccagccttcccctccgaaaaaaggagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctgcgtccttctcctcatggatctcacattccattaatagaagggggagctgacagtaacccatgtaaacatggaacatatcggatgttgatggatgccatggaaaaaataaacagggtaagagtgggggtgtgtgtcattatgagtaggatgctgagggaagactccctggaggaggtggcatctgagcagggagctgtaggaatgtgcaaggcatgaggagaagggtgttctcactggagggaagagtgagggcgaaggctccaggtgggacaatgcatggggttcagactggagagcaacgggccagggtgggtgcagtgagcaggaagagcaggaggtcacgacagaggggagcatgggacactgggaaggctttggctcttaccgcaggtggattgagttgttggagagttttgagcagaggagaactgtgatctgacttacgtcgtaaaggatccccctggcaggggtgagaaagccactgcagtcatctggcatgcagcgctggagccccagaccaaggtggtggtggtgcagggttgcgggggattgtggtcagttctgacttttattgaaatctaactgcagggtttgctgaagggttggaggtgggtgggaaaaatgaaagccaaaaccagcctccaggttggtggccgcatggtggcgtcctttaccgaggccacatagtgcctccttggtggagctggattcacattcagagcctgggatcactggatggtccaacacccataaaggcatgatgagctctgagggtcagactgcacaacccttcaccataggtgaacgggagttgggacagggtgggaagcaatgctgccatgtcacctggaaggctctgtccctgctggccttgctcctggccctgtccacactttggatatgttggggagatatccaacatgctctcgttcttcagactcacactgggtgccccttcctcctggaagccttccctgagcccctgctgaagttcatgacattttgtttcttccttgctgcccttagttgagatgacagtctggccccgtgtagggctgtgtgaccctgggtagttacctaacctctctgagcctcacatccctcctctgcatcatggggatagtgaaaatgccccagaaaacggttgaagagtgttcagggcatgtcttctgcccctgccatgtccccccagtgtggctagcttgctctatatgagctgcatgtacaaagcacctgaccactggtacctccaggacctgcaggcccgcgcccatggggatcagtacctgtcatggcagcacatggccctgcagagtagctgctgctgggccatgtggcagacggtgagccatggagggcagggacacctcccgggatgcccaagggatgctgctttcactttacaaaattctgtttagacctgagaccaaatcctggaatgccagagactgcctaattcacccaacttgtttcataggagggaaaccaaggaccagagccaaggaaggattcccctaatgtgccttaattccacagctaccacctgcacacttacactcacacactgttcgacacacagccacactcacacacacatccacccacgtccacccacagtcacacgatgtatcacattcacacgtatacacccacacacacaatcataacatttacacacagtcacacagttaactcctatacacacatatacacccacacaatcacacaactcactcatattcaacaaagtcacacaactcactcacattgacacacatacacaccaaccccacacacaattcacatacatacacacacatatacacccacatacacaaccacaccattcactgacattaatacaaagtcatcacacagttcactcccacacacacacatacacctcacacacacaggcacacaattcacaccaacaaaatcacacagttcactcattcacacacatacacccacatacacaaattcacactgctcagtcacatttacacaccattcaaattcacacacatatacacctacatacacacagttcactcacatcacacacatatacacccacatacacacagttcactcacatcacacacatatacacccacacataaacacagtcacacaattcactcacgttcacacacacagttcactgacattcgcacacatacacacacaccacacacaggcaattcagtcacatggccgaaagccagtccttaccttcctatagttcctttcccagtgtcacctcagcctttggccctcagcgtccccttcccatgcctggactgcggaagagccctgaacacaccccatcttcatgcctccagcgctagcccgagcccttccctctgccaagagcactaagtgcaactcaagatcacttctagggacccttccctgcccctgctgccaggtgacctgaggatcctgctggtcccgcttgacaatgatgcacagcatggttagttcagctgaggtcgctctcccagacttactgccacctacacagcactaggactgactgtttaactttattctttatttcgtgtactttattggagtgtctgttgaaagcaaaaccatccaataaggaacaatcccaaggcagccagcatggatcaagaaggcacaggctgtggccgccatccccagtgcctgatggggagagggggtggtaatggaaaaggcccaggaaagcaggccagagtgtccctcaaaatatgagaaatcactggaagagagagccagaatgggacctaagacagaagccaccaccaggcacccttaaggcaggacagttgcaatggttacttggaatacttccggctaggagtggtgttgcgggaagtcagggaccccaaacagagggaccggctgaagccatgacagaaaaacgtggattgtgaagattttatggacatttattagttccccaaattaatacttttataatttcttatacctgtctttactgcaatctctaaacataaattgtaaagatttcatggacacttatcacttccccaatcaataccgttgtgatttcctatgcctgtctttactttaatctcttaatcctgtcaaccaaggaggatgtatatggcctcaggaccctgtaataattgcattaactgcacacattgtacaggatgtgtgtttgagcaatatgaaatgtgggcaccttgaaaaaagaacaggataacagcaattgttcagggaataagagagataaccttaaactctgactgctggtgagccaggcggaacagagccacatttctcttctttcaaaagcaaataggagaaatatcgctgaattctttttctcagcatggaacgtccctgagaaagagaatacgcaccaggaggtatcagcttataaacagcacccctgggcgtggcctgtctcttatggtcgagactgcagagatgaaatatactccagtctcccatagcactcccaggcttattaggaagaggaaattcccacctaataaattttggtcagaccagttggtctcaaaaccctgtctcctgataagatgttatcaatgacaatggtgcccgaaacttcattagcaattttaattttgcctcggtcctgtggtcctgtgatcttgccctgcctccacttgccttgtgatattctattaccctcttaagtacttgatgtctgtcactcacacctgttcgcacactccctccccttttgaaaatccctaataaaaacttgctggtttttgtggcttgtggggcatcacggatcctaccaacgtgtgacgtctcccccggatgcccagctttacaatttctctcttttgtactctctccctttatttctcaagccggctgacggttaggaaaaataggaaagaacctacgtgattattggggcaggtcccccgatagagtggcacatgatgggcacagggcaggcttgggaaatggggggccgtaaggccacaagacatgtgggcaggtagcccagagtgtgtctggaacatcctgtttattggtcggcagtgacatctactgtcacatttgagaactgcatccacagccacatgacctcctgtgaagacctcagggcaaactggggaaacctgcccttcttggaaggtgatactaggggggatgagcaacacctttcttggaggtttgaattcttcagggcccctccagcatcttggtcttcctaattcctcccttgatcccccagccctaggggtggtagcttcttgcagtgtttacctccgtgttaatctggattctctctgtcttcggagttctctaatgcctggttaccaattctttatatcaagttctctccgttaaaatcattgtggtggggtccatcccatggatatacatggaggtctgtgtgacaatgtataatcttactatttgcagttattacaaaactgtcctagaagacatgaatgcttgttaaaagaaatcttttaagtttcctagacttcaaagaccgttgctatgccctgtgaaacatcgcctatatcctttaacagtttgcaattcgaattggttacttacttaacattttgttgccctggtgatacaattatgttgactcgttattgtgaggttactttgttattaaccatgatgaggattactagcacatacttttactccatatgtataacacaacaatgtagtaaaaccaataactcttggttctctattcaaagtgtttggaatctttattctgtttaaaacactgatgacatttgccaatttttgagtgttcttcatgttactgatttgtaggagctctttatatattgcagatttagtctcttactggttatgtatgctgcacctgaggagtagcagcactgccaaggacactgagtgtcttgtctgtgcagagcttcacatgaagctggagagaagggactggggcaagagggaaagataaaaaggggcaagtaagtaacagaatgaatccttgttgctaatctcctggcccccatcccagacccttcaggggatcctggcgattcgaagcagcatagcctgataggcctctggtgagggtgttgggagggttttcttggccgcctgttccaggatgctcaagatgatgctgtgggcctcctggcatagctcagcacccaggaaagcctccactcgtccacgccatgctgccagtcgtggccgtccctcaaacagttcatagccgagagccaccggctgtagggacaaggatgaaaaagttgtgggcatacaactttcccagttgtcactgccgacccgaatgctggaaccatgggcagaagtatcagagacatggtccattccccagcccctaagtgaatggaccacaggggcccaggcagtatgttcagccttagagcccaagagcagccagggtgagaccccacacccaggcaggaggcagaagttcagggttctggccccagatcatccagagacttgctctatgattctgggcaaagttctggctttctccaggcctcagtgtttctgtctgcctcatgggtgtgacacgaagagggacactgcccacaggctgagctcacacctgcatcagctcctccagggccatgagatcagccagtgtcacctgctggccagcgaggaagggcctgtcccccaggaacttgtcctccagccattgcagggcctggtccatggcagtcctgttgcgttccaccttctcctcgggcacctggaccccaatgaggggccccaacacctgatgggggcagagagtgggtcagtctatggccccggcctactgccaactactccctgatggccaatcactctccagatggctctcctcacctggacccacaggggtataccaaaggtgccacggatgcagtcggcatgccagcccaggtactcatgaacacgggcacgagcctgcaggtcagatggataccagtggtccggcgtctggtacttacagctcaggtaaatcaggatggccgagctgggaacaaatgggcagtggctataaggacactggcaccaggcatttacccctaactgctcccatctgccagtggggcccgggggcttctctgcatttgaaggactgccctccagcctcgccctccatctccagctccccaacaccaccccctcctcctacgagtctcctcctgtctttgttgccttgggcaccgactcttggctggaccttctgctttgcattttgagaacctcatctctgtgatatgccagcagccgccctgtgaggtagacactcctgttagccttttagcacaagagaaaactcaaggtcagaatggtcaagtgacttgtccgaggcggtgcagctcagaataggctccctggacccctggaaccctgcatggggctggcacacagtggatgctccgtggagtcccttgcatgtccacgcgcttgggtcagggatcacgaggggaggaatgtctttggcccccgtctgacaggcccccagccatcacttctgcagccacctgacctcttgtccttttcctgcccagcagctggacctcaccatgagctgtgcccttgggccatggcattggcctctaggcccggcctgggtagattgggtagtctgcgacaagtcactagaggctcttttcagctagcatttgttgaacaaatgcgcaacagtggaaaaatgttcccttgtcttctcttctaatacccttcagtctgggagtggagaggccctgcggctcagaaaaggctggaagatgagaggtggggggacatgttctgtcagcccctgctcatcccggtcacaccccaagctgtaccttctccccagatacctctcctttctttctttcctttttttttgagacggagtctccctctgtcgcccaggctggagtgggctccctctgtcacccaggctggagtgcagtggtgctatctctgctcattgcaagctccgcctcctgggttcacgccattctcctgcctcagcctccccagtagctgggactacaggcggccgccaccacgccctgctaatgttttgtatttttagtagagacagggtttcaccgtgttacccaggatggtctcgatctcctgacctcgtgatccgcccacctcggcctcccaaagtgctgggattacaggcgtaaaccaccgcgcccggcctttttgagacggagtctagctctgtcgcccaggctggagtgcagtggcgcgatctcagcacactgcaagctccgcctcctgggttcacaccattctcctgcctcagcctccagagtagctgggactacaggcgcccgccaccacgcccggttaactttttttccatttttagtagagacggtgtttcacggtgttagccaggatggtctcggtctcctgacctcgtgatccgcccgccttggcctcccgaagtgccgggatgacaggcgtgagccaccgcgcccggccagatccctcgcctttcccctccctcgctgccccatggggtatgggagggccactggggcccggggccagtggggagagccaaggtcacatgggctccggatgcggtgaggggtgagggaaggagggcacctttcagtcaagatgaaatcaccatccttgagcgtcggcagtttccccaggctgttgatctgcaagaactccttgctcttgtgctgccctgaagaggaagaagtcagaaaaggtcttcagaataaaaacgctgcacctctacaccctccctcctcctccccaagcggagccccacagccctgagaaacagcaaggtctgggactagaggcctggatcagcctcactccctggctgggcctccctgccctgccacattccggggcagctggggggttttggtgggtggggccaggtgcagcaggtggataaagagaagttttctagccggactctggtgggccaggggaggggaggcaaactggggtggctcatctcttcccatctcttaattctcacaacagtatgtccttcttcccgaggtcttctgggctttgtgaatttatatgcgtgcattccacgcaagaactctgtcaactccattcagtattttctttccatccctacagagcagaaggtaacgttatcctccttttcagaaggcaagctaaggttcagagaggctgtgatcccttcaaggccactcagtccacagcattctctggtggcagacgctgcaggaggaggtgagggggctgtgcgggcggcgagacgctcagggcagagcagggcgggggcctgggggtgcactgggtttgtggacacgcggggaaacgggctgggcccacctttgaccaaatccacggtgcgcagctctaaggggatgccattcttcttggcgaagatgtagacggcgcggctgggctgggacaccaggtcaagaaacagctctaggcccatggcgggggcggcaaggacagcggggatggcagtgaaggcgctgagcgcggtgtgggcagcagctgtggcaggatcccggcgcgccgggaaataggggatcaggccccaccccctggggacagcacccaattggagcgcaccacccccggacccgcctcgccccttcggttcctgtccagtcctgccggccaagactccaccaccagatccgtgcgtccctacagggagggcggtcgctatgaacgcacagctgggagggtggagttggagctggggaccctcgactggcagggaggacgcggatgcagggggccgactgcaaggggaaggggaaccggctggacagggagaagcaggtctgcttttcgggatcccggtgccagggaccctgcccagttccaggcgtcgccctgacccagaaacgactgggcgccgccgtcctggaaaggccccagcgcacggacatctgagggttcgttcagagctctgtttctcggcgctgcatggtggcggaagggagggagcgaatgggatcccctaaaagggatcttagagtttcacccagtgggatgtgacacttgcaggtgtcccaaactggtgggaaccttgactggaaggctggggttaaggatgaactttctgccgtccagactgtcccctgcagagcagctgctgccagacagcgggagctgccagacagcgggagctcccacttcgtgcacaggatgggggcagggagcccgcagccgcgggaggcaggaatgactgtccgggaacctcctttcttctccctgaatcccagccctggcatctcaccagggggcacagtgatggtccagggctgggcccgggactctagctgaatctttcagagtatcccatccctctggccagtggcccaagcgagtgaaccagaatgcttccttgggagttttgaaactggaactggagagaggagctccctatggggaggtaaacgggagctggggccacctgtagtgacatttcctgagttcgaggagtagacgagactgagagagaaaagctgactcagagaaagggagtgataacagggcatgctggcccacacctgcaatcccagttactctcacgggatctgtttctctgatgtctgggtatgaaaggactttctaagcctcagaacagtgggagaactcaacaaagaaaaaaccaatacatatacaaggttactttgtggaggaaaaaatggattaaccttaagcaaaaaactgggaaggatctcggtaaaagatacgtcagaaggaagtaatgtcctttaagatgttcttagaaacccatcagacaggtggggtgtggtggttcacgcctgtaatccctgtactttgggaggcagagatgggcggatcagttgaggtcaggagtttgagaccagcctgggcaacacggtgaagccccgtctctactaaaaatacaaaaattagctgggtgcggtggcacactcgggaggctgagacaggagaatcacttgaaccttggaggcagaggtttcagtgagctgagatcataccactgcactccagccgggccactgagcgagactgtctcaaaacaaacaaacgaacaaacaaaaagaagagaaactcatcagacgaagacacaggaaaaaaatgagcgaaggaaatcagcagaggtttcattgaaggacaaagagaaatggtcaatacatggatgaaaacatgtttaacttcagtaataatcaaggaagcacacaccaacacaacatgcacatactgtttttatttatcaaaggcacacatatttttgaaatgagtactcctaattaatatgtacagagcacttacccagtgcccagcacaggggtggcaccctgtgtgtgagacagcatgaaacaggtagacacgcgccctgctgaaagtaagggaccgcctctctggaggatccatcgggcaataaggaggtttccacaccttaactgtgtctgccttgacctctggggcctgggagcagagccccctccagctggtggggaaggaagcgtggtgtgtttgaggacagaatggagagaagttgagtagagcaagtgtagactcttcctatccaaagtgtggtcaatggactgggagtatcagcatcaccagggagcttgttggaaatgcagaggctcaggccccactctgaccttactgattgggagcataaactgtaaccagattccagggaggattcatacacacattcccgtttgataagtggggggtagtaggaggtgaggtgaaaagtggggaggggatggctaccgcactggagaaggctggctttgtgttgaggcctttctcatgagggcagtggggagccatggaaggctttatgcaagagagggtacgggcagattgagattacagaaggatcccactggttgccttgtgtgaggacccagggagaagggggaggctgtccctgtttgagtaggagatgagagctactggtggctatgagtggaaagaagtgagcagaggtgagcagaaatcccaaggactggtgatgataggatgatggtgggaaccaggatgggctttgggcagaccctgacccctctctctgcctgtcggcccaccagataataatccctgtgttcctgggcgagtcagtgccacccgagatgttggcggccactttggctgagctggacggatgcctgcagctgctcgaggacaagttcctgcgggaccaggccttccttactgggccccgtatctctgtggctggcttggtggcaatcacggagctgaggcatgagagtgccatggggtgcggtggcccgctgggcagtggtgtatccgggaagggagctgacatcccagctcatgttgtcttttctggctgtgggaccctgtgtgagtcacttctccttctgagcctcagtgtcctcatctataaaatggggctttacaaacccctcaccgcagctatattaagaggcttccaagtgtccccagggagggggacatcctagcccatcacacacatggtggaggagggaaaatccaatcagagaacccctaaagcaggtcatgctgccttacacttggctatgcccagcccctccgctgactctgtcttcccctagcccatcagtgctggctgctgagtctttgaaagcggacccacggtggcagcatggtgcccaacacgtggaggctgcagtgcgggaggacctcttccaggaggccctcccagctgtcctgaaggccaaggacctgcctccagtagaacctgctgttaaagagaatctgaagaccttaatgcagcttttcttgctgtgagtgcgtgtcccacacttgctgagccactgaggggatgctgtgttggtagaataaagacatggagctgtccgtctccttggttgaagagaagacatatctgcaaaggctctggtccacagttcctccagatatcatgcctgcattccttttgtctcctaccccattccattctagcttccatgtgacctctgaaaagagcttgggcaaacgcttacttgaccctgaccttctgtgtggaactttgtatggttcctcactgcccagaagctaaagtacaagtcattgaactttgcattcaaggccttgctcccactcctccaggtggccccttctgcctgcacactcctaacccctctctgggctcccaccttggcctcttggcctccgctcatgctgttccctcctcatcttcgcctggtgcccttcctggtcttttggcatttggcaccctgtctcttctccagggagacttccctgacctccccagccccagtccaggtcaggcgacctctctgggctcctcagccccagtgtttccttgcgggggatacccccggactgagcatgtatcatcgatgaggggtgacctggtggaaagatgtctgaatcaggatcagccttggtctcctcggtctctctcctcactgtggggcgatgttgtgttccacaagtggggtgcagggctggttcatgaacctccttgcaggaagggaagtccctggttatttcctggccctctcccatgcctcctcataaccttgaccacagtcttctctacaccccactcccggaccactggcttgtccatgccccacacctggtcccagacttgccacctgtccctgccctctccccttaggactgtcatatttacctgtcgtgtgtctcagaccttctgatatctgagtcatctaataaacaaactgctaataggacaagatcatgacagacagagactctgtcggcctttcagtggaggctcctttaagtatgcacacttatagagaattttatacacgtagttgaaattgtacatataaacttgcaaattttttctttcttttttgtgggggaggggggagcctgggtctcactctgtcatctagggtggagtgcagtggcacagtcatagctccctgcagcctagatctcctgcgctcaagcaatcctcctgcctcagccgcccaggtagctaggactacaggcacacaccacagcacccagatttctttctttttttttttttttttgtagaaaataaagaagagaatcttgctatgttgcctagcctgatctttaactcctgggctcaagcaatcctcccttcttagcctcccaaagtgctgagattacaggtgtgagccacattgctcgaccacaacttcagtcatatttgtaatgtacaattcaagtgattttgccacactgaccacactcatgtttaagccacgccaacagagttccatgttttctgatgttttttcgagatggagtctcgctctgtcacccaggctggagtgcaatggcgcgatctcggctcactgcaacctccacctccccggttcaagcgattctcctgcctcagcctcccgagcagctgggattacaacgtctgccaccacgcccggctaatttttgtatctttagtagagacggggtttcgtcatgttggccaggctggtctcaaactcctgacctcaggtgatccgcccgcctggacctcgcaaagtgctgggattacaggcgtgagctaccgtgcccggcctttccatgttttaaagaacatattttgccaccccctggtggacagtggctcaccaccggcacaagaggctacacaggcagatgtcaatggggaccaggcagggacaggtattgtcgtgagcctagccctacccgcgcccccgcgagtaaccacatctcctgactgcccaagcgcagatttccatactgaacatgaaattgcctgacttcgaaatggtggcaaatcattcaaaaaaactttaagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggacgtaagcgtgggccgggcagcacggggcgaggggaggttggtgggccaggggtccggccctgtccctgctccgcctccccgacagtgaccccgaatcttttccccagggaccactccccactcctttcctcacgccaagctctgactttccgtgctccacgatcccgcggctccccctccgcacgtctttcccttgtcgccctccccagtcatgacccgggcgtgaccttcagggaccgcggcccgtatcgggatccctgccccgcgaacactgcgcgtttcggctttcgcgcgctcgggtcccgtccccagaggtagcccggccggctccaacttcgggcaaaacttttcatgtccccctcagcgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggtgcgtaggggtagtaggggatccatgtgggactgccgcagactggagccactgatcctgcctcagggggaaaaacccatttcttgccctgcccagtaaggacacatcagggtctggagctttggggccccctgaccccttaggttcctgctgttaggaccatcttcaaagtgcgagcaggattgaatgaatttctggctctgctcctcagtgtgtaagtctgtgaaccgggaaggctctcttttaacacccccggggcagtgcaagggtcatgtgggattgtctgtgtgctgtacctgccttggcacctgacagggtaggtacacgtggctgaagtgtgattttctagaacttttccaggctggtcagaaggaattctgggtatgttctgaagttacgtattttggacctgtgtcccagccaggttccaggtgaagttcacgggagactcacagagtagtgaaagaccattggcctggatgtctagacatctgctttctgggtcctgcatagctgggggaccccagacaaacttggaaatgaaccatctccagttggcaacctcctcttctgtgaatacaggggaaaagacctccctcccccacaagaagcgtctgcaacccaaacctggcgttctgtgaccgagttaaagtttcctcttgggtaaaagatattcttgagccacatccatgtctaggaggaagtaagggcatgagaagcttgaaaggacactgtccaggcacggtggctcatgcctgtaatcccagcactttgggagaccaaggcgggaggttcatttgacccaggagttgtagaccagtctgggtaacatagtgagatgccatcccccaaaacagttttaaaaattaaccggacatggtggtgtgcacatgtagtctcacttagttggcaggctgaagtgggaggatggtttcagcccaggaggttgaggctgcagtgagctatgattgcgcattgcactccatcctgtgtgacagtgagaccttggctcacaaaaaaagaccttctgaaatggagcctttgttagtccatgaaggtcgatgaggaatggctgatcctgctgggtcctccctcaagctacagaggaataatacagtcagccccctgtatcactgggttacgcatctgttgattcaaacaaccatggattgaaatattagaggaaaaaaaattgataattgcatctatactgaaaatacgtatagactttattccttgtcattattccctaaacaatacaactatttacatagtacgtacattatattaggtattataagtaacccagagattatttaaagtatatgagaggatgtgtgtaggttacatgcaaatattacaccattttatgtaagggacttgagcaaatgtagattctggtttcctctggggattctagaacaaatctcccacggatactcagggaaaactgttactctaacaacaagtgttatacacttaccatgtgctaggtcctctacaggtactttacactcatgatcccatttgatccttacaatccctatccactctccctttgctcagacaagacatgctatccccatgaggtagataatctccattatgccaattttatgatgagaagactaaggctcttcatactcccccgccctcagccaggctgtcccaagctgtggcgctcctcactgaaaactgctgtcacctctgagaggggcatgttggcttatggcacagacattagtggtgggggggccaccctgtgcccaacctttgagaaaacaggtgtctgaggtactgtgtccttagggagtctgcaattaggaggaggcagattgcccctcagcccacagactgacagagatgatggagtgtgcagcacacacgatgaggctactgtgttgagtgtctgtcctaggtgggtcatgctgatgtgcagccaccattccacacctgagtgtcccactgccctgctgggggttggggaatgctcattaccgggatgagcacttttgcaaaatgggctgaggtgggaggatcacttaagcccaggaattcaagaccaccctgggaaacaaagtgcgaccccatctctacaaagtcatacaattagcccagcatggtggcatgagcctgtgatccaaactacatgggaggctgaggcagaaggtttgtttaggcccaggaggtcgaggctgcaataatctgagtttccaccactgcactcactccatgctggctgcctttggattgttcctaattggatggttttgctttcaacagacactccaataaagtacacgaaataaagaataaagttaaacagtcagtcccagtgctgtgtaggtggcagtaagtctgggagagcgacctcggctgaactaactgtggtgtgcatcattgttaagcagggccagcaggatcctcatgtcacctggcaggaggagggacagggaagggtccctagaagtgaccttgagttgcacttagtgctcttggcagagggaagggcttgggctagtgctggaggcatgaagatggggtgtgttcagggctctccagcagtccaggcatgggaaggggacgctgagggccaaaggcggaggtgacactgggaagggaactagcaaggtgaggactggcttttggccatgtgactgaattgcctgtgtggtgcgtgtgtatgtgtgcgaatgtcagtgaactgtgtgtgagtgaattgtgtgtttatgtgtgggtgtatatgtgtgtgatgtgagtgaactgtgtacatgggtgtatacgtgaattttagtgaattgtgtgtaaatgtgagcagtgtgaatttgagtatgtgggtggataagtgaattgtgattttgttggtgtgaattgtgtgcctgtgtgtgacggggagtatgtgtgtgtgtgagtgaactgtgtgatgactatgaatgtcagtgaatgctgtgattgtgtgtgtgtgtgtacgtgtgtggggatttggtctatatgtgtgaatttgagttgtgtgactttgttggatgtgagtgaattatgtgactgggtgtatatgtgtgtgtacacgagttaactgtgtgtaaatggtatgattgtatatgtgtgtgaatgtgatgaatcgtgactagatgcgggtggatgtgtgtatgtgcatggtgtgtccatgagtgtgtaagtgtgcaggtggcacagttgcaacaggagagaagacacaggaagccttacctgccattcatccccccagctgtcctcccagcctggggacccctgggctggaaaggttatgaaaagtggtgctactgccaggaaggggtgatggggcagctgggaggacggtttgagtcttgccaaagggagggagtcgaagcttgcaaccctggggaggaggaggggcagactggggaccctgcttctggaaaaccagcgaccaacccccaaagggacacaggcaacccctgcctccactctacagtggggaaaaggggagagtggcgtggcaggctgcccagccagtcatggagggagtagacttcaggaggagtacagaggtctggtcccattttggggctgaggacaggagcctcaggtcagcagtctgcaggaaggccccagctggaccagctgctcacaccttcccacaggcctgcagatgggtgtggagagcagagcctccaggctgagtctcccagccccagatctgagcagtctaaatcatccccctccaggttccctacggtcttatccaccagccctgctgcccatggtggccccagatgcccaggagagataatagaaggtaagaagtcatgtttgaatgaggaagctctcttcatttatttcatatgaggatgaagaagaggattatgtgatcacaggaatgttgcatgcgggataatccaaagctggttatctccaggccctcactctgccaagagatctctctggaagaagcagccagttcacagatgccctggatccctccgtgcccaatcataaaaaagtcatgaccgtccctatcttgccaatctgccaggactccaaggggaaaaagcggataagtatccttcaggagacagagaaaaagatatcatcagctccttggctaataccacatcttgcaagacccctgccaggtactcccactgtgggtactcaggacagcctgcctcagtccaccaggcattttgcaaacctgctcatcccaataatgattttccccaacccccagcagggcagtgggacactcaggtgtgggaggtagccgcacatcatgacccagctaggacagacacacaatacagtagcctcggtgtgtgtgccgtacactctatcatctccatcagtttgtgtactgaggggtaccctgcctcctaattgcaggctccctaagggcacagtacctcagccacctgttttctcaaaggctgagcacagggtgaccccccaccccaccaaccccgccactaatgtctgggccataagtgaacatgcccctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatgcaattatcaattttttttcctctaatatttcaatccatggttgtttgaatcaacagatgcgtaacccagtgatacagggggctgactgtattattcctctgtagcttgagggaggacccagcaggatcagccattcctcatcgaccttcatggactaacaaaggctccatttcagaaggtctttttttgtgagccaaggtctcactgtcacacaggatggagtgcaatgcgcaatcatagctcactgcagcctcaacctcctgggctgaaaccatcctcccacttcagcctgccaactaagtgagactacatgtgcacaccaccatgtccggttaatttttaaaactgttttgggggatggcatctcactatgttacccagactggtctacaactcctgggtcaaatgaacctcccgccttggtctcccaaagtgctgggattacaggcatgagccaccgtgcctggacagtgtcctttcaagcttctcatgcccttacttcctcctagacatggatgtggctcaagaatatcttttacccaagaggaaactttaactcggtcacagaacgccaggtttgggttgcagacgcttcttgtgggggagggaggtcttttcccctgtattcacagaagaggaggttgccaactggagatggttcatttccaagtttgtctggggtcccccagctatgcaggacccagaaagcagatgtctagacatccaggccaatggtctttcactactctgtgagtctcccgtgaacttcacctggaacctggctgggacacaggtccaaaatacgtaacttcagaacatacccagaattccttctgaccagcctggaaaagttctagaaaatcacacttcagccacgtgtacctaccctgtcaggtgccaaggcaggtacagcacacagacaatcccacatgacccttgcactgccccgggggtgttaaaagagagccttcccggttcacagacttacacactgaggagcagagccagaaattcattcaatcctgctcgcactttgaagatggtcctaacagcaggaacctaaggggtcagggggccccaaagctccagaccctgatgtgtccttactgggcagggcaagaaatgggtttttccccctgaggcaggatcagtggctccagtctgcggcagtcccacatggatcccctactacccctacgcaccggtcctggcccagggctagctccttggtgagaaactcaaagaagtgggcgctgtggctgcggttgtcctcggcggtgcccactacgccgatggaggagatggacagctgcgcgcagggctcggtggacccgctcagcgccatggccaggcccggccgtaccgtcacgttcacgcgctgagggggacatgaaaagttttgcccgaagttggagccggccgggctacctctggggacgggacccgagcgcgcgaaagccgaaacgcgcagtgttcgcggggcagggatcccgatacgggccgcggtccctgaaggtcacgcccgggtcatgactggggagggcgacaagggaaagacgtgcggagggggagccgcgggatcgtggagcacggaaagtcagagcttggcgtgaggaaaggagtggggagtggtccctggggaaaagattcggggtcactgtcggggaggcggagcagggacagggccggacccctggcccaccaacctcccctcgccccgtgctgcccggcccacgcttacgtccgcaggtttgcccaggatggaggcagcggcggcgcagagtcgtttctccagccccgcgggcactcggttggcgggcaaattcgtgtccagctccaggaacggcatggcgggcagaggaacggaaacagctctggcggaagaaaagctgggggtacccaaggctcgcggaccagggaggaggggcgaggcgccacagcaacctggcttctcattggctggacagagactcggcgctccccgattggctgcctagggtacctcccgcttctgcaaacaaaagtcacgtgtgccggctgatttccggaagtcccatcgtctccgccctacgtgtagccccacccactacaggtctttaacccggtagtggacccaccctgtctcccccgaccctcctgcctggcgccaggtgggtttccctctcaagcttccgcgctgtggtcgcccggttcctagccctattagaggtctgaacaccacacccccgacacacaaggacacacacacacctataggggtcttccccaggctcgaccctaataaccaatacaacgggagcttaaagtttttttgaatgatttgccaccatttcgaagtcaggcaatttcatgttcagtatggaaatctgcgcttgggcagtcaggagatgtggttactcgcgggggcgcgggtagggctaggctcacgacaatacctgtccctgcctggtccccattgacatctgcctgtgtagcctcttgtgccggtggtgagccactgtccaccagggggtggcaaaatatgttctttaaaacatggaaaggccgggcacggtagctcacgcctgtaatcccagcactttgcgaggtccaggcgggcggatcacctgaggtcaggagtttgagaccagcctggccaacatgacgaaaccccgtctctactaaagatacaaaaattagccgggcgtggtggcagacgttgtaatcccagctgctcgggaggctgaggcaggagaatcgcttgaaccggggaggtggaggttgcagtgagccgagatcgcgccattgcactccagcctgggtgacagagcgagactccatctcgaaaaaacatcagaaaacatggaactctgttggcgtggcttaaacatgagtgtggtcagtgtggcaaaatcacttgaattgtacattacaaatatgactgaagttgtggtcgagcaatgtggctcacacctgtaatctcagcactttgggaggctaagaagggaggattgcttgagcccaggagttaaagatcaggctaggcaacatagcaagattctcttctttattttctacaaaaaaaaaaaaaaaaaagaaagaaatctgggtgctgtggtgtgtgcctgtagtcctagctacctgggcggctgaggcaggaggattgcttgagcgcaggagatctaggctgcagggagctatgactgtgccactgcactccaccctagatgacagagtgagacccaggctcccccctcccccacaaaaaagaaagaaaaaatttgcaagtttatatgtacaatttcaactacgtgtataaaattctctataagtgtgcatacttaaaggagcctccactgaaaggccgacagagtctctgtctgtcatgatcttgtcctattagcagtttgtttattagatgactcagatatcagaaggtctgagacacacgacaggtaaatatgacagtcctaaggggagagggcagggacaggtggcaagtctgggaccaggtgtggggcatggacaagccagtggtccgggagtggggtgtagagaagactgtggtcaaggttatgaggaggcatgggagagggccaggaaataaccagggacttcccttcctgcaaggaggttcatgaaccagccctgcaccccacttgtggaacacaacatcgccccacagtgaggagagagaccgaggagaccaaggctgatcctgattcagacatctttccaccaggtcacccctcatcgatgatacatgctcagtccgggggtatcccccgcaaggaaacactggggctgaggagcccagagaggtcgcctgacctggactggggctggggaggtcagggaagtctccctggagaagagacagggtgccaaatgccaaaagaccaggaagggcaccaggcgaagatgaggagggaacagcatgagcggaggccaagaggccaaggtgggagcccagagaggggttaggagtgtgcaggcagaaggggccacctggaggagtgggagcaaggccttgaatgcaaagttcaatgacttgtactttagcttctgggcagtgaggaaccatacaaagttccacacagaaggtcagggtcaagtaagcgtttgcccaagctcttttcagaggtcacatggaagctagaatggaatggggtaggagacaaaaggaatgcaggcatgatatctggaggaactgtggaccagagcctttgcagatatgtcttctcttcaaccaaggagacggacagctccatgtctttattctaccaacacagcatcccctcagtggctcagcaagtgtgggacacgcactcacagcaagaaaagctgcattaaggtcttcagattctctttaacagcaggttctactggaggcaggtccttggccttcaggacagctgggagggcctcctggaagaggtcctcccgcactgcagcctccacgtgttgggcaccatgctgccaccgtgggtccgctttcaaagactcagcagccagcactgatgggctaggggaagacagagtcagcggaggggctgggcatagccaagtgtaaggcagcatgacctgctttaggggttctctgattggattttccctcctccaccatgtgtgtgatgggctaggatgtccccctccctggggacacttggaagcctcttaatatagctgcggtgaggggtttgtaaagccccattttatagatgaggacactgaggctcagaaggagaagtgactcacacagggtcccacagccagaaaagacaacatgagctgggatgtcagctcccttcccggatacaccactgcccagcgggccaccgcaccccatggcactctcatgcctcagctccgtgattgccaccaagccagccacagagatacggggcccagtaaggaaggcctggtcccgcaggaacttgtcctcgagcagctgcaggcatccgtccagctcagccaaagtggccgccaacatctcgggtggcactgactcgcccaggaacacagggattattatctggtgggccgacaggcagagagaggggtcagggtctgcccaaagcccatcctggttcccaccatcatcctatcatcaccagtccttgggatttctgctcacctctgctcacttctttccactcatagccaccagtagctctcatctcctactcaaacagggacagcctcccccttctccctgggtcctcacacaaggcaaccagtgggatccttctgtaatctcaatctgcccgtaccctctcttgcataaagccttccatggctccccactgccctcatgagaaaggcctcaacacaaagccagccttctccagtgcggtagccatcccctccccacttttcacctcacctcctactaccccccacttatcaaacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaaggcagacacagttaaggtgtggaaacctccttattgcccgatggatcctccagagaggcggtcccttactttcagcagggcgcgtgtctacctgtttcatgctgtctcacacacagggtgccacccctgtgctgggcactgggtaagtgctctgtacatattaattaggagtactcatttcaaaaatatgtgtgcctttgataaataaaaacagtatgtgcatgttgtgttggtgtgtgcttccttgattattactgaagttaaacatgttttcatccatgtattgaccatttctctttgtccttcaatgaaacctctgctgatttccttcgctcatttttttcctgtgtcttcgtctgatgagtttctcttctttttgtttgttcgtttgtttgttttgagacagtctcgctcagtggcccggctggagtgcagtggtatgatctcagctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtgagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttaaccccagccttccagtcaaggttcccaccagtttgggacacctgcaagtgtcacatcccactgggtgaaactctaagatcccttttaggggatcccattcgctccctcccttccgccaccatgcagcgccgagaaacagagctctgaacgaaccctcagatgtccgtgcgctggggcctttccaggacggcggcgcccagtcgtttctgggtcagggcgacgcctggaactgggcagggtccctggcaccgggatcccgaaaagcagacctgcttctccctgtccagccggttccccttccccttgcagtcggccccctgcatccgcgtcctccctgccagtcgagggtccccagctccaactccaccctcccagctgtgcgttcatagcgaccgccctccctgtagggacgcacggatctggtggtggagtcttggccggcaggactggacaggaaccgaaggggcgaggcgggtccgggggtggtgcgctccaattgggtgctgtccccagggggtggggcctgatcccctatttcccggcgcgccgggatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaaggtgggcccagcccgtttccccgcgtgtccacaaacccagtgcacccccaggcccccgccctgctctgccctgagcgtctcgccgcccgcacagccccctcacctcctcctgcagcgtctgccaccagagaatgctgtggactgagtggccttgaagggatcacagcctctctgaaccttagcttgccttctgaaaaggaggataacgttaccttctgctctgtagggatggaaagaaaatactgaatggagttgacagagttcttgcgtggaatgcacgcatataaattcacaaagcccagaagacctcgggaagaaggacatactgttgtgagaattaagagatgggaagagatgagccaccccagtttgcctcccctcccctggcccaccagagtccggctagaaaacttctctttatccacctgctgcacctggccccacccaccaaaaccccccagctgccccggaatgtggcagggcagggaggcccagccagggagtgaggctgatccaggcctctagtcccagaccttgctgtttctcagggctgtggggctccgcttggggaggaggagggagggtgtagaggtgcagcgtttttactctgaagaccttttctgacttcttcctcttcagggcagcacaagagcaaggagttcttgcagatcaacagcctggggaaactgccgacgctcaaggatggtgatttcatcttgaccgaaaggtgccctccttccctcacccctcaccgcatccggagcccatgtgaccttggctctccccactggccccgggccccagtggccctcccataccccatggggcagcgagggaggggaaaggcgagggatctggccgggcgcggtggctcacgcctgtcatcccggcacttcgggaggccaaggcgggcggatcacgaggtcaggagaccgagaccatcctggctaacaccgtgaaacaccgtctctactaaaaatggaaaaaaaagttaaccgggcgtggtggcgggcgcctgtagtcccagctactctggaggctgaggcaggagaatggtgtgaacccaggaggcggagcttgcagtgtgctgagatcgcgccactgcactccagcctgggcgacagagctagactccgtctcaaaaaggccgggcgcggtggctcacgcctgtaatcccagcactttgggaggccgaggtgggcggatcacgaggtcaggagatcgagaccatcctggctaacacggtgaaaccctgtctctactaaaaatacaaaacattagcagggcgtggtggcggccgcctgtagtcccagctactggggaggctgaggcaggagaatggcgtgaactcaggaggcggagcttgcaatgagcagaggtcgcgccactgcactccagcctgggtgacagagggagcccactccagcctgggcgacagagggagactccgtctcaaaaaaaaaggaaagaaagaaaggagaggtatctggggagaaggtacagcttggggtgtgtccgggatgagcaggggctgacagaacatgtccccccacctctcatcttcagccttttctgagccgcagggcctctccactcccagactgaagggtattagaagagaagacaagggaacatttttccactgttgcgcatttgttcaacaaatgctagctgaaaagagcctctagtgacttgtcgcagactacccaatctacccaggccgggcctagaggccaatgccatggcccaagggcacagctcatggtgaggtccagctgctgggcaggaaaaggacaagaggtcaggtggctgcagaggtgatggctgggggcctgtcagacgggggccaaagacattcctcccctcgtgatccctgacccaagcgcgtggacatgcaagggactccacggagcatccactgtgtgccagccccatgcagggttccaggggtccagggagcctattctgagctgcaccgcctcggacaagtcacttgaccattctgaccttgagttttctcttgtgctaaaaggctaacaggagtgtctacctcacagggcggctgctggcatatcacagagatgaggttctcaaaatgcaaagcagaaggtccagccaagagtcggtgcccaaggcaacaaagacaggaggagactcgtaggaggagggggtggtgttggggagctggagatggagggcgaggctggagggcagtccttcaaatgcagagaagcccccgggccccactggcagatgggagcagttaggggtaaatgcctggtgccagtgtccttatagccactgcccatttgttcccagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgaggagagccatctggagagtgattggccatcagggagtagttggcagtaggccggggccatagactgacccactctctgcccccatcaggtgttggggccactcattggggtccaggtgcccaaggagaaggtggaacgcaacaggactgccatggaccaggccctgcaatggctggaggacaagttcctgggggacaggcccttcctcgctggccagcaggtgacactggctgatctcatggccctggaggagctgatgcaggtgtgagctcagcctgtgggcagtgtccctcttcgtgtcacacccatgaggcagacagaaacactgaggactggagaaagccagaactttgcccagaatcatagagcaagtctctggatgatctggggccagaaccctgaacttctgcctcctgcctgggtgtggggtctcaccctggctgctcttgggctctaaggctgaacatactgcctgggcccctgtggtccattcacttaggggctggggaatggaccatgtctctgatacttctgcccatggttccagcattcgggtcggcagtgacaactgggaaagttgtatgcccacaactttttcatccttgtccctacagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaaccaagagttattggttttactacattgttgtgttatacatatggagtaaaagtatgtgctagtaatcctcatcatggttaataacaaagtaacctcacaataacgagtcaacataattgtatcaccagggcaacaaaatgttaagtaagtaaccaattcgaattgcaaactgttaaaggatataggcgatgtttcacagggcatagcaacggtctttgaagtctaggaaacttaaaagatttcttttaacaagcattcatgtcttctaggacagttttgtaataactgcaaatagtaagattatacattgtcacacagacctccatgtatatccatgggatggaccccaccacaatgattttaacggagagaacttgatataaagaattggtaaccaggcattagagaactccgaagacagagagaatccagattaacacggaggtaaacactgcaagaagctaccacccctagggctgggggatcaagggaggaattaggaagaccaagatgctggaggggccctgaagaattcaaacctccaagaaaggtgttgctcatcccccctagcatcaccttccaagaagggcaggtttccccagtttgccctgaggtcttcacaggaggccatgtggctgtggatgcagttctcaaatgtgacagtagatgtcactgctgaccaataaacaggatgttccagacacactctgcgctacctgcccacatgtcttgtggctttggggcctatttcccatgcctgacctgtgcccaccatgtgccactctattgggggacctgccccaataatcacgtagattgtttcctatttttcctaagtgtcggccggcttgagaaataaagggacagagtacaaaagagagaaattgtaaagctgtgcatccgggggagacgtcacacgttagtaggatctgtgatgccccacaagccacaaaaaccagcaagtttttattagggattttcaaaaggggagggagtgtgcaaataggtgtgagtgacagacatcaagtacttaacagggtaatagaatatcacaaggcaagtggaggcagggcgagatcacaggatcacaggaccgaggcaaaattaaaattgctaatgaagtttcgggcaccattgtcattgataacatcttatcaggagacagggttttgagaccaaccggtctcaccaaaatttattaggcgggaatttcctcttcctaataagcctgggagcactatgggagactggagtctatctcacctctgcagtctcgaccataagagagaggccacgcccggggggctgtttataagccgatacctccaggtgcgtattctctttctcagggacattccatgctgagaaaaagaattcagcgatatttctcccatttgcttttgaaagaagagaaatatggctgtgttctgcccggctcaccggtggtcagagtttaaggttatctctcttattccctgaacaattgctgttatcctcttcttttttcaaggtgctcagatttcatattgctcaaacacacatcctgtacaatttgtgcagttaatgcaattattaaagggtcctgaggcgacatacatcttcctcagctgacaggattaagagattaaagacaggtataggaaatcataagggtgttgattggggaagtgataagtgtccatgaaatctttacaatttatgtttagagattgcagtaaagacaggcataagaaactataatagtattaatttggggaactaataaatgtccataaaatcttcacactccacgttcttctgtcatggcttcagccggtccctctgtttggggtcactgacttcctgtaacaccactcctagccggaagtattccaagtaaccattgcaactgtcctgccttaagggtgcctggtgatggcttctgtcttaggtcccattctggctctctcttccagtgatttctcatactttgggggacactctggcctgctttcctgggccttttccattaccaccccctctccccatcaggcactggggatggcggccacagcctatgccttcttgatccatgctggctgccttgggattgttccttattggatggttttgctttcaacagacactccaataaagtacacgaaataaagaataaagttaaacagtcagtccccgtgctgtgtaggtggcagtaagtctgggagagcgacctcagctgaactaaccatgctgtgcatcattgtcaagcgggaccagcaggatccttaggtcacctggcaggaggaggggcagggaagggtccctagaagtgatcttgagttgcacttagtgctcttggcagagggaagggcttgggctagtgctggaggcatgaagatggggtgtgttcagggctctccagcagtccaggcatgggaaggggacgctgagggccaaaggctaaggtgacactgggaagggaaccatagcaaggtgaggaatggctttcggccatgtgactgaattgcctgtgtgtggtgcgtgtgtacgtgtgtgaatgtcagtgaactgtgtgtgtgaacgtgagtgaattgtgtaactttgtttatgtgtgggtgtatatgtgtgtgatgtgagtgaactgtgtgtatgtgggtgtatatgtgtgtgatgtgagtgaactgtgtgtatgtgggtgtatatgtgtgtggtgtgagtgaactgtgtgtaagtaggtgtatatgtgtgtgaatttgaatggtgtgtaaatgtgactgagcagtgtgaatttgtgtatgtgggtgtatgtgtgtgagtgaactgtgtgattttgttggtgtgaattgtgtgcctgtgtgtgtgaggtgtgtgtgtgtgtgtgactgaactgtgtgatgactttgtattaatgtcagtgaatggtgtggttgtgtatgtgggtgtatatgtgtgtgtatgtatgtgaattgtgtgtggggttggtgtgtatgtgtgtcaatgtgagtgagttgtgtgactgttgaatatgagtgaattatgtgattgtgtgggtgtatatgtgtgtacaggagttaactgtgtgactgtgtgtaaatgttatgattgtgtgtgtgggtgtatatgtgtgaatgtgatacatcgtgtgactgtgggtggacgtgggtggatgtgtgtgtgagtgtgcgtggctgtgtgtcgaacagtgtgtgagtgtaagtgtgcaggtggtagctgtggaattaaggcacattaggggaatccttccttggctctggtccttggtttccctcctatgaaacaagttgggtgaattaggcagtctctggcattccaggatttggtctcaggtctaaacaggattttgtaaagtgaaagcagcatcccttgggcatcccgggaggtgtccctgccctccatggctcaccttctgccacatggcccagcagcagctactctgcagggccatgtgctgccatgacaggtactgatccccatgggcgcgggcctgcaggtcctggaggtaccagtggtcaggtgctttgtacatgcagctcatatagagcaagctagccacactggggggacatggcaggggcagaagacatgccctgaacactcttcagccattttctggggcattttcactatccccatgatgcagaggagggatgtgaggctcagagaggttaggtaactgcccagggtcacacagccctacacggggccagattatcatctcaactaatggcagcaaggaagaaacaaaatgtcatgaacttcagcaggggctcagggaaggcttccaggaggaaggggcacccagtgtgagtctgaagaatgagagcaagttgggtatctccccaacatatccaaagcatggacagggccaggagcaaggccagcagggagagagccttccaggtgacatggcagcattgctccccaccccgtcccatctcctgttcacctatggtgaagggttgtgcagtctgacccccagagctcatcatgcctctatgggtgttggaccatccagtgatcccaggctctgaatgtgaatccagctccaccaaggaggcactatgtggcctcggtaaaggacgccaccatgcggccaccaacctggaggctggttttggctttcatttttcccacccacctccaacccttcagcacaccctgcagttagagtttcaagaaaagtcagaaccgaccatcaccccaccaaccctgcaccaccaccaccttggtctggggctccagcgctgcatgccagatgactgcagtggctttctcacccctgccagggggatcctttatgacgtaagtcagatcacagttctcctctgctcaaaatactccagcgactcaatccccctgcggtaagagccaaagccttcccagtgtcccatgctcccctctgtcgtgacctcctgctcttcctgctcactacacccaccctggcccgttgctctccagtctgaaccccatgcattgtcccacctggagccttcgccctcactcttccctccagccagaacacccttctcctcatgccttgcacattcctacagctctctgctcagatgccacttcctccagggagtcttccctcaacatcctactcacacacccccaatcttaccctgtttattttttccatggcatccatcaacatccgatatgttccatgtttacatgggttactgtcagctcccccttctattaatggaatgtgagatccatgaggagaaggacgtagacacgttcactgctcaagccccagggcttaaatggggtctggccctggtggatgtttagcaaatagccactgaagctcgctgagtggtccctcgactctccagggaaacagcacttgccccacaggatttgtgggcaaaatggtagcactaagatgcctggtacagccgctcctcgaaacttagcactctccttttttcggaggggaaggctggcggtgaggaggcccggaagcagactgggccctgtggccttgtgcaagtccctcccctcctccagcctcagtttcctcacttgtacaatgcaggaggggacttctataacccttgtcaacactgggcaccactgcctgcctccacccattcttcaccctggggctggtgcagggcccacagtccatgatccaagccatcaacagtgaacagacagccgactggccccacaaggcccggcagcagcccacggaccggttacctctcagccaaggtgaagtccccatccttcaaggcccggcaccttcctcagggggttcacctgggcaaaggcatcgctgtgctgctggcctgcaggagagatcagagaggtgagtggggataacccagagttctctgaggtctctgcccacccccaccccaaaatcccagcagcagctttctgaggcccctatctgggaggcatcagggaagaggaagcctctctgctagtcactgggtcacagaccttgaccccatcagagggccatctttcctgtgtccagctccttgaagcatggctcaaggacaattccctggagctgtaattcacaccccacccccagccagttccatccataggtcagacccctccagcctcctccctgggctctaggcttgccccctctgattcagcttcctatcccagctggggacttaggccctactggccaggctgggtgacctgtcaataccccagagtcccagccaaacatgttcccaaccctcagaccaacctcattcttgctgggaatccctgccccattcagccactcagcccccggtggctcagctcttcttcctttcttatgccaaactctcaaggctccctccccactgggggttcccaggtctgactcactttagcattctaggccagtgctagaggccgcattaggtgcctggtgtttggatcagaggacctcagtcaagccaggctccagtctgatcataggcctacatgtgggcctctttgcccttctactgaatggacatgcacacccctgcccattctccctccacagactgcttctgtgtccagcccctgttctgtagcaggtgactcaagctggttgtaccaagggcagcagttgggaagagtcagctgagcagggtcctccctctggcctgcccagggggctctggctctgctctctgccctactgcttagttatagccctgcctcctccactgaattgtgctccagctgcatctctgtatgccagccagaccagcaaacgctggagctcagggtgagggtgctggcctcccccactgccctgccacagggccctccagcctctagcctctaggagtagccccttcagctgggtgagaagccccatgggatagagcaagtcagatgcaggaaaaagaaaagacagaagaatgccaagaaatacataaaagtggaagagacccagggccagacatggtggtgcatgtctgtgatctcaacactttagaaggaggaggcaggaggatcacttgagctcaggagctcaaggtcagcctggtctacatggcaaaatcacgcgtctacacacaccaaaaaaaaaaaaaaaaaaagtagctgggcacggggacgtgcctgtagtcccaactattctacttaggaggagtaagttgggaggatcacttgatcctgagaggtcaaggctgcagtgagccgggatcatgccactgccctctagcctgggctgcagattgagacactgtaataaataaataaataaataaataaataaataaataaacaaacaataaaaaagtggaagagacacaggcaggggtagacagggactattttacttaggaaacaacgaggcagtttgttttttccaagcacatggggtgaagatattcttgccccactccatttccctaccctcgttctgtgcctgctgtgccctctctaaacctgtattttgaagaatgttttgtattcacaagcaaagatcaagcctctattaaaatagacaaccagtggggcatggcggctcatgcctgtaatcccaacactttgggaggccaaggcaagaggatcacttgagcccaggagttctaggccagcctcggaaacacagcaagacctcctctcaataataataataataataataaattggccaggcatgtcggtgggcacctgtagtcccagctacttgaggggctgaggcgggaggatcgcttaagcctggaaggtcgaggctgcagtgagccatgattgtgccactgcactccagcctgagtgacagagttagatgctgtctccaaaaagtaaaaataataacatagataattatgtaatagtttccacaccggagagtctgattcttcgtgttagtctgcattcttggcccgactgcaaagcagcggggacaggcagggattcgtggccaatatcccctgggcctgcctgcccagcccagctttggtcagctccactgtgcgaagctcgaaggggatgccattcttggcgaagatgtagactgaacggcagggctgggacagcagacccatggcgggggcaatggggtggggcgtcggagggcagacctaaacccaggggacgggccctggggacaaacccggggacaggcccgggaacaggaactgcgggcaggaatggctggttgggggcggcggacaggaacggctgggggtaggtgagggatgggcaggaactgctgggtcaccgagcctgcagcggtgcacctcaccaggagccccgagtccggccacgccctcttcactcatcccttggctcctagaactttgggtcaatcagtggcgtgtctgctctctcaccacccctttctgggaatctaggctgcaggtatatttcccactaaaagggaagaggagaggctgggcgcggtggctcacgcctgtaatcccagcactttgggagaccgaggggggtggatcacgaggtcaggagatcgagaccatactggctaaaacggtgaaacccgtctctactaaaaatacaaaaaattagccgggcggggtggcgggcgcctgtagtcccagctacttgggaggctggggcaggagaatggcgtgaacccgggaggcggagcttgcagtgagccgagctcacgccactgcactccagcctgggcgacagagccatactccgtctcaaaaaaaaaaaaaaaaaaaaggaagaggagaaaggaggtgcagcagcctccttgcccagtgcctgggcccagtgcccaggacggaggccagagaggaagggtggctgactgcctgcggggctgccagccccacacctcatgaaggaatgagctgtccctccccagttgctggggtcatatttgttacactctagctaacgcctccccgagatggctgaggccctgtgaggcctatccagaggtttccaacagtgcctggcattgcacagtaaattaatcaccatgacacgagttttgcaaaagagaaaagatttattcacagggcaccaagcaaggatgtgggatagtagctctcaaatccaccttcccgaaaataaggcttagggataagccttgcttccaagcagtagagcacaggccccagccacgctccagggtaggggaccatacaaggatgtgaatagcagtgtcggccttgtgggcctacaacgcagaagggccatgcacttggtttaaagctttgctgttgccatcttaacattcttaacaagttaaaaataagggtccccacattttcatttatagccagtcctgtccaaggagttcaaagatctcatgagggtggacagggcactgtctgctctgggcagtgatgggaccactaacagttgttctccagtctcccagcgcctaccccagggacacaccttcccctggtctctactattctttttttttttcgagacagggtcttgctgttgcccaggctggaatgagtgcagtggtacaaacttagcttactgcagcctcgacctgggctcaaacaatccttctgcctcaccctcccatgtagctcagaccacatgcgcatgccaccaatctgggctaattttttgactttgtagagacggggtcgcactttgtttcccagggtgctcttgaattccttggctcaagtgatcctcccacctcagcctcccaaagtgctgggattataggtgtgatccaccacccctggcctctctcacattcttgacatttaaagttaccatcattgacaaggaacatgggtacactccaatttactcaagaaaaagctcttttctccattgaagacatatgtggcctagctgcttcatattctagttgaggtcttcttgttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagtagcagccttgcctgggagcttgttagaaatatactaacaggctcccacccccaaacccagacctactgaatcagacagagtttattttcataagatcctcaggtgatccaaatgcaccttaaactttgaggagctttgattcagaacctgggctggaggcccctaggggccaccttgttcctcacagactgcaaggtatgtttttttcttgcctcttctctctgtcccaatgtctccttctctctgtgtctgaccctgaggaccctgtgacatcctcccaggggagtttccactgccaaaggcctgattctctagaaactgatgggctcctctagacaccaatctctacctgggctcttgttgaagaagccaatcagctcattggttggcgatcacgtgatatacaacatggctgccttccaagccttatgtgtggacaaggagatagggacaagtaggcatatcatgttctgctacctggtccatcgtctctcctcaggcccccaggatacacgtttatggggagttttcctcccttcccccaatatggtcactcataactttacacccaacagtcaaacaggggtggaagctacagggtttcatgtaaacaataggctaggctgtggggctgagtaaaaggcactggactgtggtaggtcttactccaagatggccaaatggaagggcttttagctttctttgtttttgttttatattttgagatataatgttcaaatttacacttcagaataaaaaagagccacaatttatgcttcatattttttgtagcttcttccctatgcttttgaacaatgtaatcatattttcattatcagatataattcccataccataatatccaccctttcaaagtatactttaaaattcaattggtttaaagccaattcagtggtttttagtatattaacaaagttttgtcaccatcacagttatctaattctagatcattttcatcacccaaaaagaaactctgtacccaataaagagtcactccccattcccctcttcccctagcccctggttaccattcatctactttctacctctgtggataggaagtagctgcctattctggagatttcattcaaatgtaataatgaaatatgtggccttttatgactggcttctttcatttagcataatggtgtcaaggttcatccatgttgtagcatataacggtacttcatcccttcttatggctgaataatattcaattttatggactttttagcaaaacattctaatttttacttctctactgtgcttattgtttgtctttctccacaacaatgtgagcactaaaggcagacatttttgcctattttgttcactactgctttttctgcaccaaacgcattgcctggttgtgggtacttttctagttttaggaaggagaagacaagatataggtcctgactctggttctgcctctcattcatatgctacccttccccttgaagaacttgtttcttcatctacaaaatgggcataatactactactcatcagggtggttgtgaggattaaacaaggtaagagatgtaaaattgcatgttagttatcagatagatttgtgttcccatctagctccaatgagggagaggatttgctctagtctgtccctctgggctctgggcttctaatgggcagacagcttcctccatgatgtttgtagctgttaaggctggcgtagtccctcaagacaagttttttttttgtttgtttgttttttttttgagtcagagtatcgctctgtcaccaggctggagtacagtggtgcgatcttggctcactgcaatctctgcttcccggattcaagcgattctcctgcctcagcctcctgagtagctgggattacaggcatacgccaccacacccagctaattttaagacaagcttttggaattgaactgctgatggtcttccatgaacaattcaacagaaacccagtagcgtacacttccttgtatgcacttgcaccctctctttacatttattacacatttaatgctacctaataattccctatacttttactttatccaatcgttcaacagattccaaccgaaatacatagaagagtgatattccaacttcatcagaccctgagattctatttttaacatttcttccatggattgttgaatgtttccaatgattgatccaccttcccttggccttttctacattacagatttggtggcatgtccatgtctatgttgccaaacttgcctcatagacccagcttgaacacaagatgggtgcttgctgaagagcaggactcattctgttgaacctgcatgttttctcaggtcagattgcttggtggcgcttctttaatttctttcaacagcacattgtagtttgctgtgttgaaatgttgcttttctttggttaaatttattctattttattctttttgatggtattataaatggaagtgtggttttaattttgtttttcatcctttattgcaaatgtatactattgatttttgtgtattaatcttgtaccctgcaaccttgctgaacttattttattttattgagatggagtctcagtcagtcacccaggctggagtgcagtggcttgatcttggcacactgcaacctccacctcctgggctctggtgattctcctgcctttgcctcctgagtagctgggactacaggcatgcgccaccacgcccggctaatttttgtatttttagtagagacggggtttcaccatattggacaggctggtctcaaacttctgacctcatgatctgcccgccttggcctcccaaagtgctgggattacaggtgtgagccaccgtgcccagccttgaacttgtttattagctctaatggtttttaagtgagttaagaatttctgtaatgtcatctgtgaatagagatggttttacttctttctttctgatctagattccaccttgttcctttttcttgcctaattgccctaataagtagaagtagtgtgaatgaacattcttgtcctgttcctgatcttaggggggaaacgcttgatctttcacaatggatgaagtatggtgttagttataggtttttcatagatgctttttgtcaagttgaggaagttcctttctcgtcttcatctgctgagtaattttatcgtaaaaggatgttaggttttgtcaaatgccttctgtgcattaggatgatcatgtgactttctattaacatggtatgctacactgattgatttttgtatgttgaactgcatttgtactcctgggataaatcctacctggtcaaggtgtatgatccttttaatatgctgctggatttgatttgctaatattttgctgaggatttttacatctatatttataaggatattgctttgtaactttattttcttgtaatgtctttttctgtctttggtatcagagtaattctggcctcatagtatgagttgaaaaatatttcttcctgttttatttttttggaagagtttgtgaaggctttgtgttagttcttcaagcttttggttgaattcaccagggaagccatctggtcctgggcttttctttgtggaatttttaaaaataattaatattttaatctctttatttgttacaggcctattaaaattttatctttcttcttaagtcagttttggtagattgtgtgtttctaaaattttcccatttcatctaggttgtctaaattgtccacatatagttattcatagtatttctaaacttttgaatttctctatgaccaatgtgatgtctccattttctttctttctggtttccatttcattttttcatttttgtttttgtttgttttttgagataaggttcttctatgtgcccaggctggagtgcagtggtgcaatcatagctcggtgtaaccttgaactcttggactcgagtgatcctcccacctcggccacccagttagctaagactacaggcttgcaccaccacaccaagctaatttttttaaaaaatatattttttagaaaaaagtctcattgtgttacccaggctgttatcaatctcctggcctcaagtgatccttctgcctctgctttccaaagtgctgggattgcaggtgtgagccattgcacccagcctccactttctttcttggtgaataatttgacccttatttttttcacttggctattctaagtaaaggtttgccaattttgttgatctttgcaaagatccaatttttggttttattgattttattgcttttctattttctatttcatttatctccattctaatctttattatttcctgttttctagtggtgttgggttgagtttgctcttatttttctagttccttaaggtgtaaagttaggttattgattcaagatcattcttctttaacttatgtgtttacagctataaattttgctcttagaactgcttctgctgcatcctataaatctgggcatgttgtgttttcatttttatttgttcaggatactttttgatgtcccttgtgatttcttctttaacccatttgttgtttaagagtgtgctgtttaatttctatgtgcttgtgagttttctagttttccttctgttcttgatttttaactttattccactgtgtccagagaacatactttgtgtgatttcaatcatcttaaatttgagacttaggaccaaatatatgctctatactggagaatattccatgtgctctttagaagaatgcttattctgctcctgtcgggtggaacgttctgttcatgtctagtgtatgcgattggttaatcgtgcttttcaaattccctatttccttgatggtcttctgtagtttttctattactgaaagtggggtattgaagtcaccaactattattactcacaatgtaaccatatttaaccctttacttttaaaattctttttggaaactggaaggatctgtaaccaccacccactcccacatcagaccctatgcatatgccaactgtctgctgctcagcagctgtgatggttgttccagttctttattaggcaaagaacagttgtttttttgtttttttgtttttttttttttaacatttcctttaaggaaggtggctcagattgctaagccagccaggccctgcgggacaggctgcgcctagggtcacctgctcttcttcagcaactcagaaatattctccttgaccattgaatccaatgttgaaaagtcccagtcggccaactgcattagtcgatcatgggcctccctaaagaggccagagccaatattcagctccacctgcatacgccactcagctagcttggagctgttgaggaagacattatagttggctgccatgggctgtagatagacgaagacaaagacgtggtcagcctggggaccagccccacctgggtcctctcccacagcctcaggcccacgtccctaacatctacctatgcaaagaattaggctgctgacccccaaggcctgagcaaggggtcacagactatgtaatagatgtaggtggggatggaggatccagaatccctcagagtcctcagtcactggtcttcttgctccaagccttctgaaccatgctgagagggctcctggcccaggcacttcccacttctccagcctgcgacctcgcatgaatcctgccttcttccagggaaaccccttatcccaggtgtgtatatgtggatgagggagagaactcaggttttttcctccatgtttagcctcccactgtgatcaagctcaggggctaggatgggagacctggcgggcagtctaccctgcagtttcgctggcttactaagagtttggtttgcacccaagatctttgggaagcccaagaatgggtgtgtgtgggtgaaatgtaaggggtggggacgaagcatatggctgaacccttggggcaggccagaatgatttttcctggtgctggtctgccctgcaaacagaccaaggagactaattttcatatcagccagagatctctgggataaggaaaagaatactgcattttctggtcaatccaccaggaccccaggtccctcctctcgggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttcctcccctgttatctttgggatcagcaactggccagggttgggaagaggagggaagaggaggctgcactccagggccacctgccctgccaggtctctgtactcttgtctgctggatagatattgaacacttcccaggatataaagcagtttcacctcttttagcagttctgattggtggaagttgctgggaaccatgtgttcacaaggatttggggagctcagcaggcataagtcctgtgattgattagtgatgtctgtcacaggcatagaattcaaagtagagacacatgtactggttatttgtcatcttctaattttctataggccatactcttttttgtttttgttttttgagatggagtctcactctgtcgcccaggctggagtgcagtggcacaatcttggctcactgccaactccaactcctgggttcaagcaattgtcctgcctcagcgtcctgagtagctgggattacaggtgcccatcaccacacccagctaataattttgtatttttagtagagatggtgtttcacaatgttggcaaggtaggtcttgaactcctgacctcaagtgatctgcccgcctcggcctcccaaagtactgggattacagttgtgagccaccgtacccggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcaggtctggcgggcaccagtgcgatggtgcgctgtacttgcggcacaggtagtaaaggatggccgcgctgcagaaggggccggtcaggggcactgcccttgccttcctgagtgccactacgtcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacgtagggtagcccctggaggtgcagggaggttatggacttaatgcttaagattaggcattatataagccagggcatgaaaggatccatctctctggtgctggatggagggtgagcccgagggggcagaatggacaatgaggtggcgggccagcaactatcgggaaggttgtggtgtctggggatggtggaggccatggggacagagggaaggggacggaggggagacatgcttcggaggggatgtcctaggccttgctgattgatggctggtgtgggaacctccgcagcacaagggctcctttatcatcaccaacagcaaccatgccaaggtaaaaaggtcagggcatggagagagctatcggttaaaaagtggcaggagagacagcaactggctgcaagactcagaacttctttggatcctgatccaaacaaactgccaagaaaatatttaggagataatcagagagttttgaacaggagccacgtattagatgaaatccaggaattactgttaattttatgaggtatcttaatggtatcgtagtgatgctacgctctatcctagcccaggctggagtgcagtggcacaatcagagttcactgcagtcgtgaactcctggcctcaagcgatcctcccgtgtcagcctctcaaagtgctgggattacaggcatgagccaccgcgcccagcctgttgctttttttttttttttttttttttttttaaagaacgcttatctctaagaggtatgttcctgaacgtttattgatttatttacttacttatttttatttttgagatggggtctcactctgttgcccaggctgaagctcaatctttgctcactgcaacctctgcctcccgggctccagcaatccctccacctcagcctcctgagtagctgggactacaggtgcggaccaccatgctggctaacttttgtattttttgtagagatgggggttttgccatgttgtctaggctaggctggtcttgaacacgtgagctcaggccatcccctcacttcagcctctcaaagtgctagaattacaggcatgagctggcccctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgctcgcactgaacctcccaggaggagcagagacagatggtgcaagggccccagggaagacttacctttcacttaagataaatttcccatctttgaggctgggaagcttcctgagggggttgatgtcaatgtattctttgctgtggtggtgacctgggaggagcagggaaggtctgaggctgtgggactccaggggagagagaactgagactcccagagacacaaacgcctccctctctattttctcaagaagagaggactgaggcccggagggacatggcggctcaccccaggtcacagggcaaggcagttgcagaaccggactgggatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagttttggagtccctctgtgctcgggatggagttggagcccacccctctgaccctcactcgggagcagtggagccctgagcctttctgaacactggggaggatgggtgtagacggactgtgcacttctgccccctttgccaacctggtgggcaggtgctgagttcacaaggtcctagaatcccacaacgaagccagggtgcctggtgggagcccagggagtcccagctgctgttcattcccccttctcctcaaaaagcctgttcatctgtggcgtggggactatcattagtggggagtggctaaggtaggctaggcagggacgcagcctacaagccccgtggcatcttttccttccctgtggacctctggggtgattcccttgtctctgtccctgcttctcagaaatgcccctatcaatctgagcgtggtggctcacgcctgtaatcccagcactttggaggctgaggcggggcagatcacttttggtcaggggttcgagaccagcctggccaacatggtgaaactccatctcgactaaaaatacaaaaaatgagccgggcatggtggcgtttgcctataaacccagcaactcgggaggctgagctgggagaatcacttgaacccagtggagattgcagtgagccaagatagcaccactgcactccagcctgggtgacaaagtgaggctctaccaaaaagaaaaagaaaaaaaaagctccaatctgtgtgtcctgcctccccccaggaccaggcctgccaggcagcagtgggagctgacctttcagcagatccacaaactgaaagttgaactggatgtcatgcttcttcgagaagatgtagacggcacggcagggtgctgacagcaggtccatgtagagctccagggccatgttgagacacatgccaggccccacagctgcagctggccagccacagacctgggcctatgtctggccagagtccctggccctgtgccctctccgatctgggcccaggaccctgcattctggaacctcttgtttccctttgtgttgtcataaggccaggaagcctgcaattctcacagcatcaaggattctaaggaggcccaggagtaggctggcagaggcccgtggcaaaggtgtggcagccgtgaccctactctccccctctcacgtgtgtctgtgtcccgtggcgccacctcacagacaccctgtctgagaagggattatgcctgggaattcccagggccggactttgattgcagaacctgacgaaaggggctttgcagggtccagaatgaggaggaggcaatgagaattatccctggaggattctagaagtagaggctgggagcatccacaggtgaatggagcctgaactatgactagaaaggaattgggagaaagagacacaggaacctgggagcttcgggagcagtggggacaccaccaccaggaagtcagggggcactcggcaatgaaagtggcagatgcaataaaacttttaacatattgttgtataatgtacaataatgtaataaaaatacaccccctatacattattgttccaactctagctctatctattgccctcctcatatgaatccctctccccataccccattctctagttaatcttaactaggcctcctgtttatattagccacatcaagcctagctgtctactctatcctgtgatcaggatgagcatctaatttgaaatatgcactcatcggtgcactatgtacagtggcccaaacagtctcatatgaagtcactctagctattatcctcctatcagtcctattaataagtggttcatttaatttgtatatactcattggaacagaagaatttctctggctgctcctaccatcatgacctctggccataatatgacttatttccacactagcagaaaccagccgagcctctttagacctaacagagggggaatcagaattaatctcgggctttaacgtcgaatatgctgcaggcccatttgccctgttctttatagcagactatataaatatcattataataaatgccctgaaggccgcaagaggttcgtgggtgcagtgcacaggagaccatatctggggacagcagctgcagcagaccccaagctgggccatccctgccacttgccaggtggtgcttggcgaaggcaagcagctcccacccgcccggggaatacagcgcgacccccggcggcatgctcttcagcaccaccccaggaggtaccaggatcatctaccactggaaattcctgatggagtgttgaaacttacccgtgaccaaaacactcccaagggatctgcccaccattcccggggtcaccagccctgccagtgatgatccccccaacggaagccagccagagccacctgagcaatagtccagaagataagcagggcgggcagtgaagaagcacagttttgagatggacatttaaagcaccagccatcgcatggagcactgccaagggacccctcaggcccttcctggaggagtcccaccagccaggccttatgaaagtgatcatactaggcaggcattggtgtggggccagtcaccccagccctctctccctcactcgcggcacctgccccctcctctttgtgaacaccagcaggtacctccttgtgcctccgctgatgcaggagcagctgccccaaggggagtaacccctgccagcacaccctgcagctgagggccaggaagtggacaagaatgaaccctttcttccaaatgatcagctcttccagcccctgctgggggccccacgaccccttccttaggttgacgtgcctgggaaagctcacctccccctcttccctaagagaggaaataaaagccaccttcgccctagggcaaaaaataaataaataataaatcccgtaatcactattgtcttcctaggagcactgcataacatatatataccagaactctataccacaaatttcgtcacccaaactctcattttaacaagtctttttttatgaattcgaacatcatattcctgattccattatgatcagctcatatatctccttgaaaaaattttctaccactcacactagtactttcatatgacatatcttcatgccagtcctaacctccagcatcccaccccaaacataagaaatatgtctcacaaaagagttactttgatagaataaattacagaggtttaaacccttttgtttctagaattacaggaattgaacctacccatgagaatccaaaattctccgtgctacataatacaccacatcctatcacaccccacagtaaggacagctaagtaagctattgggcccataccctgaaaatgttggttatacccttcctatactaattaatcctccagtgtatgccatgcagaggagcccagaaacttcctggcctgggttggggctgcagtggccagactgtgcacctggtggcccaggaaggtaactagagccccacgtagaggactgagtgccactcactctatgctttgtgatttaataggtctaggctcagaaatgggactgatcccacttccagtgacagagtaagcctggagacaagcgaagagcatgcagtgtgtttattgcagacagcagggtgcagtgcagtgggctgtacccactcagtggagccactcctgcagcaactgcacctgcttctgggccagctgggggtcctgccgagcctcactgtggttcagaggctggagtatgagcttgtgggcctccaggaagagctcagtaccaagggcagccttcatatgggcctgtcacactgccagccagggccagtcttggaagaggtcgcagccaacggcagtgggctgggaagacagggcagctggggttggggctcagccccatgcccagagtccccccgagggcaggtgggtaggaaagcttcacctgcatcacctccgtcagcaccaagtcttccagggagatctgctccattgccaggaagggcctggccaccaggacccccccatccaggtgctgcagggctggcgtcagcctccccaacagccgctccagctgtgcagcatctgcaggctgtctggagaagtggggcaggagagactgggctgtgaggagaggagcaacttaacccagactcttggaagcctcttgggcctcctctccatcccttcccggctgccattcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtaccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatctgggtgacctacgtcctttccccatctgggcagctccagctggcttagactctagccaggttccagcctccagctttagcccaaaggtgcccctgggtccagcctctgcatcggagctacacaggctgaaatgaggaaggggccacagtgatttggaaagatctccaacccaaggaaagatctcccctctcgcctctgcctccccctacaactctgagccccagaacccaggcagatcctggctctgaccctgggtgggcaccaggtcaccattacctctctgctagtaggaagtcgccatctctgagggcaggcaccttccccagggggttcaccttcaggaactcaggcttcaggtgctcccctggtgggcagaaaggagagaaggctcagtgcagggcctggtccttggcacccactccatggggcccagcccagccacctggctcaccccaagccaactccactgtctgcagctgaaaagggatgtcattctgcctggcaaaagtggatagcatggcagggggctgagtgcatgtccaggaacagcttgggccccattgctgctcctcccacctgccctccccagaggtctgtacctccaggagttgctcagcccttctcggccagtgccttcccccaaaatggggccagaactctgtactcctcctgaagcctattccctccatgactggctgggaggcctgccaagcccctctccccttttctccacctctgtagagtggaggcaggggtggccagtgtccctttgggggtttcagatagaaactcaatgacaattggcttagcaaaaacaaacaaacaaaaaaaaaacaacaaaaaaaaaacaaagggagtggggtgggtggggagatttctcagaaaacttctccagtcataggaggggaggggtgtagaagccactaagagaactggaatcagaacctgtttctgtctccccacttttcctcccctctcctcctctcccctccttcccctcctgtcccctcccctcctctcccctcccctcccttccctttccttccttcccttcctcctttcctcccttctttctttgagacaggatctctgtctccctacacttttttcttttaattctctgtctctttcttgacatagaatcttgctctgtcacccagcctggagttcagtggcacgatcatggcttactgcaatctccaagtcctgtgctccagcagtcattccactacagcctctggagtacctaggactacaggtgcacatgaccataccccactagttaaaaaaaacaaaaacaaaaacaaaaaaacccttgggcctggcagggcggctcgtgcctacaatcccagccctttgggaggccaagatgggctgatcacatgagcccaggacatcaagacgagcctgggcaacgtgccgaaacccagtctctacaaaaaatacaaaaattagctgggcatggtggcgcatgcctgtagtcccagctactcaagagactgaggtggcaggatcacttgagcccaggaggcagaggttgcagtgagccaagatcacgccactgcgctccagcctaggcaacagagccagactctgtctcaaaaaaaaaaaaaagagagagagacagatagggtctcactatgttgtccaagctgatcacaaactcctggcctaaagtgatccttgggtctcagcctcccgagctgattagctgggattgcaggtgtgggctaccacgccctgttatcactccctttctctgagtcagcttttctctctcagactagcctactccatgaactcaggaaatgtcactacaggtggccccagctcccatttacctccccatagggagctcctctctccagttccaatttcaaaactcccaaggaagcattctggttcactcgcttgggccactggccagagggatgggatactctgaaagattcagctagagtcccgggcccagccctggaccatcactgtgcaccctggttagatgccagggctgggattcagggagaagaaaggaggttcccggacagtcattcctgcctcctgcggctgcgggctccctgcacagtcattcctgcctcctgcggctgcgggctccctgcccccatcctgtgcacgaagtgggagctcccgctgtctggcagcagctgctctgcaggggacagtctggacggcagaaagttcatccttaaccccagccttccagtcaaggttcccacaagtctgggacacctgcaagtgtcatatcccgctgggtgaaagtctgagatcccttttagaggatcccattcgctccctcccttctgccaccttccagctccgagaaacagagctctgaacgaaccctcagatgtccatgcgctggggcctttccaggacggcggggcgcagtcctttctgggttggggtgacacctggaaacatgtaaggtccctggcacagggacccctcccagtttcaagcgattctcctgcctcagtctcccgagtagctgggattacaggcgcccaccactgcacccagctaattttttgtgtttttagtagagatggggtttcaccgtgttagccaggatggtcgcgatctcctgacctcgtgactagcccgcctcagcctcccaaagtgctgggattacaggcgtgagccaccatgcagggccaatttttgtattttcagtagagacagggttttaccatattggacaggttggtctcgaactcctgacctcaggtgatctgcctgcattggcctcccaaagtgctgggattacaggcgtgagccaccaagcctggtggtaatttataaggggtggacatttgttggctcatggtcctgaaggctggaaagtccaagatcgaggggccagcatctggccagagctttcttgctgtatcatcccctggtgaaaggataaagagagggtaagagagagcaagaggctgaactcacagcctcaaagtccttttataatccacatcaatccatctgtaacggtggaggcctcatgagataaacacctctcattaggccccacctcccaacactgttgcattggggattacatttccaacacatgctttgtgggggacccattcaaaccacagcacagggacaccttctctttccttcctgtgatatgctgaataatgacccctaaggatatacaagtcctgatctctggaacctgtgaatattaccttctgtggcaaaagggactttgcagaattgattaagaatgttgagatggaggcattgtcttggattatctgagtgagccctaaatgcagtcacaagtatctgtgtaagaggagacagacggagatttgaaacagaagacaggagaagatggaagcagagagatttgaagatgctacattgtgggctttgaagatggaagaaggggctacatgacccaagacaggcagctccaaaagctggaaaaattgaggaaaccaattcccctctcagagcctctggagggtgtgcaaccctattggcacctgggttttggcccagagaaatagattataaagttctggtctccataactgtaagagaatagatttatgttgttttaagccaccaaggtggtggtaatttgttataccatccagaggagaggaacacagattttggtgccaggaagcagggtgctgctataaaaaagaaaatctaggctgggcacagtggctcatgtctgtaatttcaacattttcggatgccaaggtgggtggattacttgagccctggagtttgagactagcctgggcaacatggcaaaaccccgtctctactaaaaatatataaattagctggggatgggccgggagcagtggctcacgcctataatcccagcactttgggtggcaaaggcaggcggatcacgaggtcagaaggttgagaccatcctggcgaacatggtgaaacccagtctctactaaaaatacaaaaaattaaccaggcgtggtggcgggtgcctgttgtcccagctactcaggaggctgaggtagcagaatggcatgaacccaggaggcggagcttgcagagagccaagatcgtgccactgcactccagcctggggaacaaagcgcgactccgtctcaaaaaaaaaaaaaattagttggggatggtagtgcatgcttgtagtcccagctactggggagaccgaggtgggaggattgcttgaggctgggaagtctaggctgcagtgacctgtgactgtgacactgcactccagcctgggcaacagagtcagaccctgtctcaaacaaacaaacaaacaaaaatctaaaaatgtggaagtagctttaaatttgggtgatgtgcagaggccagaaaaattatgaggcccatgatagagaaaacctagattgccttgcacagattgttggtagaaatatggatgttaaagactatagggagggctcacgagtatcaactaaacatggtcagagcaagtctacattgccttacagcatacctaagtcatcataggcagctgtaggtagatatatagatattggctgggtgcagtggctcacgcctgtaatgccagcactttgggaggctgaggtgggtggatcacctgaggtcaggagttcaaaccagcctggccaacatagtgaaaccccgtctctactaaaaatacaaaaattagctaggcgtggtggcatcccagctactagggaggcggaagcaggagaattgctcgaacctgggagacggaggttgcagtgagccaagattgcgccactatactccatcctgggcgaccaagcgagaatctgcctcaaaaaaagaaaaaatagatattaaaaatcctgctgctgaggactctgaagaaatgaggaacgtgtttctggaaactggaggaaggaggatcatttcccagaaaaggagcccgtagggaggtagaaagcttagttgaattgtgtccgatagttatatggtgggtgaacttaaagcaacgaagttggatatttagctgaggagacttccaagcaaagcgttgaaggtgaagcctcatttcttcttgctgtttatggtgaaaagcaagaggaaagtgataaaatgaggaaaaagctgttaagcaaaaagaaaccaaggtttgatgatttgggaaattatcagcctgtgcagattgcaaaagatgctaaaattagaagattcgctgtttggaaaacacaactctatccctgtcctggggatcactcaagacttgtatccatagacaaccagatttctatgggcttgaactctgtgtgtgtgtgtgtgtgtgtgtgtgtgtgtgtgtgtgtgtgtgtgtgtgtgtgtgtagcaaggttgggggagcacagtggaaagaccttgaatttatttgtttattttttagacggagtcttgctctgtcgcccaggctggagtgcaatggcacgatctcagctcactgcaacctccacctccagggtggttcgagcgattctcctgcctcagcctcccgagtagctgggactacaggcgtataccactatgcccagctaatttttgtattgttagtagagatggggtttcaccatgttggtcaggctggcctcaaattcctgacctcaggtgatcaggctggtctcaaactcctgacatcaggagatccaccagcctcggccttccaaggtgctgggattacaggcatgagccaccatgcccagccttattatttatttatttatttttgagacaaagtctccctctgtcacccagactggagtgcagtggcgcaatctctgctcactgcaacctctgtctcccaggttcaagtgattctcccagctcaacctctcaagtagctgggactacaggtgcgcaccaccatgacctgctaatttttgtatttttatttatttatgtattattttattttatttttccataagttattggggtatgggtggtatttggttacatgagtaagttcttttgtagcaatttgtgagattttggtgcacctgtcaccccagcagtatacactgcaccatatttgtagtcttttatccctcaccctcctcccactcttcccctcaagtccccaaagtccattcttatgcctttgcgtcctcatagcttagctcccacatatcagtgaaaacataagatgtttggttttccattcctcagttacttcacttagaataatagtctccaaactcatccaggtcactgcaaatgctgttaattaattccttttcatgactgagtagtattccacatatacatattccatatatattcattccatatatatattccatatatgctcattccatatacatattccatatatgctcattccatatacatattccatatatactcattccatatacgtattccatacgtatgtactccatatacgtattccatacgtatgtactccatatacgtattccatgtatgtattccatacgtatgtattccatgtatgtattccatgtatattttccatatgtatatattccatgtatatattccatatgtatatattccatatatattccttatgtatatattctgtatgtatatactccatgtatatattccgtatatctatattccatatatgtattccgtatgtatatattccatatgtactccatatgtattccatatgttccatatatattccatatattccatataaattccatatattccatatatatcccatatacattccatatattccacatatattccatatacattccatatattccacatatattccgtatattccatatagattccatacatttattccatatatattccatatagattccatatatattcagatatattccatatttatattccatatatggaatatatatgtattccatatatatgtattccgtatatgtatgtattccacatatatattccatatatgtatgtattccacatatatattccatatacgtatattccagatatatactccatatgtatatcccagatatatatattccagatgtatatattccacatatatattccagatgtatatattccatgtgtgtatattccatatatgtatattccatgtgtgtatattccatgtgtattccatatatatattccatgtgtgtattccatatatatagtccatgtgtgtattccctatatatattccctatatatatattccctatatatattccccatgtacattccatatatatattccccatgtacattccatatatattccccatatatattccatatatattccccatatatattccatatatatattccccatatatattccatatatatattccccatatatattccatatatatattccccatatatattccatatatatattccctatatatatattccctatatatattccctatatattccatatatatatatatatatatatatatatatacaccctatatatatattccctatatattccatatatatatggagtctcgctctgttgcccaggctggagtgcagtggcgcgatctctgctcattgcaagctccacctcccaggttcacgccattctcctgcctcagcctcctgagtagctgggactacaggtgccagccaccatgcccagctaattttgttttcgtatttgtagtagagacggggtttcaccatgttagataggatggtctcgatctcccgacctcgtgatccgcccacctcggcctcccaaagtgctaggattacaggcttgagcctccgcgcccggcctctgaattctttttcaggtaaatcagggatttcttcttggtttggatccgttgctggtgaactagtgtgatatttgggggtgttgacgacccttgttttgtcatgttaccacagttggttttctggttccttctcattggggtaggctctgtcagagggaaggtatagggctgaaggttgttgttaagattttttttgtcccagggctattcccttgatgtagtctctcccccttttcctgtggatgtggcttcctgtgagccaaactgcagtgattgttgtttctcttctgggtctagctgcccagtgagtctagtcagctccaggctggtactgggggttgtctgcacagagtcctgtgatgtgaaccgtctatgggtctctcagccatggataccagcacctattctggtggaggcggcggacggtgcagtgcactccgtgagctttggtggtttaatgctctatttttgtgctggttggcctcctgccaggaggtggctctctccagaaagcatcaactgtagtagtgtggagaggggccagtggtgggtggggccctaggactcccaagattatgcgtcctttgtctaccactactagggtgggtaggaaaggaccctcaggtgaggacggtgctaggcatgtctgagatcagactcttcttgggcaggtgttgctgtagctgctgtggaggatgggggtgagatgcccaggtcattggagttgtgtgcctaggagaattatggctgcctctgctgagtcatgcaggttgtcagggaagtgggggaaagccggaagtcacaggcctcatccagctcccatgcaaactgaaggggcggtctcactcccaccatgtcctgcaaacagccctccatctggaaacagcaaacagtgtgtttccagatggagggccagacgaattgaaaacttgcctgaggctttccacctcccagctgccaaagaaaagggctttagttcttcctccgcctgtgaaatctgcaagccagattcacaccctcccctgggttctggcccagaggcttctcaccccattcaaattgttacaaagttcagctagagaattccttctccctgtggagctgtggagttttaccccttgctttctggccaccctcctgatggatccctgtggtgccaggcaggaatgggctgcttggggatccagtgagctcccagggcctttctgctgcttcctctgaccctgtattttgctcggctgagttttgtaacttgactcagctccaggaaaagtcggaaacttcttccacaaacaggccttcagcttctccagtgggggtgtgtgctcaggagaagcgggtctccctttcccacttccacagctggggcactcacagtatttggggtgtctcctgggccctacaggagcaagtctgcttccttcagagggtctgtggatcctctcaggattgctggtttgttctttcagtggatctgcagctaaaattcacaatgcaagcctccacatgctgctctgtccggagctgcaatctggctatgcctcccgtctgccatgatcccgaaatccctctccaatttttatatttttagtagagttggggttttgccatgttggccaggctggtattgaacttctgacctcaagttatctgcccatctcggcctcccaaagtgttggtgtaccaggacaagctgcagacaaaacctctgagacaccaagttaaagaaggaagggctttattcggccgggaacttcagcaagactcacgtctccaacaaccgagctccctgagtgagcaattcttgtcccttttaagggcttacaattctaaggggtctgtgtgagagggtcatgatcaattgagcaagcagggggtacacgactgggggctgcatgcaccagtaattagaatggaacagaacaggacagggattttcacaatgcttttccatacaatgtctggagtctatagataacataactggttaggtcaggggtggatctttaaccaagcccaaggtgcagcgccgggctgtctgcctgtggatttcatttctgccttttagtttttacctctttctttggaagcagaaattgggcataagacaatatgaggggtggtctcctaccttattggggttacaggcatgagccaccgtgcccagccaagaccctgaatttaaatcctgactctgtcattcattagctcctgacctcaagtatgccattaactactttgaatcctggtatccttgctgtcaaaggagatgagagttctgacacttataggtccactgtaagacataatttttaaaatatctgtaaaaactgggccgggcatggtggctcatacctgtaatcccaatactttgggaggtcaaggaaggcagattgcttgagcccaggagtttgagaccagcctgggcaacatgatgaaaccccgtctttaccaaaaattcaaaaaaatttagctaggcattggcacgtgtctgttagtcccatctgctcgggaggctgaagtgggaggatcactggagcccaggaggcagaggttgcagtgagccgagattgtgccactgcactccagcctggcagagtgagaccctgtctctacaaaaatgtaaaataaacttaaaaaatgtcaaagcatgataaagtacaggacataaagaccatgattaatctaacacccatcactacaatctttgcctctgttctggcattcccctatgtgtcttcgcatcaccctccttctgggtgactcctttatgttgtatttttttgtttggtttggtttttttggttagtttgttctgagacagagtcttgctctgttgctcaggctggagtgtagtggtgtgatcttggctcactgctacctctgcctcccaagtttgtacctcagcctcccgagtagttgggattacaggcatgcgccaccatgccctgctaatttttgtatttttagtagagacggggttttgccatgttggccaggctggtctcagactcctggctcaagtgacctgcccacctcagcctcctaaagtgttgggactacaggcatgagccaccacgcccggccaccccactcattttgaatgtaagtagattaccaattctgaaatgggttttgagcagtagcaacattgacacaaatttataatattttcaagaagatacttccttcaatatgtaaaatgcaacagatatcatttgcaatcatacatatgtacatatatacatacacacatataatatatatatctcaccatggaataagtctgagctgaaacatgcattacttaaaaaagaaaacacttacagacaggatcttgctccgtcatccaggctgaagtacagtggcacgattgtggctcactgcagcctcgacctcctgggctcaagtgatcctcccacctcagcctcccaagtagctgggactacaggcatgagctacctcgcctggcctgcatgatctttatgaagaatgtcatagaaagtttttgaaagcgattaaagttcacctaaacaagcagggatctatgctgtatgccatgctattattggggaggaaaaaaattctcctctacattcttagggtctctggagatctggaactaagaataaaactgaaataagacagattaacagaagaaaatcattcaagttttgctaaattttcagtgtacatgggtactttcacaagagaatgaaggcctaaagaagtcactaaagtagaaaaacaataccttttttttttttttttttaagacaaggacgggtgcggtggctcatgcctataatcccagcactttgggaggccaaggcgggcagatcacaaggtcaggagattgagaccatcctggccaacatggtgaaaccccatctctactaaaaatacaaaaaaattagccaggtgcggtggcgggcacctgtagtcccagctactcaggaggctgaggcaggagaatggcatgaatcctggaggcggagcttgcagtgagcggagatcgcaccactgcactccagcctgggtgacagagcaagactctgcctcaaaaaaaaaaaatgacaagacaaagcggcttggattatagggagtaaattgtggagaagggactaggacatacatgcggagcaaaattagaagataaggattatttttagtcgtgtgtttatacagatccattggaaccttgattcacagtcacttgtgatgacaatgttcttctcttcctggtaaagggagggtgctttcttatgggaaattgtgtggcctattcttagatagaaaagggcaggtcagagagtctttcctgcatgtgctatttctcaagtgccttcaactcaaaataattaatactccaaagcagcatatttggggtgacgtgtttttaattccttcatttcccctgctgcagactttcctagaagtttcagatattaaaagctgagttggtggctatggagataagagccagattcataacgagggatctacaaatggggagaagaacatagataagaataggaatgaataagctgaaaggaacaggtctgagcacatttccccttatcctgttaaacacacatcccattgctgggacaaggtcagtacagcagaaggaatgcacctcttttgtttgatggagagtgtttagcttgttctttaacaggtgcagcttaggcactatttgtcccagtggatttacacagaccagccttatccaccaatgatcacacaaactcctccttttgaggctgtcagtgtgtccagggtgcaacaattttggaatacagcagaagctaagctattaacttcttttgttgtggttgctgttgttgttttgagacagaatctcactttgttgagtgcaggctggagtgcagtggtgcgatcatggcttgctgcatccccagcctcctgggctcaagtgatcctcccacctcagcccccagagtagctggaactactactatgccctactaatttttaaactttttgtagagacagtctcactatgctgcccaggctggcctcgaacttctgggctcaagtgatcctccctcctcagactttcaaagtgctgggattagaggcctcagccaccatgcccagattgctttgacatcttgaggccttactgatccaggagagactgcccctccctgggccagctaattcctacagagaataaatgatttgcttatggtgtgccttcgatgggccaatcaaccgattcgtatctccaacataactttaccagccacctttcagcaggttcctgccccaaatcactccagggacaggtaccaggtaacaaaggaccactcctataacccagagcccatcacaattattaaaactagccagtcctaagtctgtttaccctgtcttgccttcttgcaaaaaacacagtaaagccttttgtccaccttttgccctcactcattctgccacctgactgaccctggtgcttccccatggccctgcatggtgtggcatgtcccccctattgtcttgggaactgtgagtaacaaactttcttttacatggctatcacctctgatctgtggcctcgccatacctgaataaagccaaaatcccaggtacattttaaaacaagtctacaagtcaaggaataccaaggatttccagcaacaccagagaggccggcccacgcccggcctgactcttactgttaatcactagttttgcatttctcttgaggaactagtcaggaggagaaaacctagacagcagctctcctggtcaagacccagtcattcagaagcctaaatggcatgcctaggtgcttggctttaaactgttagcaggtatggagtgctctgattgtgttttagaataatattctgggctgggcacggtggctcacgcctgtaatcccagcactttgggaggcggaggcaggcggatcacgaggtcaggagattgagaccatcctggctaagatggtgaaaccccgtctctactaaaaatagaaaaaattagccgggcgtggtggtgggcgcctgtcgtcccagctactcgggaggctgaggcaggagaatggcgtaaacccaggagtcggagcttgcagtgagccgagattgcgccactcattccagcctgggcaacagagcgagactccatctcaaaaaaaaaaaaaaaaaaaaaaagaataatattctggctgctgctggaaggcagccagggaggaagcaaggacattggatactgcagtaatcctggccaaaggcgacttgtgaaaaggggtgggcaactgaaggggcaggagaatgtggcccctctcagtctggagagagctgcagcactaggccaggaaggcactcttctgcggggggataggtcttaaatggggaccatgggattgggtgcagtggctcatgcctgtaatctcaacacttcaggagtctgaggcaggaagaccacttgagcccaggagttggagaccagcctgggcaacatagtgagaccctgtctcaaaaaaaaaaaaaaagacaatttaaaaactagccagatgtgatgcctgtggtcccagctacttgggaggctgaggtgagatgatcacttgatcacttgagccctggaggtcaaggctacactgagccatgatcatcccactgcactccagcctgcgcaacaaagtgagactcttatctcaaaaaaggcgacaggtgggaaccatggggaaccagagaagcaaagctattctcaagttttccagtaaccatcctcttgccaatggtctttctctgaatcttggatttgggaataggattttcctgccttgggaggctcccttgggaaatgggagtgtcacagccacaggcatcaaaagccctagagttgcacttgaatagtgggtagaaagttctgtgcaatgccaggcactgttggaaacctctgggtagggcttacagggccttagccatctgtgggaggcattagctggagtgtaataaatatgaccctcaggactggggagaaacagctcattccttcatgaggtgtggggctggcagccttgcaggcagccagccacccttcccctctggcctccatcctgggcactgagccaggcactgggtaagaaggctgctgcacctcctttctcctcttcccttttagagagaaagatacccccagccgaggatcccagaaaggcgagagcagacgcgccattgattggcccaaagttctccggagccaacctttgagcaaggagggcgtggctgggctccagtctcctagtgaggtgcaccactgcaggcttggtgacccagccgttcctgcccgctgcccccaaccagccgttcctgcccacagttcctgttcccgggcctgtccccgggtttgtccccagggcccgtcccctgggtttaggtctaccctccctcgccccaccccatcgccctcgccatgggtctggagctgtacctggacctgctgtcccagccctgccgttcagtctacatcttcaccaagaacggcatccccttcgagcttcgcaaagtggagctgaccaaagctgggctgggcaggcaggcccaggggatattggctgcggatccccacctgtccccactgctttgcagtcgggccgagaatgcagactaacatgaagaatcagactctctggtgtggaaactattacgtaattatctatgttattatttttactttttggagacaggagctaactctgtcactcaggctggagtgcagtggcacaatcatggctcactgcagcctcgaccttccaggctcaagcgatcctcccatctcagcccctcaagtagctgggactacagatgcccaccgatatgcccggccaatttattattattattattattattattactattgagaggaggtcttcctgtgttgcccaggcaggtctcaaactcctgagctcaggcgatcctctttccttggcctcccaaagtgctgggattacaggcatcagctgtcatgccctgctggttgtttattttaaaagaggcttcatctttgcttagtgaatacaaagcattcttcaaaatacaggttaagagggggcagagcagatgcagcaggagggcagggaaatggagtggggctagaatatcttcaccccatgtgcttggaaaaaacaatgaaactacctccttgtttcctaagtggagtagtccttgtttacctctgcctgggtctcttcccttcttgcctcttctttttttgacacggtctcactctgcagcccaggtagagggcagtggcatgatcccggctcactgcagccttgacctctcaggctcaagtgatcctcccacttcctcctctcaagtagagtagttgggaccacaggcacgcaaccacatccagcaatttcttttttttcctttttttttttttttttggtatttgtggagacgggattttgccatgtagaccaggctgaccttgaactccagagctcaagtgatcctcctgcctcctccttctaaagtgttgagattacagacatgcactaccatgtctggccctgggtctcttccacttttatgtatttcttggcattcttctgccttttcttttcctgcatctgacttgctctatcccatggggcttctcacccagctgaaggggctgctcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagaaggaggaacctgctcagctgactcttcccaactgctgcccttggtacaaccagcttgagtcacctgctacagaacaggggctggacacagaagcagtctgtggagggagaatgggcaggggtgtgcatgtccattcagtagaaggccagagaggcccacatgtaggcctatgatcagactggagcctggcttgactgatgccctctgatccaaacaccaggcacctaatgcggcctctagcactggcctagagtgctaaagtgagtcagacctgggaacccccagtggggagggagccttgagagtttggcacaagaaaggaagaagagctgagccaccgggggctgagtggctgaatggggcagggattcccagcaagaatgaggttggtctgagggttgggaacatgtttggctgggactctggggtattgacaggtcacccagcctggccagtagggcctaaggccccagctgggataggaagctgaatcagagggggcaagcctagagcccagggaggaggctggaggggtctgacctatggatggaactggctgggggtggggtgtgaattacagctccagggaattgtccttgagccatgcttcaaggaactggacacaggaaaggtggccctctgatagggtcagggtctgtgacccagtgactaacagagaggcttcctcttccctgatgcctcccagataggggcctcagaaagctgctgctgggagtttggagtgggggtgggcagagacatcagagaactcagggttctccccactcacctctctgatctcgcctgcaggccagcagcacagtgatgcctttgcccaggtgaatgccctgaggaaggtgccaggccttgaaggatggggacttcaccttggctgagaggtaaccggtccctgggctgctgccgggccttgtggggccagtcagtcagctgtctgtttactgctgatggcttggatcatggactgtgggccctgcaccagccccagggtgaagaatgggtggaggcaggcagaggtgcccagtgttgacaagggctatagaagtcccctcctgcattgtacaagtgaggaaactgaggctggaggaggggagggacttgcacaaggccacagggcccagtctgcttccgggcctcctcaccgccagtcttcccctccgaaaaaaagagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctacgtccttctcctcatggagctcacattccattaatagaagggggagctgacagtaacccatgtaaacatggaacatatcggatgttgatggatgccatggaaaaaataaacagggtaagagtgggggtgtgtgtcattatgagtaggatgttgagggaagactccctggaggaggtggcatctgagcagagagctgtaggaatgtgcaaggcatgaggggaagggtgttctcactggagggaagagtgagggcgaaggctccaggtgggacaatgcatggggttcagactggagagcaacgggccagggtgggtgcagtgagcaggaagagcaggaggtcatgacagaggggagcatgggacactgggaaggctttggctcttaccacaggtagattgagtcgctggagggttttgagcagaggagaactgtgatctgacttacgtcataaaggatccccctggcaggggtgagaaagccactgcagtcatctggcatgcagcgctggagccccagaccaaggtggtggtggtgcagggttggtggggattgtggtcagttctgacttttattgaaatctaactgcagggtttgctgaagggttggaggtgggtgggaaaaatgaaagccaaaaccagcctctaggttggtggctgcatggtggcgtcctttaccgaggccaaatagtgcctccttggtggagctggattcacattcagagcctgggatcactggatggtccaacacccatagaggcatgatgagctctgggggtcagactgcacaacccttcaccataggtgaacaggagatgggacagggtggggagcaatgctgccatgtcacctggaaggctctctccctgctggccttgctcctggccctgtccacgctttggatatgttggggagatatccaacatgctctcgttcttcagactcacagtggatgccccttcctcctggaagccttccctgagcccctgctgaagttcatgacattttgtttcttacttgctgcccttagttgagatgatagtctggccccgtgtagggctgtgtgaccctgggcacttacctaacctctctgagcctcacatccctcctctgcatcatggggatagtgaaaatgccccagaaaatggctgaagagtgttcagggcatgttttctgcccctgccatgtccccccagtgtggctagcttgctgtgtatgaactgcatgtacaaagcacctgaccactggtacccccaggacctgcaggcccgcgcccgtggggatgagtacctgtcatggcagcacatggccctgcagagtagctgctgctgggccatgtggcagaaggcgagccatggagggcagggacatctcccaagatgccaagggatgctgctttcactttacaaaatcctgtttagacctgagaccaaatcctggaatgccagagactgcctaattcacccaacttgtttcctaggagggaaaccaaggaccagagccaaggaaggattcccctaatatgccttaattccagagctatgagcagttaatcctatgctcttttgcatactccaggttgcctgggaatcttgcctttagggggagaaaataaacaaaccctcactttgctacacacataattcgtagatggagaagtatgaagtgaaaaaagtcaaactaggaagaagtgaggagacatttcaataaacgtttgtctgatgtctcggtatgaaaggactttctaaccctcagaacagtgggagaactcaacaaagaaataaccactacatgccagctgcggtagcatctgtaatgagcacacctgtaatcccagcactttgggaggccgaggcaggcagatcacctgagattgggagtttgagaccagcgtgaccaacatggagaaaccccgtctctaccaaaaatgcaaaattagccgggtatggtggcgcatgcctgtaatcccagctactcgggaggctgagtcaggagaattgcttgaatctgggaggcagagattgcagtcagctgagatcacgccattgaactccagccttggcaacaagagcaaaactctgtctcaaaaaacaaacaaacaaaaaaacatatacaaggacatgttgtgtaagaaaaaatggattaaacataaaacaagcaaaaaaccgggaaggatcttgataaaagatatgtcagaaggaggtaatgttctttaagatgctcttagaaacccttaagagaggcctggtatggtggctcacccctgtaatcccagcattttgggaggccaaggtgggcagatcacttgaggtcaggagtttgagaccaccctgggcaacatgatgaaaccccatctatattaaaaatacaaaaattagttgggtgcggtggcacactcaggagactgagacaggagaatcacttgaacctgggaggcggaggttgcagtgagctgacatcataccactgcactcaagctccacttagagcgagactgtctcaaaagcaaacaaagaaaaataagagaaacccatcagacaagagacaggaaaaaaatgagtcatagctcactgcattctagatctcctgggctcaagcgatcctcctgcctccgcccaggtagctagaactacaggtgcacaccacaacactgggattctttttttttttctttttttttgtagaaaacaacgaagggaatcttgctatgttgcctagcctggtcttgaactcctgggctcaagcaatcctcccttcttggcctcccaaagagctgagattacaggtgtcagccactttgcgtgaccacaatttcaatcatatttaaaatgtacaattcaagtgattttgccacactaaccacagactcatgtttaagccacaccaacggatttccatgttttaaataacatattttgccaccccctagtggacagtggctcaccaccggcacaaggggctacataggcagtcaatgggaaccaggcggggacgggaaatgtcgtgaacccaacggtccctgcccagccccacccgcgtccgcaacgtgtaaccacatctcctgactgcccaagagaagcgcagatttccatactgaacatgaaattgcctgacttcgaaatggtggcaaatcattaaaaaaaattttaaactcactttgcattggttattagggtcgaacttggggaagacccctacaggtgtgtgtgtgtctgtatgttaggggtgttcagacctttaatagggctagaaaccaggcaaccacaccgcggaaagcttgaggagagggaaatccaccagacgccaagcaggagggtcagggaagagacagggtggggccactaccgggttaaagacttgtagtgggtggggctacacgtagggccgagacgaccggatttccggaaatcagagccggcacacgtgacttttgtttgcagaagtgggaaggtaccctaggcagccaatcggggagcgctgagtctctgtccagccaatgagaagccaggttgttttagcgcctcgcccctcctctccggtccgcgagccttgggtatctccagcttttttccgccagagctgtttccgttcctctgcccgccatgccgttcctagagctgcacacgaatttccccgccaaccgagtgcccgcggggctggagaaacggctgtgcgccgtcgctgcctccatcttgggcaaacctgcagacgtgagcgtgggccgggcagcactgggcgaggggaagttggtgggccaggggtccggccttgtccctgctctgcctccgcaacagcgaccccgatccctttccccagggaccaccccccaccccattccgcaggccaagctctgactttccgtgcttcacgatcccgcggctccccctccgcacgtctttcccttgtcgccctccccagtcatgacccggacgtgaccttcagggacctcggcctgtactgggatccctgtccccgcgaacactgcgcgtttcggctttcgcgcgctcgggtcgggaccccagacgtagcccgactggctccagcttcgggtaaaacttttcatgttcccctcagcttgtgaacgtgacggtacggccgggcctggccagggcgctgagcgggtccaccgagccctgcgcgcagctgtccatctcctccatcggcgtagtgggcaccgccgaggacaaccgcagccacagtgcccacttctttgagtttctcaccaaggagctagccctgggccaggaccggtgcgcaggggtagtaggcccggaatattattctaaaacacaatcagagtactccattcctgctaacagtttaaagccaaacacctaggcaggccatttaggcttctgaatgactgggtcttgaccaggagagctgctgtctaggttttctcttcctgaccagttcctcaagagaaatgcaaaactagtgattaacagtaagagtcaggcagggcgcggtggctcacgcctgtaatcccagcactttgggaggccgaggcgggcggattatgaggtcaggagatcgagaccatcctgactaacacggtgaaactccgtctctactaaaaatacaaaaaactagccggacgtggtgggcgcctgtagtccccgctactcgggaggctgaggcaggagaatggcgtgaacccgggaggcggagcttgcagtgagccgaaattgcgctactgcacaccagccggggcgacaaagcgagactgtctcaaaaaaataccaaaaaacaagcaaaagaaaacaaaacaaaaacagtaagagtcgtcccaacgcagtggcttatgcctgtaattccagcactttgggaggccgaggcaggcagatcacctgtggttgggagttcgagaccagcctgaccaacatggagaaaccctgtctctactacaaatacaaaattagctgggcgtggtggtgcatgcctgtaatcccagctactcagaaggctgaggcaggagaatcactttaacccgggaggcggaggttgtggtgagctgagattttgccactgaactccagcctgggcaaaaagagcaaaactccttctcaaaaaaacaaacaaacaaacaaaaaaaaaaaacacacacacacacaatccaaaaaccagtaagggtcatgtcctgggaggctaactcagccgactgttaggtcaccatgcttatagccaagaaatgtgggatgctgctgggccctgagcggtcagataaactactttctctgataattagaaggctacaggaaatgttttgttttgttttgttttgggtttctttgtgtgtttttagagacaggatcttgttctgttgccccaggctggagtgctatggctcaatcagagctcactgcagcctcgaactcctgggctcaagcaatcctcccacctcagcctcccaagtagctagaactacaggtatgcatcaccacgcctgactaattaaaaaaaaaatttcttttggttgcgtgtggtgtcttggcacccgtaatcccagcactttgggaggtagaggtgggagcatctcttgagcacaggagtgcagggctagcctgggcaacatggcaagaccctgtctctacaaaaataaaaaagaaatgagctgggcgtggtggggtgcacctgttgtcccagcttcttaggaggctgaggtgggaatattgcttgagcctgggatgtcaaggctgcagtgagccatgactgtgccactgcactccaggctgggcaacagagtgagaccccatctctgaaaaaatatttttttggggagccaggcacagtggctcatggtaatcccagcactttcagaggtggaggtgcacagatcatttgaggtacagagtttgacaccagcctggacaacacggtgaaaccctgtttctactaaaaacacaaaaattagccaggtgtgatagtgcgtgcctataatcccagcttctggggagactgaggcaagagaatcgcttgaacctgggaggtggaggttgcagtgagctgtgatcatgccattgcactccagcctgggcaacagagcaagacactatctcaaaaaaaaaaaaaaaaaagtttgttttgaaatcctggactcaagcaatccccccaacctggacctcccaaagtactaggattataagtatgagctaccacactcagccactttttttttttttgagatggagtctcgctcggttgcccaggctggagtgcagtggcgcgatctcggctcattgcaaggtccgcctcctgggttcatgccattctcctgcctcagcctcccgagtagctgggactacaggcacccaccaccacgcccggctaattttttgtatttttagtagagacggggtttcaccgtgttagccaggatggtctcgatctcctgacctcgtgatccccctgccccggcctcccaaagtgctgggattacaagcgtgagccaccgcacgcggcctcagccacatttattaatttcactcttggcaaacatcagggggaagctgacccacacggcctgggaagggggttgtcttttgcatagagaccatgaccaggtctgggacagaggaaagtcaaataaatcacacattagagttagaagcagaggctcaggctgagcccaggtttattatccaaaatcaaaatgaaatgcagtgattaaaggacacaaggcctcagtgtgcatcattctcattgtggctttcaggcggctgtggaagacagggtggggatggtggcttcgggaggtgaggtgctctgggacttgggcaagtcttaggcaagccattcctgctttctgggcctggctcccatgggccattagaaatgaaaatgctttgtggactgctgaggacggtgcaagggtgaggtttcccagctcaccggatcatggccagcacccagggcatcagcttctgctttatggtggggtctgcaggtgggaagtccttggccttcagaatgacctcatgggcctcctggaagaggtcctcccccactgctgcctccacgcgctgccgccatgtggccagcttgggtcggccttcgaagacttggcagccagcacccacgggctgtggggaaaagggtacagactggggatggatggttgtgagggcagggatgggcagcatctgatttggggaccacagatctccaggaggtgtttgcacacacacttaagcacagtgccatagcccggtgtggcagcataagcaggacttcagcaactagccagggccccctgcctagtgggttcacctgcccacagcactcacatgcatcagctccgtgatggctacgaggtcagctaaggagatgtgaggaccagtaaggaaggccttgttctggaggaacttgtcctcgagcaactgcagggtcacatccaactctgccagggtggctgccagtgtctggggagatactggctcacccaggaaaacagggaacatcacctggggattgggcaggcaaagtcgggagttactggagtagggagttagttttgatttgcatttccctaatgattagtgatgctgagcatcttttcttttttttttttttttgagactgagtcttgctctctcgcccaggctggagtgcagtggggtgatctcggctcactgcaagctccgcctcctgggttcacgccattctcctgcctcagcctcccgagtagctgggactacaggtgcccgccaccacgcccagctaattttttttttatttttagtagagacagggtttcactgtgttagccaggatggtctcaatctcctgaccttgtgatctgcctgcctccgcctcccaaagtgctgggattacaggcgtgagccaccgcgcccggccaagcatcttttcttgtacttgttggccaaaatgataatattctcaacacattgggttaagtaaaatatatcaatttccttttactttttttttttcttttgagacagtgttcagctctgtcacccaggctggagtgaagtggcaccatctcggcacactgccaactttgccccctgggttcaagcaattctcctgcctcagcatcctgagtagctgggattataggcacaggccaccaagcctggctaatttttgtggttttagtagagacaaggtttccccatgttgaccaggctggtctcgaactcctgacctcaggtgatccactgccttggcctcccaaagtgctaggattattggcatgagccactgtgcctggactctttttactttttaaatgtgcctactagaaaatttaaaattacgtatgtggctcactttatacttctatcggacagcacttgactaaatgaactaaattccagagaggcataagccgttcctagatgagctactttcattccaatttcatttccttgggcccaagcaggctgggagaaagactgtcacaggcatgggcttttctgactgagcagcagtttgggaactgggggcagggatgaaaagcagagagatcttacaggcaacatcgtagttggtgattagattccaaagccatgctagactgagctagtgacctgatctcacattcaagatatttgaaaccaaagataaactgaaaccaactaaacctgcaacccagcccacctcctgattagcttagaagagaacagcctcacatcctggctacctgacacagggaagtgcaagccctttcttgggggtgtttattatgcaattcaatctctgctcttcttttatcataatgtctggcacacaaggatacatcatgaggccgggcatggtggctcatgcctacaatcccagcactttgggaggccgagatgggaggatcacctgaggtcaggagttcaagaccagcctggccaacatggtgaaaccctgtctctacaaaaatacaaaaattagccaggcatgatggcaggtgcctgtaattctagctacttgggaggctgaggtgggagaatcgcttgaacccaggaggcggaggttgcagtgagccaagatcgtgccattgcacgccagcctgggcaatggagtgagagtccgtctcaaaaaaataaaaaataatgataatacatcatgagacatgcaaagaagcaggcaaatgtgacccataatcaagagggagaaaacaacaatcaatagaaatagacccgtaggctgggtatggtggctcatgcctgtaatcccaacactttgggaagccaaggaggacgaatcacttcaggtggagagttcgaaaccagcctggccaacatggtgaaacccggtctccactacaaataacaaaagttagccaggtgtgctggtgggtgcctgtaatcccagctacgcaggaggctgaggcaggagaatcgcttgagcctgggaggtggaggttgcagtgagctgagatcgcaccattgcactcagcctgggtgacagagtgagaccccatctcaaaaacaaaacaaaacaaaaaaaccagacccacagaacacctacgtgttgaaattagttgacaaagatttttaggtaacagtgataaatatgttaaagaatttacaagaaaagacagataaaatggatgaacagatggtgaatttcatcagagaagtggaaattctaaaaaacaaccaaatggaatttccagagctgaaaaatacatatctcaaacaaagaatgtattggatgggcttaatagcaatttggcacaacagaggaaagaatctgtgaaggcaaagacaggtcagtagaaataatccaaaactgaaaagaagagactggtgcctgaacacctttggggaatgctctcgctgccgccccccacattcccagcctcaccttatgccacaaggcccggaggcagcttctccgcagagtcgtgtgctgccatgccaggtactcatccacacgggcacgggcctgcaggtcctgagggtaccagtagtcagggaccttatatttgcgcgtcaggtagagcaggatggccacactgtgggtgtgggggtcatgatgggtaagggaagggcactgtgctgggtatttcatacatagtcgcttttttttttttttgatacggagtctcgctctgtcgctcaggctggagtgcagtggtgcgatcttggctcactgcaacctccacctcccgggttcaagtgattctcctgcctcagcctcccaagtagctggaactacaggtgcgtgccaccatgcctggctaattttttgtagttttagtagagatggggtttcaccatattagccaggatggtctcgaactcctgaccttgtgatctgcctgcctcggcctcccaaagtgctgtgattacacgtataagcaaccgcacctggccttttttttttttttttttttttttttttttggagacaaggtcttcctcagtcacccaggctggagtgcagtggtgcagtctcagctcactgcagcttcaatttttataggagtgcaccaccatgcctggctaccttttttcttttttgtagagatgggatctcactgtattgccaggctggtcttaaactcctatcctcaagcaatcctccagccttggcatcccaaagcgctggcattataggcatgaaccactgtgcccagcacacttctttaacctttctgacaatttgccaaagtattagcctcattttccagagaagaaaaccaggcttagaaaggcagagacttgccctagggcacacagctcttaatggcagagctgagaatctttctgaggctaatacccaagcttttcctaccaccaggcaaaatcccacaacagaatgtcttgccaaatgtttagagacagtttctgatcagagaaccagagagagcttccaggagaacggggcatcaaagctgagctttaaagaagctcagttctttccattcggtatccactctcatctgctgggattccgaccagcctctgatggcctgactgttcaaaaaggcttccgtgtccctttgttctttctgtcattctttctgccaagaatcagctcctatctaagctgactggggtagtttggcttcctaaagtaccactcaggaagcactcctgcagctgcaggatcctagaacaacagaacagacaaggccccctggcactctcctccttccctgggttttgagggccgccatggtgatgagatgagcatggacctggaaggacacaggatgtgtccatttggagacacagaaaagctttcaggaacttggggtttcccaaaggttgggcatgcaggccaaaagggcagaaaacctctgtatctgccacgggcctatattctcttttaagctggggctacacacgtgtcccagcttaacgactccgttgtctgtgcagggtgcccaggagctccttttgctcccagccaattgttcaagccacctctgaggagggctgcaggtctctgtgagccacagacctgaaggtgagagtagtgacagaggcagagattgcacattgactctggctggtacctgggggtcacaacgctgagtgacacaaggactcaggacacctggggcaccagggaggaagacgggccctggcagaatgtcagaggaattcatcggaggtgcgtccatcctgagatttcagagatgagctttaaagcacaaactccaggttcttgttaggggaagggtgactctggtgacaaaaggggcagaactggggaaagattggcttttcctgaagaggattcaacttcttgggaccagctgtgatgtaagacgtccatatctggtggctcttccatggggaagacccatcctgggaagctgcagcccagagatggagccaccgggcagcccagatgccactgagccatcgccacacaagcttggccagaggcctgccccacggtgggcaaagctgccatcgtcctctggcctaccctgtctcaaggatactctcaccactcaccagcaaccaaagcactggtgtggaagtaaagtagatatttgcttttctaatcatcagggtgaactggaatagcaggaaggcaagggcctggggtccagtactgactctctgcaggatgcggggcacagagactctctgcctctgaagactttagtttccttgtctatgaaatagagggttagaacaggatggttccagcaggcctggcagcagtcctagggtcccagttacctctccgtcaaggtgaagtccccgtccttcaaggctggcaccttcttgagggggttcacctgggcaaaggcatcgcttaagtgctgacctgggaagagtccagcatggtgggtggtgggaggagaacgctgagcccgccatggcctgtgcccctccctgcaatgctctggccccagtttcacagttcttcttcccaccagtctgcactcctggttggcaaagactggaagggcccctgcgggaggaggaggagaccactccaccggctggtacaaaatagacaacaccccttgctaagtcctgtaggcacagcctcctcccacaggctgcccctctgcaacagagctcactgtgcagggtgtggttcctggacctttgcatgcaccctacccatctcctctttccactattgccagcttcatgaactcacaatcagagcaccccaagctgcacgataggtcacctgaggggactgactaccttgtcccttccaccattaattctaaggcagggtcatgaaacacagagaagtggtctttttctggtatctacctacttagaagcaacttctactggccccaccatgtccctttgttcaccctgccctgggcactgtggagctgtgtgtagcatacctgctaccaccccctgtgccccaaacttttattccccttacagttggggtctcactatgttgcccaggctggtcttgaactactggcctcaagtaatcttcctacttcggcctcccaaagtgctgggattacaggtgtgagccaccatgcccagcctgctaccctctcttcaccctcccttcagactgttccttcaccaggaaaaccctcctctgtctcctgggaaaacacacttccctctgcaccactacatttgacaaccagcttggacgtcctcttgtcccccattccctttcctctactccacactctgcagaggaagtccttgcgcaggacagtgggcagtttgcagaagagattatgtggagaagtttcaggcagagggccagccatggagtgggagccctgggcagaaggcttagccaagtagagtcgccttacttgccccaccagccatacctggattctgcttccaacccctcctactaccccaccctgcactgggcctgggcctgggcctgccagctgagtcctcaagggccttggaggcatgctagagaaacaaaacagggtgtagggctcatcaagccccagggtccccctgctgcttccagcatcagcagcctggggcaacctacctccccagcaggaacaagaggcagaggacaaggtttcgggcggcagaggttgcagtgagctgtgatcctgccactgcactccagcctgggcgacagagcgagactccgtctcaaaaacaaacaaacaaataaacaaaatgccttgggccaggcacagtggctcatgcctgtaatcccagcactttgggaggctaagccggcagatcatttgatgtcaggagttcgagaacagcctgaccaaaattgtgaaatcccatctctgttaaaaatacaaaaaaattagccagacatagtggcacacatttgtaatctagctactcaggaggctgaagcaggagaattgcttgaacccgggaggtggtggttgcagtgattcgagatccgtgccactgcactgcaacaaagcaaaagcaagactctgtctcaaaaaaaaaaggacaaggacaaggtcagaggcaaaacaggaggaacagaggaaggaagggacaaagagggaccccaatgcagactggacgagtgcagagggcagggatggaaagtcacgtcctgagctgtttgctgttgcagaatctcagcagctgggccataaagaagggacttgacgctgtcccagtctctacacttggcacccttgacctctctcatcccacctttccctaggccgaggtcacacctgctttcattttgtttttttttgttttttttttttaagacggggtctcgctagattgccctgacgggagtgcagtggctattcaagggcaccatgatagtgcactgcggcctggaattcctgggctcaagcgatcctcccaccccagcctctcgagttgctgggactacaggcgtgtgcccctgcacccagctgcgcccgtttttgtcctcctgtctggcttctcttcatgatccccacccctttattcggcctcaggggaaccccgtggtctattccgtgagaccgagcagagttttggggagccccgactcttggatctccctgctggctcacctttctctgttcggtctccaaaccagaccagcaatggccccaggaagaaggtggcgctgggagaagttccctaagctatgtatgcctacctgtccccttcctgacttttcggttccccaaacccgaggctggacctacctttaatcagatccacgatgcgcagctcgaagggaatgtcgttcttcttggcaaagatgtaaacagcgcggcagggctgggacagcaggtccaggtacagctccaggcccatagtggggaccgaccgacctgaccggaaaccagagggagtcagcaaactccagtgccaggactcgggtctcggacctcagaccacgcccctgcggctacgcaccccgaccgctgtgccccattgggcggcacggacgcctgggacactctttagtccaattgcgggcggcgggcggcctgtctcagggctgggcccgcctggctcctgtgggatcagggtgggtggccaagagaccgttgtctctcagggggacgcacagagaggccccagtcccatccctttcgtgcctggctcgctcatttcacttagcataatgtcttcaaggtgcatctgtgttgaagcgtgtgtcagaatttcccaccgtccgcattttagaggaggagacagacactgaatgattatagacccagaaagtctggctccaaagtccatcctcttggctcaacactgcagagtccttggtgccagcaagtggcaaagcctcagggcttacgttcagtgttttgtggtcactcgcttcactgcagtcgcactccctggaatgtcacagccttggtcttcctgcccctgccagcacagtgccatctatcgcattccctgggtttatttcttcctttctccaggcctgtgtttctccatctttaaaatgacagggaagctagagccctccagagtccttgcaagtccacccccctggattcatctgctgagccgtaagcccaggcctgccccttgctgccatggagcctgtcaaatagtatcagggtcacatgtcattttctaaaacgaatcccactgaaagtgtgtcagccaacgcataatgttttctagagaataaggaacatttctgcaaataaagtggaagtaacaactgttttattttatttagatagagtctcactctcttgcccagggtagaatgcagtggcatgatcacagctcactacagactccaactcctgggctcaagccatcctcccatctcagcctccccaagtagctgggactacaggtgcgcacaaagacgcccagctagttaaaaaaaatttttttctgtagaggcagggtctcactatgttgcctaggctgatcctcccacctctgccacctgctgggattacagatgtgagccactacaactggccagtaataatgatttttaactggaaaaaaaattaaggaaagatgagaaattcagatttccatgttaaagttttgaaaggaggtagacactcagagaaggcaatggctgccttatcctcacctctggataactccagtcagaggcccaaggaggagctgtcaggattctggttcaaggctcagcctgtcttttaagttcaaaacctaatttggggcgggagtggtggctcattcctataaccccagcaccttgggaggctgaggccggcggatcacctgagttcaggagtttgagaccagcctggccaacttggtgaaaccccatctctgctaaaaatataaaaattatctgggcgtggtggcatgcacctgtaattccagctactcaggaggctgaggcaggagaatcgttgaactctagaggcagaggttgccgtgtgccaagactgcgccattgcactccaggctgggcgacaagagagtaactccaactaaaaaacaaaacaactaatttggtccacgtttcaggattgatcattttctttgggtctgactcacataaaccaactcacaaaggctgtatttattaatttatagaaacaagataaaagtgagagtgtgtgggttggttcgtttgtttgttttttgactttgcccctctctgtcactcaggctgaagtgcagtggtgcaatctctgctcactgcaacctctgcctcctgggttcaagcgattctcgtgcctcagccacccgggtagctgggatttcaggcatgtgccaccatgctcagctaattgtatttttagtagagacagggtttcaccatgttggccaggctggtcttgaactcctggcctcaagtgacctgccagcctcggcctctcaaagtgctgggattacaggcgtgagccaccgtgcccggcctagaaagaagagaaaagtcatttagacagaatgctcccaaccattgctcagtgctctcttggcagtgtagtctcctaggaagcctcgtgggtgttactggccaggaccaggtccgttctgcccatgcacagtaaattaatcactgtgacatgagttttgcaaaagactaaagatttattcacaagggtgccaagcaaggaggtaggataatagctctcaaatccacctccccgaaaataaggcttagggataagccttgcttccaagcaataaagcacagaccccagtcacactcaaggggagggggctatacaaggatgtgaataccagtctgcctgcctcgtgggcctacaacgcagaagggccatgcacttggtttaaaactttgttgttgctgtcttgacattcttaacaatttaaaaataagggtccccacattttcatgtgtagccagtcctgtccaaggagtccaaagaggtcatgagggtggacaggtcactgtctcctctgggcagtgatggggccactagcagttgttctgtagtctcctagcccctaccccagggccacaccttccccatggtctctcacattcttttttttttttttttttttttttttgagacagggtcctgctgttgcccaggctggagtgagtgcagtgctgcaaactcagcttactatagcctcgacctcctgggctcaaacaatccttctgcctcaccctcctgtgtagttcggatcacaggcacatgccaccatgcttggctaattttttgactttgtagagagggcatcacactttgtttcccagggtggtcttgaattcctgggctcaagtgatcctcccacctcagcctcccaaagtgctaggattataaagatgtgatccgccgccccggcctctctcacattcttggcatttaaagttaccgtcattgacaaggaacatgggtacactccaatttactcaagaaaaaaactcttttctccattgaagagatatgtggcctggctgcttcctactctagttgaggtcttctttttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagcagcagccttgcctgggagcttgttagaaatatactaacaggctcccacccccaaacccagacctactgaatcagacagagtctgtattttcataagatcctcagatgatccaaatgcgccttaaactttgaggagctttgatccagaacctgggctggaggcccctgggggccactctgttcctcacagactgcaaggtatgtttttttcttgcctcttctctctgtcctaatgtctccttctctctgtgtctgaccctgaggaccctatgacatcttcccaggggagtttccactgtcaaagagctgattctctctctcttttttttttttttgagacggagtttcgctcttgttgcccaggctggagggcaatggcgtgatctcggcttaccgcgacctctgcctcccaggttgaagcgattctcctgcctcagcctcccgagtagctgggattacaggcatgcatcaccacgcccagctaattttttgtagttttagtagagacagggtttctccatgttggtcaggctggtctcgaactcctgaactcaggtgatctgcccacctcagcctcccaaaggcatgagccaccatgccctactgccagaggcctgattctctagaatctgatgggctcttctagacagcaatctctacctgggctcttgttgaagaagccaatcagctcattggttggaggtcacatgatataaaacatggccatcttccaagccctatgtgtggacaacgagatagggacaagtaggcatatcacgttctgatacctggacccacatctgtcgctgggcccacgtctgtcctcaggcccccaggatatacttttatggggagttttcctcccttcccccaatgtggtcactcataactttacacccaacagtcaaacaggagtggaagctacagagtttcacgcaaacaataggctaggctgtgggactgagtaaaaggcactggactgtggtaggtcttactccaagatggccaaatggaagggcttttagctttctttgtttttgttttatatcctgagacaaaatgttcaatttctacactttagaataaaaagagccatattttatgtttcatattttttgtatgcttcctttcatactcttttgaacaatgcaatcatattttcattatgaggtataattcacataccataatatccgctctttcaaaatatactttaaaattcaattggtttaaagccaattcattggtttttagtatattaacaaagttttgtcaccatcacaattatctaattctagatcattttcatcacccctaaaagaaactctgtacccattaaacagtcactccccatttccctcttctcctagcccctggtaaccattcatctactttctacctctgtggacagtaagtatctgcctattctggacatttcattcaaatttaataatgaaatatgtgagcttttatgactggcttctttcatttaacataatggtgtcaaggttcattcatggtgtagcatataacagtacttcatcccttcctgtggctgaattatattccattttatgtatacaccacattctgtttatccattcaccagttgatggacttttgcattgattctacttttcagctattgtgaatccccatgctgtgatgaacattcacgtacaagtttttgtctggacatatgtcttcagttgtcttgggtatacacctaggaatggaattgctggataatataattctatgttggccgggcacggtggcacatgcctgtaatcccagcactttggaaggctgaggtgggtggatcacctgaggtcaggagttcgagaccagcctggccaacatggcgaaaccccgtctctactaaaaatacaaaaactagctgggcatggtggtgcctgcctgtaattccagcctgtaattccagttactcaggaggctgaggcaggagaattgcttgaaaccaggagacggaggttgcagtgagccgagatggcaccactgcactctagcgtgggtgacagagcaagaatctgtctccaaaaaaaaaaaaaacaaaaaaaacaaaacaaaactaacccatatatatataatatgttatatatacataataatatattttatatatatgtgtatatatgtttaacttttggaggaactgcaagctgttttccaaagcggttatacattttacattctcagcagcagcacacaagggtttcaatttcttcacacatcctcaacaatacttttaatctgtcttttctgttatacccctcatagagtgtgtgaagtgatatctcattgtggtttgattggcaatgtcttgattatagtatctttgtactaagttttgaaattgggaagcatgagtcctacagctttttctttttcaaaattattttgaagattctgagtcactttaatttccaaatgaattttagggccaatttgtcagtttgtgcaaacaggccaagtggaattttaatgcagactgtgttgaatttgacatcttaacattactacaccttccaatcatgaacatgggatgtctttccatttattaaggtcttctttaagttttcccccaacttttaaattatgaaaacatttaaaatccagaaaatgaaaggactagtacaacagcactaatat

SEQ ID NO: 513 - DNA, 102994 bp, Homo sapiens
tcggttggaatctgttgaatgattggataaagtaaaagataagtatagggaattattaggtagcattaaatgtgtaataaatgtaaagagagggagcaagtgcatacaaggaagtgtgcgctactgggtttctgttgaattgttcatggaagaccatcagcagttcaaatccaaaagcctgtcttaaaattagctgagtgtggtggcgtgtgcctgtaattccagctacttgggaggctgaggcaggagaatcacttgaacccaggaagcggcgattgcagtgagccaagatcgcaccactgtactccagcctggtgatagagcgatactccgactcaaaaaaaaaaaaaacttgtcttgagggactatgccaggctttacagctacaaacatcatggaggaagctgtctgcccattagaagcccagagcccggagggacagactagagcaaatcctctccctcgttggagctagatgggaacacaaatctatctgataactaacatgcaattttacatctcttaccttgtttaatcctcacaaccaccctgatgagtagtagtattatccccattttgtagatgaagaaacaagttcttcaaggggaagggatcctcagagtagcatatgaatgagaggcagaaccagagtcaggacctatatcttgtcttctccttcctaaaactagaaaagtacccacaaccaggcaatgcttttggtgcagaaaaagcagtagtgaacaaaataggcaaaaatgtctgcctttagtgctcacattgttgtggagaaagacaaacaataagcacagtagagaagtaaaaattagaatgttttgctaaaaagtccataaaattgaatattattcagccataagaagggatgaagtaccgttatatgctacaacatggatgaaccttgacaccattatgctaaatgaaagaagccagtcataaaaggtcacatatttcattattccatttgaatgaaatctccagaataggcagctacttcctatccacagaggtagaaagtagatgaatggtaaccaggggctaggggaagaggggaatggggagtgactctttattgggtacagagtttcttttttgggtgatgaaaatgatctagaattagataactgtgatggtgacaaaactttgttaatatactaaaaaccactgaattggctttaaaccaattgaattttaaagtatactttgaaagggtggatattatggtatgggaattatatctgataatgaaaatatgattacattgttcaaaagcatagggaagcagctacaaaaaatatgaatcataaattgtggctctttttattctgaagtgtagaaattgaatattatagctcaaaatataaaacaaaaacaaagaaagctaaaagcccttccatttggccatcttggagtaagacctaccacagtccagtgccttttactcagccccacagcctagcctattgtttacatgaaaccctgtagcttccactcctgtttggtgggtgtaaagttatgagtgaccatattgggggaagggaggaaaactccccataaacgtgtatcctgggggcctaaggagagacgatggcccaggtatcagaacatgatatgcctacttgtccctatctccttgtccacacataaggcttggaaggcagccatgttgtatatcacgtgatctccaaccaatgagctgattggcttcttcaacaagagcccaggtagagattggtgtctagaggagcccatcagattctagagaatcaggcctttggcagtggaaactcccctgggaggatgtcatagggtcctcagggtcagacacagagagaaggagacattgggacagagagaagaggcaagaaaaaaacatatcttgcagtctgtgaggaacagagtggcccccaggggcctccacctcaggttctggatcaaagctcctcaaagtttaaggtgcatttggatcacctgaggatcttatgaaaataaactctgtctgattcagtaggtctgggtttgggggtgggagcctgttagtatatttctaacaagctcccaggcaaggctgctactgctgctgatctaatgaccacagtttgaggctggacagagtggctcacacctgtaatcccaacactttgggaggacaaggcaggagggtctcttgagggtagaactttgagaccagcctgggcaacacagcaggacctcgtctctaaaaaacaagagagaagaagaaaaaggaaacaacaagaagactcaactagagtaggaagcagttaggccacatatctcttcaatggagaaaagagctttttcttgagtaaattggagtgtacccatgttccttgtcaatgatggtaactttaaatgtcaagaatgtgagagaggccaggggtggtggatcacacctataatcccagcactgtggggggctgaggtgggaggatcacttgagccaaggaattcgggagcaccctgggaaacaaagtgcgaccccgtctctacaaagtcaaaaaattagcccagactggtggcatgcgcatgtggtctgagctacatgggagggtgaggcagaaggattgtttgagcccaggttgaggctgcagtaagctaagtttgtaccactgcactcattccagcctgggcaacagcaagaccctgtctcgaaaaaaaaaaaaaaaaaagaatagtagagcccaggggaaggtgtggccctggggtaggcgctgggagactggagaacaactgttagtggtcccatcactgcccagagcagacagtgccctgtccaccctcatgagatctttgaactccttggacaggactggctataaatgaaaatgtggggacccttatttttaacttgttaagaatgttaagatggcaacagcaaagctttaaaccaagtgcatggcccttctgcgttgtaggcccacaaggccgacactgctattcacatccttgtatggtcccctaccctggagcgtggctggggcctgtgctctactgcttggaagcaaggcttatccctaagccttattttcgggaaggtggatttgagagctactatcccacatccttgcttggtgccctgtgaataaatcttttctcttttgcaaaactcgtgtcatggtgattaatttactgtgcaatgccaggcactgttggaaacctctggataggcctcacagggcctcagccatctcggggaggcgttagctagagtgtaacaaatatgaccccagcaactggggagggacagctcattccttcatgaggtgtggggctggcagccccgcaggcagtcagccacccttcctctctggcctccgtcctgggcactgggcccaggcactgggcaaggaggctgctgcacctcctttctcctcttcctttttttttattttttgagacggagtatggctctgccgcccaggctggagtgcagtggcgtgagctcggctcactgcaagctccgcctcccgggttcacgccattctcctgccccagcctcccgagtagctgggactacaggcgcccgccaccccgcccggctaattttttgtatttttagtagagacgggtttcaccgttttagccagtatggtctcgatctcctgacctcgtgatccgcccccctcggtatcccaaagtgctgggattacaggcgtgagccaccgcgcccagcctctcctcttcccttttagtgggaaatatacctgcagcctagattcccagaaaggggtggtgagagagcagacacgccactgattgacccgaagttctaggagccaagggatgagtgaagagggcgtggccggactcggggctcctggtgaggtgcaccgctgcaggctcggtgacccagcagttcctgcccaaccctcacctacccccagccgttcctgtccgccgcccccaaccagccattcctgcccgcagttcctgttcccgggcctgtccccgggtttgtccccagggcccgtcccctgggtttaggtctgccctcccacgccccaccccattgcccccgccatgggtctgctgtcccagccctgccgttcagtctacatcttcgccaagaatggcatccccttcgagcttcgcacagtggagctgaccaaagctgggctgggcaggcaggcccaggggatattggccgcggatccctgcctgtccccgctgctttgcagttgggccaagaatgcagactaacacgaagaatcagactctccggtgtggaaactattacataattatctatgttattatttttactttttggagacagcatctaactctgtcactcaggctggagtgcagtggcacaatcatggctcactgcagcctcgaccttccaggcttaagcgatcctcccgcctcagcccctcaagtagctgggactacaggtgcccaccgacatgcctggccaatttattattattattattattgagaggaggtcttgctgtgtttccgaggctggcctagaactcctgggctcaagtgatcctcttgccttggcctcccaaagtgttgggattacaagcatgagccgccatgccccactggttgtctattttaatagaggcttgatctttgcttgtgaatacaaaacattcttcaaaatacaggtttagagagggcacagcaggcacagaacgagggtagggaaatggagtggggcaagaatatcttcaccccatgtgcttggaaaaaacaatgaaactgcctcgttgtttcctaagtaaaatagtccctgtctacccctgcctgtgtctcttccacttttgtattatttgtttgtttatttatttatttatttatttatttatttatttatttatttattacagtgtctcaatctgcagcccaggctagagggcagtggcatgatcccggctcactgcagccttgacctctcaggatcaagtgatcctcccaacttactcctcctaagtagaatagttgggactacaggcacgtccccgtgcccagctacttttttctttggtgtgtgtagacgcatgattttgccatgtagaccaggctgaccttgaactcctgagctcaagtgatcctcctgcctcctccttctaaagtgttgagatcacagacatgcaccaccatgtctggccctgggtctcttccacttttatgtatttcttggcattcttctgccttttccttttcctgcatctgacttgctctatcccatggggcttctcacccagctgaaggggctactcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagagggaggaccctgctcagctgactcttcccaactgctgcccttggtacaaccagcttgagtcacctgctacagaacaggggctggacacagaagcagtctgtggagggagaatgggcaggggtgtgtatgtccattcagtagaagggcaaagaggcccacatgtaggcctatgatcagactggagcctggcttgactgaggtcctctgatccaaacaccaggcacctaatgcggcctctagcactggcctagagtgctaaagtgagtcagacctgggaacccccactggggagggagccttgagagtttggcataagaaagcaagaagagctgagccaccggaggctaagtagctgaatggggcagggattcccagcaagaatgaggttggtctgagggttgggaacatgtttggctgggactctggggtattgacaggtcacccagcctggccagtagggcctaagtccccagctgggataggaagctgaatcagagggggcaagcctagagcccagggaggaggctggaggggtctgacctatggatggaactggctgggggtggggtgtgaattacagctccagggaattgtccttgagccatgcttcaaggagctggacacaggaaagatggccctctgatggggtcaaggtctgtgacccagtgactagcagagaggcttcctcttccctgatgcctcccagataggggcctcagaaagctgctgctgggattttggggtgggggtgggcagagacctcagagaactctgggttatccccactcacctctctgatctttcctgcaggccagcagcacagcgatgcctttgcccaggtgaaccccctgaggaaggtgccgggccttgaaggatggggacttcaccttggctgagaggtaaccggtccgtgggctgctgccgggccttgtggggccagtcggctgtctgttcactgttgatggcttggatcatggactgtgggccctgcaccagccccagggtgaagaatgggtggaggcaggcagaggtgcccagtgttgacaagggttatagaagtcccctcctgcattgtacaagtgaggaaactgaggctggaggaggggagggacttgcacaaggccacagggcccagtctgcttccgggcctcctcaccgccagccttcccctccgaaaaaaggagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctgcgtccttctcctcatggatctcacattccattaatagaagggggagctgacagtaacccatgtaaacatggaacatatcggatgttgatggatgccatggaaaaaataaacagggtaagagtgggggtgtgtgtcattatgagtaggatgctgagggaagactccctggaggaggtggcatctgagcagggagctgtaggaatgtgcaaggcatgaggagaagggtgttctcactggagggaagagtgagggcgaaggctccaggtgggacaatgcatggggttcagactggagagcaacgggccagggtgggtgcagtgagcaggaagagcaggaggtcacgacagaggggagcatgggacactgggaaggctttggctcttaccgcaggtggattgagttgttggagagttttgagcagaggagaactgtgatctgacttacgtcgtaaaggatccccctggcaggggtgagaaagccactgcagtcatctggcatgcagcgctggagccccagaccaaggtggtggtggtgcagggttgcgggggattgtggtcagttctgacttttattgaaatctaactgcagggtttgctgaagggttggaggtgggtgggaaaaatgaaagccaaaaccagcctccaggttggtggccgcatggtggcgtcctttaccgaggccacatagtgcctccttggtggagctggattcacattcagagcctgggatcactggatggtccaacacccataaaggcatgatgagctctgagggtcagactgcacaacccttcaccataggtgaacgggagttgggacagggtgggaagcaatgctgccatgtcacctggaaggctctgtccctgctggccttgctcctggccctgtccacactttggatatgttggggagatatccaacatgctctcgttcttcagactcacactgggtgccccttcctcctggaagccttccctgagcccctgctgaagttcatgacattttgtttcttccttgctgcccttagttgagatgacagtctggccccgtgtagggctgtgtgaccctgggtagttacctaacctctctgagcctcacatccctcctctgcatcatggggatagtgaaaatgccccagaaaacggttgaagagtgttcagggcatgtcttctgcccctgccatgtccccccagtgtggctagcttgctctatatgagctgcatgtacaaagcacctgaccactggtacctccaggacctgcaggcccgcgcccatggggatcagtacctgtcatggcagcacatggccctgcagagtagctgctgctgggccatgtggcagacggtgagccatggagggcagggacacctcccgggatgcccaagggatgctgctttcactttacaaaattctgtttagacctgagaccaaatcctggaatgccagagactgcctaattcacccaacttgtttcataggagggaaaccaaggaccagagccaaggaaggattcccctaatgtgccttaattccacagctaccacctgcacacttacactcacacactgttcgacacacagccacactcacacacacatccacccacgtccacccacagtcacacgatgtatcacattcacacgtatacacccacacacacaatcataacatttacacacagtcacacagttaactcctatacacacatatacacccacacaatcacacaactcactcatattcaacaaagtcacacaactcactcacattgacacacatacacaccaaccccacacacaattcacatacatacacacacatatacacccacatacacaaccacaccattcactgacattaatacaaagtcatcacacagttcactcccacacacacacatacacctcacacacacaggcacacaattcacaccaacaaaatcacacagttcactcattcacacacatacacccacatacacaaattcacactgctcagtcacatttacacaccattcaaattcacacacatatacacctacatacacacagttcactcacatcacacacatatacacccacatacacacagttcactcacatcacacacatatacacccacacataaacacagtcacacaattcactcacgttcacacacacagttcactgacattcgcacacatacacacacaccacacacaggcaattcagtcacatggccgaaagccagtccttaccttcctatagttcctttcccagtgtcacctcagcctttggccctcagcgtccccttcccatgcctggactgcggaagagccctgaacacaccccatcttcatgcctccagcgctagcccgagcccttccctctgccaagagcactaagtgcaactcaagatcacttctagggacccttccctgcccctgctgccaggtgacctgaggatcctgctggtcccgcttgacaatgatgcacagcatggttagttcagctgaggtcgctctcccagacttactgccacctacacagcactaggactgactgtttaactttattctttatttcgtgtactttattggagtgtctgttgaaagcaaaaccatccaataaggaacaatcccaaggcagccagcatggatcaagaaggcacaggctgtggccgccatccccagtgcctgatggggagagggggtggtaatggaaaaggcccaggaaagcaggccagagtgtccctcaaaatatgagaaatcactggaagagagagccagaatgggacctaagacagaagccaccaccaggcacccttaaggcaggacagttgcaatggttacttggaatacttccggctaggagtggtgttgcgggaagtcagggaccccaaacagagggaccggctgaagccatgacagaaaaacgtggattgtgaagattttatggacatttattagttccccaaattaatacttttataatttcttatacctgtctttactgcaatctctaaacataaattgtaaagatttcatggacacttatcacttccccaatcaataccgttgtgatttcctatgcctgtctttactttaatctcttaatcctgtcaaccaaggaggatgtatatggcctcaggaccctgtaataattgcattaactgcacacattgtacaggatgtgtgtttgagcaatatgaaatgtgggcaccttgaaaaaagaacaggataacagcaattgttcagggaataagagagataaccttaaactctgactgctggtgagccaggcggaacagagccacatttctcttctttcaaaagcaaataggagaaatatcgctgaattctttttctcagcatggaacgtccctgagaaagagaatacgcaccaggaggtatcagcttataaacagcacccctgggcgtggcctgtctcttatggtcgagactgcagagatgaaatatactccagtctcccatagcactcccaggcttattaggaagaggaaattcccacctaataaattttggtcagaccagttggtctcaaaaccctgtctcctgataagatgttatcaatgacaatggtgcccgaaacttcattagcaattttaattttgcctcggtcctgtggtcctgtgatcttgccctgcctccacttgccttgtgatattctattaccctcttaagtacttgatgtctgtcactcacacctgttcgcacactccctccccttttgaaaatccctaataaaaacttgctggtttttgtggcttgtggggcatcacggatcctaccaacgtgtgacgtctcccccggatgcccagctttacaatttctctcttttgtactctctccctttatttctcaagccggctgacggttaggaaaaataggaaagaacctacgtgattattggggcaggtcccccgatagagtggcacatgatgggcacagggcaggcttgggaaatggggggccgtaaggccacaagacatgtgggcaggtagcccagagtgtgtctggaacatcctgtttattggtcggcagtgacatctactgtcacatttgagaactgcatccacagccacatgacctcctgtgaagacctcagggcaaactggggaaacctgcccttcttggaaggtgatactaggggggatgagcaacacctttcttggaggtttgaattcttcagggcccctccagcatcttggtcttcctaattcctcccttgatcccccagccctaggggtggtagcttcttgcagtgtttacctccgtgttaatctggattctctctgtcttcggagttctctaatgcctggttaccaattctttatatcaagttctctccgttaaaatcattgtggtggggtccatcccatggatatacatggaggtctgtgtgacaatgtataatcttactatttgcagttattacaaaactgtcctagaagacatgaatgcttgttaaaagaaatcttttaagtttcctagacttcaaagaccgttgctatgccctgtgaaacatcgcctatatcctttaacagtttgcaattcgaattggttacttacttaacattttgttgccctggtgatacaattatgttgactcgttattgtgaggttactttgttattaaccatgatgaggattactagcacatacttttactccatatgtataacacaacaatgtagtaaaaccaataactcttggttctctattcaaagtgtttggaatctttattctgtttaaaacactgatgacatttgccaatttttgagtgttcttcatgttactgatttgtaggagctctttatatattgcagatttagtctcttactggttatgtatgctgcacctgaggagtagcagcactgccaaggacactgagtgtcttgtctgtgcagagcttcacatgaagctggagagaagggactggggcaagagggaaagataaaaaggggcaagtaagtaacagaatgaatccttgttgctaatctcctggcccccatcccagacccttcaggggatcctggcgattcgaagcagcatagcctgataggcctctggtgagggtgttgggagggttttcttggccgcctgttccaggatgctcaagatgatgctgtgggcctcctggcatagctcagcacccaggaaagcctccactcgtccacgccatgctgccagtcgtggccgtccctcaaacagttcatagccgagagccaccggctgtagggacaaggatgaaaaagttgtgggcatacaactttcccagttgtcactgccgacccgaatgctggaaccatgggcagaagtatcagagacatggtccattccccagcccctaagtgaatggaccacaggggcccaggcagtatgttcagccttagagcccaagagcagccagggtgagaccccacacccaggcaggaggcagaagttcagggttctggccccagatcatccagagacttgctctatgattctgggcaaagttctggctttctccaggcctcagtgtttctgtctgcctcatgggtgtgacacgaagagggacactgcccacaggctgagctcacacctgcatcagctcctccagggccatgagatcagccagtgtcacctgctggccagcgaggaagggcctgtcccccaggaacttgtcctccagccattgcagggcctggtccatggcagtcctgttgcgttccaccttctcctcgggcacctggaccccaatgaggggccccaacacctgatgggggcagagagtgggtcagtctatggccccggcctactgccaactactccctgatggccaatcactctccagatggctctcctcacctggacccacaggggtataccaaaggtgccacggatgcagtcggcatgccagcccaggtactcatgaacacgggcacgagcctgcaggtcagatggataccagtggtccggcgtctggtacttacagctcaggtaaatcaggatggccgagctgggaacaaatgggcagtggctataaggacactggcaccaggcatttacccctaactgctcccatctgccagtggggcccgggggcttctctgcatttgaaggactgccctccagcctcgccctccatctccagctccccaacaccaccccctcctcctacgagtctcctcctgtctttgttgccttgggcaccgactcttggctggaccttctgctttgcattttgagaacctcatctctgtgatatgccagcagccgccctgtgaggtagacactcctgttagccttttagcacaagagaaaactcaaggtcagaatggtcaagtgacttgtccgaggcggtgcagctcagaataggctccctggacccctggaaccctgcatggggctggcacacagtggatgctccgtggagtcccttgcatgtccacgcgcttgggtcagggatcacgaggggaggaatgtctttggcccccgtctgacaggcccccagccatcacttctgcagccacctgacctcttgtccttttcctgcccagcagctggacctcaccatgagctgtgcccttgggccatggcattggcctctaggcccggcctgggtagattgggtagtctgcgacaagtcactagaggctcttttcagctagcatttgttgaacaaatgcgcaacagtggaaaaatgttcccttgtcttctcttctaatacccttcagtctgggagtggagaggccctgcggctcagaaaaggctggaagatgagaggtggggggacatgttctgtcagcccctgctcatcccggtcacaccccaagctgtaccttctccccagatacctctcctttctttctttcctttttttttgagacggagtctccctctgtcgcccaggctggagtgggctccctctgtcacccaggctggagtgcagtggtgctatctctgctcattgcaagctccgcctcctgggttcacgccattctcctgcctcagcctccccagtagctgggactacaggcggccgccaccacgccctgctaatgttttgtatttttagtagagacagggtttcaccgtgttacccaggatggtctcgatctcctgacctcgtgatccgcccacctcggcctcccaaagtgctgggattacaggcgtaaaccaccgcgcccggcctttttgagacggagtctagctctgtcgcccaggctggagtgcagtggcgcgatctcagcacactgcaagctccgcctcctgggttcacaccattctcctgcctcagcctccagagtagctgggactacaggcgcccgccaccacgcccggttaactttttttccatttttagtagagacggtgtttcacggtgttagccaggatggtctcggtctcctgacctcgtgatccgcccgccttggcctcccgaagtgccgggatgacaggcgtgagccaccgcgcccggccagatccctcgcctttcccctccctcgctgccccatggggtatgggagggccactggggcccggggccagtggggagagccaaggtcacatgggctccggatgcggtgaggggtgagggaaggagggcacctttcagtcaagatgaaatcaccatccttgagcgtcggcagtttccccaggctgttgatctgcaagaactccttgctcttgtgctgccctgaagaggaagaagtcagaaaaggtcttcagaataaaaacgctgcacctctacaccctccctcctcctccccaagcggagccccacagccctgagaaacagcaaggtctgggactagaggcctggatcagcctcactccctggctgggcctccctgccctgccacattccggggcagctggggggttttggtgggtggggccaggtgcagcaggtggataaagagaagttttctagccggactctggtgggccaggggaggggaggcaaactggggtggctcatctcttcccatctcttaattctcacaacagtatgtccttcttcccgaggtcttctgggctttgtgaatttatatgcgtgcattccacgcaagaactctgtcaactccattcagtattttctttccatccctacagagcagaaggtaacgttatcctccttttcagaaggcaagctaaggttcagagaggctgtgatcccttcaaggccactcagtccacagcattctctggtggcagacgctgcaggaggaggtgagggggctgtgcgggcggcgagacgctcagggcagagcagggcgggggcctgggggtgcactgggtttgtggacacgcggggaaacgggctgggcccacctttgaccaaatccacggtgcgcagctctaaggggatgccattcttcttggcgaagatgtagacggcgcggctgggctgggacaccaggtcaagaaacagctctaggcccatggcgggggcggcaaggacagcggggatggcagtgaaggcgctgagcgcggtgtgggcagcagctgtggcaggatcccggcgcgccgggaaataggggatcaggccccaccccctggggacagcacccaattggagcgcaccacccccggacccgcctcgccccttcggttcctgtccagtcctgccggccaagactccaccaccagatccgtgcgtccctacagggagggcggtcgctatgaacgcacagctgggagggtggagttggagctggggaccctcgactggcagggaggacgcggatgcagggggccgactgcaaggggaaggggaaccggctggacagggagaagcaggtctgcttttcgggatcccggtgccagggaccctgcccagttccaggcgtcgccctgacccagaaacgactgggcgccgccgtcctggaaaggccccagcgcacggacatctgagggttcgttcagagctctgtttctcggcgctgcatggtggcggaagggagggagcgaatgggatcccctaaaagggatcttagagtttcacccagtgggatgtgacacttgcaggtgtcccaaactggtgggaaccttgactggaaggctggggttaaggatgaactttctgccgtccagactgtcccctgcagagcagctgctgccagacagcgggagctgccagacagcgggagctcccacttcgtgcacaggatgggggcagggagcccgcagccgcgggaggcaggaatgactgtccgggaacctcctttcttctccctgaatcccagccctggcatctcaccagggggcacagtgatggtccagggctgggcccgggactctagctgaatctttcagagtatcccatccctctggccagtggcccaagcgagtgaaccagaatgcttccttgggagttttgaaactggaactggagagaggagctccctatggggaggtaaacgggagctggggccacctgtagtgacatttcctgagttcgaggagtagacgagactgagagagaaaagctgactcagagaaagggagtgataacagggcatgctggcccacacctgcaatcccagttactctcacgggatctgtttctctgatgtctgggtatgaaaggactttctaagcctcagaacagtgggagaactcaacaaagaaaaaaccaatacatatacaaggttactttgtggaggaaaaaatggattaaccttaagcaaaaaactgggaaggatctcggtaaaagatacgtcagaaggaagtaatgtcctttaagatgttcttagaaacccatcagacaggtggggtgtggtggttcacgcctgtaatccctgtactttgggaggcagagatgggcggatcagttgaggtcaggagtttgagaccagcctgggcaacacggtgaagccccgtctctactaaaaatacaaaaattagctgggtgcggtggcacactcgggaggctgagacaggagaatcacttgaaccttggaggcagaggtttcagtgagctgagatcataccactgcactccagccgggccactgagcgagactgtctcaaaacaaacaaacgaacaaacaaaaagaagagaaactcatcagacgaagacacaggaaaaaaatgagcgaaggaaatcagcagaggtttcattgaaggacaaagagaaatggtcaatacatggatgaaaacatgtttaacttcagtaataatcaaggaagcacacaccaacacaacatgcacatactgtttttatttatcaaaggcacacatatttttgaaatgagtactcctaattaatatgtacagagcacttacccagtgcccagcacaggggtggcaccctgtgtgtgagacagcatgaaacaggtagacacgcgccctgctgaaagtaagggaccgcctctctggaggatccatcgggcaataaggaggtttccacaccttaactgtgtctgccttgacctctggggcctgggagcagagccccctccagctggtggggaaggaagcgtggtgtgtttgaggacagaatggagagaagttgagtagagcaagtgtagactcttcctatccaaagtgtggtcaatggactgggagtatcagcatcaccagggagcttgttggaaatgcagaggctcaggccccactctgaccttactgattgggagcataaactgtaaccagattccagggaggattcatacacacattcccgtttgataagtggggggtagtaggaggtgaggtgaaaagtggggaggggatggctaccgcactggagaaggctggctttgtgttgaggcctttctcatgagggcagtggggagccatggaaggctttatgcaagagagggtacgggcagattgagattacagaaggatcccactggttgccttgtgtgaggacccagggagaagggggaggctgtccctgtttgagtaggagatgagagctactggtggctatgagtggaaagaagtgagcagaggtgagcagaaatcccaaggactggtgatgataggatgatggtgggaaccaggatgggctttgggcagaccctgacccctctctctgcctgtcggcccaccagataataatccctgtgttcctgggcgagtcagtgccacccgagatgttggcggccactttggctgagctggacggatgcctgcagctgctcgaggacaagttcctgcgggaccaggccttccttactgggccccgtatctctgtggctggcttggtggcaatcacggagctgaggcatgagagtgccatggggtgcggtggcccgctgggcagtggtgtatccgggaagggagctgacatcccagctcatgttgtcttttctggctgtgggaccctgtgtgagtcacttctccttctgagcctcagtgtcctcatctataaaatggggctttacaaacccctcaccgcagctatattaagaggcttccaagtgtccccagggagggggacatcctagcccatcacacacatggtggaggagggaaaatccaatcagagaacccctaaagcaggtcatgctgccttacacttggctatgcccagcccctccgctgactctgtcttcccctagcccatcagtgctggctgctgagtctttgaaagcggacccacggtggcagcatggtgcccaacacgtggaggctgcagtgcgggaggacctcttccaggaggccctcccagctgtcctgaaggccaaggacctgcctccagtagaacctgctgttaaagagaatctgaagaccttaatgcagcttttcttgctgtgagtgcgtgtcccacacttgctgagccactgaggggatgctgtgttggtagaataaagacatggagctgtccgtctccttggttgaagagaagacatatctgcaaaggctctggtccacagttcctccagatatcatgcctgcattccttttgtctcctaccccattccattctagcttccatgtgacctctgaaaagagcttgggcaaacgcttacttgaccctgaccttctgtgtggaactttgtatggttcctcactgcccagaagctaaagtacaagtcattgaactttgcattcaaggccttgctcccactcctccaggtggccccttctgcctgcacactcctaacccctctctgggctcccaccttggcctcttggcctccgctcatgctgttccctcctcatcttcgcctggtgcccttcctggtcttttggcatttggcaccctgtctcttctccagggagacttccctgacctccccagccccagtccaggtcaggcgacctctctgggctcctcagccccagtgtttccttgcgggggatacccccggactgagcatgtatcatcgatgaggggtgacctggtggaaagatgtctgaatcaggatcagccttggtctcctcggtctctctcctcactgtggggcgatgttgtgttccacaagtggggtgcagggctggttcatgaacctccttgcaggaagggaagtccctggttatttcctggccctctcccatgcctcctcataaccttgaccacagtcttctctacaccccactcccggaccactggcttgtccatgccccacacctggtcccagacttgccacctgtccctgccctctccccttaggactgtcatatttacctgtcgtgtgtctcagaccttctgatatctgagtcatctaataaacaaactgctaataggacaagatcatgacagacagagactctgtcggcctttcagtggaggctcctttaagtatgcacacttatagagaattttatacacgtagttgaaattgtacatataaacttgcaaattttttctttcttttttgtgggggaggggggagcctgggtctcactctgtcatctagggtggagtgcagtggcacagtcatagctccctgcagcctagatctcctgcgctcaagcaatcctcctgcctcagccgcccaggtagctaggactacaggcacacaccacagcacccagatttctttctttttttttttttttttgtagaaaataaagaagagaatcttgctatgttgcctagcctgatctttaactcctgggctcaagcaatcctcccttcttagcctcccaaagtgctgagattacaggtgtgagccacattgctcgaccacaacttcagtcatatttgtaatgtacaattcaagtgattttgccacactgaccacactcatgtttaagccacgccaacagagttccatgttttctgatgttttttcgagatggagtctcgctctgtcacccaggctggagtgcaatggcgcgatctcggctcactgcaacctccacctccccggttcaagcgattctcctgcctcagcctcccgagcagctgggattacaacgtctgccaccacgcccggctaatttttgtatctttagtagagacggggtttcgtcatgttggccaggctggtctcaaactcctgacctcaggtgatccgcccgcctggacctcgcaaagtgctgggattacaggcgtgagctaccgtgcccggcctttccatgttttaaagaacatattttgccaccccctggtggacagtggctcaccaccggcacaagaggctacacaggcagatgtcaatggggaccaggcagggacaggtattgtcgtgagcctagccctacccgcgcccccgcgagtaaccacatctcctgactgcccaagcgcagatttccatactgaacatgaaattgcctgacttcgaaatggtggcaaatcattcaaaaaaactttaagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggacgtaagcgtgggccgggcagcacggggcgaggggaggttggtgggccaggggtccggccctgtccctgctccgcctccccgacagtgaccccgaatcttttccccagggaccactccccactcctttcctcacgccaagctctgactttccgtgctccacgatcccgcggctccccctccgcacgtctttcccttgtcgccctccccagtcatgacccgggcgtgaccttcagggaccgcggcccgtatcgggatccctgccccgcgaacactgcgcgtttcggctttcgcgcgctcgggtcccgtccccagaggtagcccggccggctccaacttcgggcaaaacttttcatgtccccctcagcgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggtgcgtaggggtagtaggggatccatgtgggactgccgcagactggagccactgatcctgcctcagggggaaaaacccatttcttgccctgcccagtaaggacacatcagggtctggagctttggggccccctgaccccttaggttcctgctgttaggaccatcttcaaagtgcgagcaggattgaatgaatttctggctctgctcctcagtgtgtaagtctgtgaaccgggaaggctctcttttaacacccccggggcagtgcaagggtcatgtgggattgtctgtgtgctgtacctgccttggcacctgacagggtaggtacacgtggctgaagtgtgattttctagaacttttccaggctggtcagaaggaattctgggtatgttctgaagttacgtattttggacctgtgtcccagccaggttccaggtgaagttcacgggagactcacagagtagtgaaagaccattggcctggatgtctagacatctgctttctgggtcctgcatagctgggggaccccagacaaacttggaaatgaaccatctccagttggcaacctcctcttctgtgaatacaggggaaaagacctccctcccccacaagaagcgtctgcaacccaaacctggcgttctgtgaccgagttaaagtttcctcttgggtaaaagatattcttgagccacatccatgtctaggaggaagtaagggcatgagaagcttgaaaggacactgtccaggcacggtggctcatgcctgtaatcccagcactttgggagaccaaggcgggaggttcatttgacccaggagttgtagaccagtctgggtaacatagtgagatgccatcccccaaaacagttttaaaaattaaccggacatggtggtgtgcacatgtagtctcacttagttggcaggctgaagtgggaggatggtttcagcccaggaggttgaggctgcagtgagctatgattgcgcattgcactccatcctgtgtgacagtgagaccttggctcacaaaaaaagaccttctgaaatggagcctttgttagtccatgaaggtcgatgaggaatggctgatcctgctgggtcctccctcaagctacagaggaataatacagtcagccccctgtatcactgggttacgcatctgttgattcaaacaaccatggattgaaatattagaggaaaaaaaattgataattgcatctatactgaaaatacgtatagactttattccttgtcattattccctaaacaatacaactatttacatagtacgtacattatattaggtattataagtaacccagagattatttaaagtatatgagaggatgtgtgtaggttacatgcaaatattacaccattttatgtaagggacttgagcaaatgtagattctggtttcctctggggattctagaacaaatctcccacggatactcagggaaaactgttactctaacaacaagtgttatacacttaccatgtgctaggtcctctacaggtactttacactcatgatcccatttgatccttacaatccctatccactctccctttgctcagacaagacatgctatccccatgaggtagataatctccattatgccaattttatgatgagaagactaaggctcttcatactcccccgccctcagccaggctgtcccaagctgtggcgctcctcactgaaaactgctgtcacctctgagaggggcatgttggcttatggcacagacattagtggtgggggggccaccctgtgcccaacctttgagaaaacaggtgtctgaggtactgtgtccttagggagtctgcaattaggaggaggcagattgcccctcagcccacagactgacagagatgatggagtgtgcagcacacacgatgaggctactgtgttgagtgtctgtcctaggtgggtcatgctgatgtgcagccaccattccacacctgagtgtcccactgccctgctgggggttggggaatgctcattaccgggatgagcacttttgcaaaatgggctgaggtgggaggatcacttaagcccaggaattcaagaccaccctgggaaacaaagtgcgaccccatctctacaaagtcatacaattagcccagcatggtggcatgagcctgtgatccaaactacatgggaggctgaggcagaaggtttgtttaggcccaggaggtcgaggctgcaataatctgagtttccaccactgcactcactccatgctggctgcctttggattgttcctaattggatggttttgctttcaacagacactccaataaagtacacgaaataaagaataaagttaaacagtcagtcccagtgctgtgtaggtggcagtaagtctgggagagcgacctcggctgaactaactgtggtgtgcatcattgttaagcagggccagcaggatcctcatgtcacctggcaggaggagggacagggaagggtccctagaagtgaccttgagttgcacttagtgctcttggcagagggaagggcttgggctagtgctggaggcatgaagatggggtgtgttcagggctctccagcagtccaggcatgggaaggggacgctgagggccaaaggcggaggtgacactgggaagggaactagcaaggtgaggactggcttttggccatgtgactgaattgcctgtgtggtgcgtgtgtatgtgtgcgaatgtcagtgaactgtgtgtgagtgaattgtgtgtttatgtgtgggtgtatatgtgtgtgatgtgagtgaactgtgtacatgggtgtatacgtgaattttagtgaattgtgtgtaaatgtgagcagtgtgaatttgagtatgtgggtggataagtgaattgtgattttgttggtgtgaattgtgtgcctgtgtgtgacggggagtatgtgtgtgtgtgagtgaactgtgtgatgactatgaatgtcagtgaatgctgtgattgtgtgtgtgtgtgtacgtgtgtggggatttggtctatatgtgtgaatttgagttgtgtgactttgttggatgtgagtgaattatgtgactgggtgtatatgtgtgtgtacacgagttaactgtgtgtaaatggtatgattgtatatgtgtgtgaatgtgatgaatcgtgactagatgcgggtggatgtgtgtatgtgcatggtgtgtccatgagtgtgtaagtgtgcaggtggcacagttgcaacaggagagaagacacaggaagccttacctgccattcatccccccagctgtcctcccagcctggggacccctgggctggaaaggttatgaaaagtggtgctactgccaggaaggggtgatggggcagctgggaggacggtttgagtcttgccaaagggagggagtcgaagcttgcaaccctggggaggaggaggggcagactggggaccctgcttctggaaaaccagcgaccaacccccaaagggacacaggcaacccctgcctccactctacagtggggaaaaggggagagtggcgtggcaggctgcccagccagtcatggagggagtagacttcaggaggagtacagaggtctggtcccattttggggctgaggacaggagcctcaggtcagcagtctgcaggaaggccccagctggaccagctgctcacaccttcccacaggcctgcagatgggtgtggagagcagagcctccaggctgagtctcccagccccagatctgagcagtctaaatcatccccctccaggttccctacggtcttatccaccagccctgctgcccatggtggccccagatgcccaggagagataatagaaggtaagaagtcatgtttgaatgaggaagctctcttcatttatttcatatgaggatgaagaagaggattatgtgatcacaggaatgttgcatgcgggataatccaaagctggttatctccaggccctcactctgccaagagatctctctggaagaagcagccagttcacagatgccctggatccctccgtgcccaatcataaaaaagtcatgaccgtccctatcttgccaatctgccaggactccaaggggaaaaagcggataagtatccttcaggagacagagaaaaagatatcatcagctccttggctaataccacatcttgcaagacccctgccaggtactcccactgtgggtactcaggacagcctgcctcagtccaccaggcattttgcaaacctgctcatcccaataatgattttccccaacccccagcagggcagtgggacactcaggtgtgggaggtagccgcacatcatgacccagctaggacagacacacaatacagtagcctcggtgtgtgtgccgtacactctatcatctccatcagtttgtgtactgaggggtaccctgcctcctaattgcaggctccctaagggcacagtacctcagccacctgttttctcaaaggctgagcacagggtgaccccccaccccaccaaccccgccactaatgtctgggccataagtgaacatgcccctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatgcaattatcaattttttttcctctaatatttcaatccatggttgtttgaatcaacagatgcgtaacccagtgatacagggggctgactgtattattcctctgtagcttgagggaggacccagcaggatcagccattcctcatcgaccttcatggactaacaaaggctccatttcagaaggtctttttttgtgagccaaggtctcactgtcacacaggatggagtgcaatgcgcaatcatagctcactgcagcctcaacctcctgggctgaaaccatcctcccacttcagcctgccaactaagtgagactacatgtgcacaccaccatgtccggttaatttttaaaactgttttgggggatggcatctcactatgttacccagactggtctacaactcctgggtcaaatgaacctcccgccttggtctcccaaagtgctgggattacaggcatgagccaccgtgcctggacagtgtcctttcaagcttctcatgcccttacttcctcctagacatggatgtggctcaagaatatcttttacccaagaggaaactttaactcggtcacagaacgccaggtttgggttgcagacgcttcttgtgggggagggaggtcttttcccctgtattcacagaagaggaggttgccaactggagatggttcatttccaagtttgtctggggtcccccagctatgcaggacccagaaagcagatgtctagacatccaggccaatggtctttcactactctgtgagtctcccgtgaacttcacctggaacctggctgggacacaggtccaaaatacgtaacttcagaacatacccagaattccttctgaccagcctggaaaagttctagaaaatcacacttcagccacgtgtacctaccctgtcaggtgccaaggcaggtacagcacacagacaatcccacatgacccttgcactgccccgggggtgttaaaagagagccttcccggttcacagacttacacactgaggagcagagccagaaattcattcaatcctgctcgcactttgaagatggtcctaacagcaggaacctaaggggtcagggggccccaaagctccagaccctgatgtgtccttactgggcagggcaagaaatgggtttttccccctgaggcaggatcagtggctccagtctgcggcagtcccacatggatcccctactacccctacgcaccggtcctggcccagggctagctccttggtgagaaactcaaagaagtgggcgctgtggctgcggttgtcctcggcggtgcccactacgccgatggaggagatggacagctgcgcgcagggctcggtggacccgctcagcgccatggccaggcccggccgtaccgtcacgttcacgcgctgagggggacatgaaaagttttgcccgaagttggagccggccgggctacctctggggacgggacccgagcgcgcgaaagccgaaacgcgcagtgttcgcggggcagggatcccgatacgggccgcggtccctgaaggtcacgcccgggtcatgactggggagggcgacaagggaaagacgtgcggagggggagccgcgggatcgtggagcacggaaagtcagagcttggcgtgaggaaaggagtggggagtggtccctggggaaaagattcggggtcactgtcggggaggcggagcagggacagggccggacccctggcccaccaacctcccctcgccccgtgctgcccggcccacgcttacgtccgcaggtttgcccaggatggaggcagcggcggcgcagagtcgtttctccagccccgcgggcactcggttggcgggcaaattcgtgtccagctccaggaacggcatggcgggcagaggaacggaaacagctctggcggaagaaaagctgggggtacccaaggctcgcggaccagggaggaggggcgaggcgccacagcaacctggcttctcattggctggacagagactcggcgctccccgattggctgcctagggtacctcccgcttctgcaaacaaaagtcacgtgtgccggctgatttccggaagtcccatcgtctccgccctacgtgtagccccacccactacaggtctttaacccggtagtggacccaccctgtctcccccgaccctcctgcctggcgccaggtgggtttccctctcaagcttccgcgctgtggtcgcccggttcctagccctattagaggtctgaacaccacacccccgacacacaaggacacacacacacctataggggtcttccccaggctcgaccctaataaccaatacaacgggagcttaaagtttttttgaatgatttgccaccatttcgaagtcaggcaatttcatgttcagtatggaaatctgcgcttgggcagtcaggagatgtggttactcgcgggggcgcgggtagggctaggctcacgacaatacctgtccctgcctggtccccattgacatctgcctgtgtagcctcttgtgccggtggtgagccactgtccaccagggggtggcaaaatatgttctttaaaacatggaaaggccgggcacggtagctcacgcctgtaatcccagcactttgcgaggtccaggcgggcggatcacctgaggtcaggagtttgagaccagcctggccaacatgacgaaaccccgtctctactaaagatacaaaaattagccgggcgtggtggcagacgttgtaatcccagctgctcgggaggctgaggcaggagaatcgcttgaaccggggaggtggaggttgcagtgagccgagatcgcgccattgcactccagcctgggtgacagagcgagactccatctcgaaaaaacatcagaaaacatggaactctgttggcgtggcttaaacatgagtgtggtcagtgtggcaaaatcacttgaattgtacattacaaatatgactgaagttgtggtcgagcaatgtggctcacacctgtaatctcagcactttgggaggctaagaagggaggattgcttgagcccaggagttaaagatcaggctaggcaacatagcaagattctcttctttattttctacaaaaaaaaaaaaaaaaaagaaagaaatctgggtgctgtggtgtgtgcctgtagtcctagctacctgggcggctgaggcaggaggattgcttgagcgcaggagatctaggctgcagggagctatgactgtgccactgcactccaccctagatgacagagtgagacccaggctcccccctcccccacaaaaaagaaagaaaaaatttgcaagtttatatgtacaatttcaactacgtgtataaaattctctataagtgtgcatacttaaaggagcctccactgaaaggccgacagagtctctgtctgtcatgatcttgtcctattagcagtttgtttattagatgactcagatatcagaaggtctgagacacacgacaggtaaatatgacagtcctaaggggagagggcagggacaggtggcaagtctgggaccaggtgtggggcatggacaagccagtggtccgggagtggggtgtagagaagactgtggtcaaggttatgaggaggcatgggagagggccaggaaataaccagggacttcccttcctgcaaggaggttcatgaaccagccctgcaccccacttgtggaacacaacatcgccccacagtgaggagagagaccgaggagaccaaggctgatcctgattcagacatctttccaccaggtcacccctcatcgatgatacatgctcagtccgggggtatcccccgcaaggaaacactggggctgaggagcccagagaggtcgcctgacctggactggggctggggaggtcagggaagtctccctggagaagagacagggtgccaaatgccaaaagaccaggaagggcaccaggcgaagatgaggagggaacagcatgagcggaggccaagaggccaaggtgggagcccagagaggggttaggagtgtgcaggcagaaggggccacctggaggagtgggagcaaggccttgaatgcaaagttcaatgacttgtactttagcttctgggcagtgaggaaccatacaaagttccacacagaaggtcagggtcaagtaagcgtttgcccaagctcttttcagaggtcacatggaagctagaatggaatggggtaggagacaaaaggaatgcaggcatgatatctggaggaactgtggaccagagcctttgcagatatgtcttctcttcaaccaaggagacggacagctccatgtctttattctaccaacacagcatcccctcagtggctcagcaagtgtgggacacgcactcacagcaagaaaagctgcattaaggtcttcagattctctttaacagcaggttctactggaggcaggtccttggccttcaggacagctgggagggcctcctggaagaggtcctcccgcactgcagcctccacgtgttgggcaccatgctgccaccgtgggtccgctttcaaagactcagcagccagcactgatgggctaggggaagacagagtcagcggaggggctgggcatagccaagtgtaaggcagcatgacctgctttaggggttctctgattggattttccctcctccaccatgtgtgtgatgggctaggatgtccccctccctggggacacttggaagcctcttaatatagctgcggtgaggggtttgtaaagccccattttatagatgaggacactgaggctcagaaggagaagtgactcacacagggtcccacagccagaaaagacaacatgagctgggatgtcagctcccttcccggatacaccactgcccagcgggccaccgcaccccatggcactctcatgcctcagctccgtgattgccaccaagccagccacagagatacggggcccagtaaggaaggcctggtcccgcaggaacttgtcctcgagcagctgcaggcatccgtccagctcagccaaagtggccgccaacatctcgggtggcactgactcgcccaggaacacagggattattatctggtgggccgacaggcagagagaggggtcagggtctgcccaaagcccatcctggttcccaccatcatcctatcatcaccagtccttgggatttctgctcacctctgctcacttctttccactcatagccaccagtagctctcatctcctactcaaacagggacagcctcccccttctccctgggtcctcacacaaggcaaccagtgggatccttctgtaatctcaatctgcccgtaccctctcttgcataaagccttccatggctccccactgccctcatgagaaaggcctcaacacaaagccagccttctccagtgcggtagccatcccctccccacttttcacctcacctcctactaccccccacttatcaaacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaaggcagacacagttaaggtgtggaaacctccttattgcccgatggatcctccagagaggcggtcccttactttcagcagggcgcgtgtctacctgtttcatgctgtctcacacacagggtgccacccctgtgctgggcactgggtaagtgctctgtacatattaattaggagtactcatttcaaaaatatgtgtgcctttgataaataaaaacagtatgtgcatgttgtgttggtgtgtgcttccttgattattactgaagttaaacatgttttcatccatgtattgaccatttctctttgtccttcaatgaaacctctgctgatttccttcgctcatttttttcctgtgtcttcgtctgatgagtttctcttctttttgtttgttcgtttgtttgttttgagacagtctcgctcagtggcccggctggagtgcagtggtatgatctcagctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtgagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttaaccccagccttccagtcaaggttcccaccagtttgggacacctgcaagtgtcacatcccactgggtgaaactctaagatcccttttaggggatcccattcgctccctcccttccgccaccatgcagcgccgagaaacagagctctgaacgaaccctcagatgtccgtgcgctggggcctttccaggacggcggcgcccagtcgtttctgggtcagggcgacgcctggaactgggcagggtccctggcaccgggatcccgaaaagcagacctgcttctccctgtccagccggttccccttccccttgcagtcggccccctgcatccgcgtcctccctgccagtcgagggtccccagctccaactccaccctcccagctgtgcgttcatagcgaccgccctccctgtagggacgcacggatctggtggtggagtcttggccggcaggactggacaggaaccgaaggggcgaggcgggtccgggggtggtgcgctccaattgggtgctgtccccagggggtggggcctgatcccctatttcccggcgcgccgggatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaaggtgggcccagcccgtttccccgcgtgtccacaaacccagtgcacccccaggcccccgccctgctctgccctgagcgtctcgccgcccgcacagccccctcacctcctcctgcagcgtctgccaccagagaatgctgtggactgagtggccttgaagggatcacagcctctctgaaccttagcttgccttctgaaaaggaggataacgttaccttctgctctgtagggatggaaagaaaatactgaatggagttgacagagttcttgcgtggaatgcacgcatataaattcacaaagcccagaagacctcgggaagaaggacatactgttgtgagaattaagagatgggaagagatgagccaccccagtttgcctcccctcccctggcccaccagagtccggctagaaaacttctctttatccacctgctgcacctggccccacccaccaaaaccccccagctgccccggaatgtggcagggcagggaggcccagccagggagtgaggctgatccaggcctctagtcccagaccttgctgtttctcagggctgtggggctccgcttggggaggaggagggagggtgtagaggtgcagcgtttttactctgaagaccttttctgacttcttcctcttcagggcagcacaagagcaaggagttcttgcagatcaacagcctggggaaactgccgacgctcaaggatggtgatttcatcttgaccgaaaggtgccctccttccctcacccctcaccgcatccggagcccatgtgaccttggctctccccactggccccgggccccagtggccctcccataccccatggggcagcgagggaggggaaaggcgagggatctggccgggcgcggtggctcacgcctgtcatcccggcacttcgggaggccaaggcgggcggatcacgaggtcaggagaccgagaccatcctggctaacaccgtgaaacaccgtctctactaaaaatggaaaaaaaagttaaccgggcgtggtggcgggcgcctgtagtcccagctactctggaggctgaggcaggagaatggtgtgaacccaggaggcggagcttgcagtgtgctgagatcgcgccactgcactccagcctgggcgacagagctagactccgtctcaaaaaggccgggcgcggtggctcacgcctgtaatcccagcactttgggaggccgaggtgggcggatcacgaggtcaggagatcgagaccatcctggctaacacggtgaaaccctgtctctactaaaaatacaaaacattagcagggcgtggtggcggccgcctgtagtcccagctactggggaggctgaggcaggagaatggcgtgaactcaggaggcggagcttgcaatgagcagaggtcgcgccactgcactccagcctgggtgacagagggagcccactccagcctgggcgacagagggagactccgtctcaaaaaaaaaggaaagaaagaaaggagaggtatctggggagaaggtacagcttggggtgtgtccgggatgagcaggggctgacagaacatgtccccccacctctcatcttcagccttttctgagccgcagggcctctccactcccagactgaagggtattagaagagaagacaagggaacatttttccactgttgcgcatttgttcaacaaatgctagctgaaaagagcctctagtgacttgtcgcagactacccaatctacccaggccgggcctagaggccaatgccatggcccaagggcacagctcatggtgaggtccagctgctgggcaggaaaaggacaagaggtcaggtggctgcagaggtgatggctgggggcctgtcagacgggggccaaagacattcctcccctcgtgatccctgacccaagcgcgtggacatgcaagggactccacggagcatccactgtgtgccagccccatgcagggttccaggggtccagggagcctattctgagctgcaccgcctcggacaagtcacttgaccattctgaccttgagttttctcttgtgctaaaaggctaacaggagtgtctacctcacagggcggctgctggcatatcacagagatgaggttctcaaaatgcaaagcagaaggtccagccaagagtcggtgcccaaggcaacaaagacaggaggagactcgtaggaggagggggtggtgttggggagctggagatggagggcgaggctggagggcagtccttcaaatgcagagaagcccccgggccccactggcagatgggagcagttaggggtaaatgcctggtgccagtgtccttatagccactgcccatttgttcccagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgaggagagccatctggagagtgattggccatcagggagtagttggcagtaggccggggccatagactgacccactctctgcccccatcaggtgttggggccactcattggggtccaggtgcccaaggagaaggtggaacgcaacaggactgccatggaccaggccctgcaatggctggaggacaagttcctgggggacaggcccttcctcgctggccagcaggtgacactggctgatctcatggccctggaggagctgatgcaggtgtgagctcagcctgtgggcagtgtccctcttcgtgtcacacccatgaggcagacagaaacactgaggactggagaaagccagaactttgcccagaatcatagagcaagtctctggatgatctggggccagaaccctgaacttctgcctcctgcctgggtgtggggtctcaccctggctgctcttgggctctaaggctgaacatactgcctgggcccctgtggtccattcacttaggggctggggaatggaccatgtctctgatacttctgcccatggttccagcattcgggtcggcagtgacaactgggaaagttgtatgcccacaactttttcatccttgtccctacagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaaccaagagttattggttttactacattgttgtgttatacatatggagtaaaagtatgtgctagtaatcctcatcatggttaataacaaagtaacctcacaataacgagtcaacataattgtatcaccagggcaacaaaatgttaagtaagtaaccaattcgaattgcaaactgttaaaggatataggcgatgtttcacagggcatagcaacggtctttgaagtctaggaaacttaaaagatttcttttaacaagcattcatgtcttctaggacagttttgtaataactgcaaatagtaagattatacattgtcacacagacctccatgtatatccatgggatggaccccaccacaatgattttaacggagagaacttgatataaagaattggtaaccaggcattagagaactccgaagacagagagaatccagattaacacggaggtaaacactgcaagaagctaccacccctagggctgggggatcaagggaggaattaggaagaccaagatgctggaggggccctgaagaattcaaacctccaagaaaggtgttgctcatcccccctagcatcaccttccaagaagggcaggtttccccagtttgccctgaggtcttcacaggaggccatgtggctgtggatgcagttctcaaatgtgacagtagatgtcactgctgaccaataaacaggatgttccagacacactctgcgctacctgcccacatgtcttgtggctttggggcctatttcccatgcctgacctgtgcccaccatgtgccactctattgggggacctgccccaataatcacgtagattgtttcctatttttcctaagtgtcggccggcttgagaaataaagggacagagtacaaaagagagaaattgtaaagctgtgcatccgggggagacgtcacacgttagtaggatctgtgatgccccacaagccacaaaaaccagcaagtttttattagggattttcaaaaggggagggagtgtgcaaataggtgtgagtgacagacatcaagtacttaacagggtaatagaatatcacaaggcaagtggaggcagggcgagatcacaggatcacaggaccgaggcaaaattaaaattgctaatgaagtttcgggcaccattgtcattgataacatcttatcaggagacagggttttgagaccaaccggtctcaccaaaatttattaggcgggaatttcctcttcctaataagcctgggagcactatgggagactggagtctatctcacctctgcagtctcgaccataagagagaggccacgcccggggggctgtttataagccgatacctccaggtgcgtattctctttctcagggacattccatgctgagaaaaagaattcagcgatatttctcccatttgcttttgaaagaagagaaatatggctgtgttctgcccggctcaccggtggtcagagtttaaggttatctctcttattccctgaacaattgctgttatcctcttcttttttcaaggtgctcagatttcatattgctcaaacacacatcctgtacaatttgtgcagttaatgcaattattaaagggtcctgaggcgacatacatcttcctcagctgacaggattaagagattaaagacaggtataggaaatcataagggtgttgattggggaagtgataagtgtccatgaaatctttacaatttatgtttagagattgcagtaaagacaggcataagaaactataatagtattaatttggggaactaataaatgtccataaaatcttcacactccacgttcttctgtcatggcttcagccggtccctctgtttggggtcactgacttcctgtaacaccactcctagccggaagtattccaagtaaccattgcaactgtcctgccttaagggtgcctggtgatggcttctgtcttaggtcccattctggctctctcttccagtgatttctcatactttgggggacactctggcctgctttcctgggccttttccattaccaccccctctccccatcaggcactggggatggcggccacagcctatgccttcttgatccatgctggctgccttgggattgttccttattggatggttttgctttcaacagacactccaataaagtacacgaaataaagaataaagttaaacagtcagtccccgtgctgtgtaggtggcagtaagtctgggagagcgacctcagctgaactaaccatgctgtgcatcattgtcaagcgggaccagcaggatccttaggtcacctggcaggaggaggggcagggaagggtccctagaagtgatcttgagttgcacttagtgctcttggcagagggaagggcttgggctagtgctggaggcatgaagatggggtgtgttcagggctctccagcagtccaggcatgggaaggggacgctgagggccaaaggctaaggtgacactgggaagggaaccatagcaaggtgaggaatggctttcggccatgtgactgaattgcctgtgtgtggtgcgtgtgtacgtgtgtgaatgtcagtgaactgtgtgtgtgaacgtgagtgaattgtgtaactttgtttatgtgtgggtgtatatgtgtgtgatgtgagtgaactgtgtgtatgtgggtgtatatgtgtgtgatgtgagtgaactgtgtgtatgtgggtgtatatgtgtgtggtgtgagtgaactgtgtgtaagtaggtgtatatgtgtgtgaatttgaatggtgtgtaaatgtgactgagcagtgtgaatttgtgtatgtgggtgtatgtgtgtgagtgaactgtgtgattttgttggtgtgaattgtgtgcctgtgtgtgtgaggtgtgtgtgtgtgtgtgactgaactgtgtgatgactttgtattaatgtcagtgaatggtgtggttgtgtatgtgggtgtatatgtgtgtgtatgtatgtgaattgtgtgtggggttggtgtgtatgtgtgtcaatgtgagtgagttgtgtgactgttgaatatgagtgaattatgtgattgtgtgggtgtatatgtgtgtacaggagttaactgtgtgactgtgtgtaaatgttatgattgtgtgtgtgggtgtatatgtgtgaatgtgatacatcgtgtgactgtgggtggacgtgggtggatgtgtgtgtgagtgtgcgtggctgtgtgtcgaacagtgtgtgagtgtaagtgtgcaggtggtagctgtggaattaaggcacattaggggaatccttccttggctctggtccttggtttccctcctatgaaacaagttgggtgaattaggcagtctctggcattccaggatttggtctcaggtctaaacaggattttgtaaagtgaaagcagcatcccttgggcatcccgggaggtgtccctgccctccatggctcaccttctgccacatggcccagcagcagctactctgcagggccatgtgctgccatgacaggtactgatccccatgggcgcgggcctgcaggtcctggaggtaccagtggtcaggtgctttgtacatgcagctcatatagagcaagctagccacactggggggacatggcaggggcagaagacatgccctgaacactcttcagccattttctggggcattttcactatccccatgatgcagaggagggatgtgaggctcagagaggttaggtaactgcccagggtcacacagccctacacggggccagattatcatctcaactaatggcagcaaggaagaaacaaaatgtcatgaacttcagcaggggctcagggaaggcttccaggaggaaggggcacccagtgtgagtctgaagaatgagagcaagttgggtatctccccaacatatccaaagcatggacagggccaggagcaaggccagcagggagagagccttccaggtgacatggcagcattgctccccaccccgtcccatctcctgttcacctatggtgaagggttgtgcagtctgacccccagagctcatcatgcctctatgggtgttggaccatccagtgatcccaggctctgaatgtgaatccagctccaccaaggaggcactatgtggcctcggtaaaggacgccaccatgcggccaccaacctggaggctggttttggctttcatttttcccacccacctccaacccttcagcacaccctgcagttagagtttcaagaaaagtcagaaccgaccatcaccccaccaaccctgcaccaccaccaccttggtctggggctccagcgctgcatgccagatgactgcagtggctttctcacccctgccagggggatcctttatgacgtaagtcagatcacagttctcctctgctcaaaatactccagcgactcaatccccctgcggtaagagccaaagccttcccagtgtcccatgctcccctctgtcgtgacctcctgctcttcctgctcactacacccaccctggcccgttgctctccagtctgaaccccatgcattgtcccacctggagccttcgccctcactcttccctccagccagaacacccttctcctcatgccttgcacattcctacagctctctgctcagatgccacttcctccagggagtcttccctcaacatcctactcacacacccccaatcttaccctgtttattttttccatggcatccatcaacatccgatatgttccatgtttacatgggttactgtcagctcccccttctattaatggaatgtgagatccatgaggagaaggacgtagacacgttcactgctcaagccccagggcttaaatggggtctggccctggtggatgtttagcaaatagccactgaagctcgctgagtggtccctcgactctccagggaaacagcacttgccccacaggatttgtgggcaaaatggtagcactaagatgcctggtacagccgctcctcgaaacttagcactctccttttttcggaggggaaggctggcggtgaggaggcccggaagcagactgggccctgtggccttgtgcaagtccctcccctcctccagcctcagtttcctcacttgtacaatgcaggaggggacttctataacccttgtcaacactgggcaccactgcctgcctccacccattcttcaccctggggctggtgcagggcccacagtccatgatccaagccatcaacagtgaacagacagccgactggccccacaaggcccggcagcagcccacggaccggttacctctcagccaaggtgaagtccccatccttcaaggcccggcaccttcctcagggggttcacctgggcaaaggcatcgctgtgctgctggcctgcaggagagatcagagaggtgagtggggataacccagagttctctgaggtctctgcccacccccaccccaaaatcccagcagcagctttctgaggcccctatctgggaggcatcagggaagaggaagcctctctgctagtcactgggtcacagaccttgaccccatcagagggccatctttcctgtgtccagctccttgaagcatggctcaaggacaattccctggagctgtaattcacaccccacccccagccagttccatccataggtcagacccctccagcctcctccctgggctctaggcttgccccctctgattcagcttcctatcccagctggggacttaggccctactggccaggctgggtgacctgtcaataccccagagtcccagccaaacatgttcccaaccctcagaccaacctcattcttgctgggaatccctgccccattcagccactcagcccccggtggctcagctcttcttcctttcttatgccaaactctcaaggctccctccccactgggggttcccaggtctgactcactttagcattctaggccagtgctagaggccgcattaggtgcctggtgtttggatcagaggacctcagtcaagccaggctccagtctgatcataggcctacatgtgggcctctttgcccttctactgaatggacatgcacacccctgcccattctccctccacagactgcttctgtgtccagcccctgttctgtagcaggtgactcaagctggttgtaccaagggcagcagttgggaagagtcagctgagcagggtcctccctctggcctgcccagggggctctggctctgctctctgccctactgcttagttatagccctgcctcctccactgaattgtgctccagctgcatctctgtatgccagccagaccagcaaacgctggagctcagggtgagggtgctggcctcccccactgccctgccacagggccctccagcctctagcctctaggagtagccccttcagctgggtgagaagccccatgggatagagcaagtcagatgcaggaaaaagaaaagacagaagaatgccaagaaatacataaaagtggaagagacccagggccagacatggtggtgcatgtctgtgatctcaacactttagaaggaggaggcaggaggatcacttgagctcaggagctcaaggtcagcctggtctacatggcaaaatcacgcgtctacacacaccaaaaaaaaaaaaaaaaaaagtagctgggcacggggacgtgcctgtagtcccaactattctacttaggaggagtaagttgggaggatcacttgatcctgagaggtcaaggctgcagtgagccgggatcatgccactgccctctagcctgggctgcagattgagacactgtaataaataaataaataaataaataaataaataaataaacaaacaataaaaaagtggaagagacacaggcaggggtagacagggactattttacttaggaaacaacgaggcagtttgttttttccaagcacatggggtgaagatattcttgccccactccatttccctaccctcgttctgtgcctgctgtgccctctctaaacctgtattttgaagaatgttttgtattcacaagcaaagatcaagcctctattaaaatagacaaccagtggggcatggcggctcatgcctgtaatcccaacactttgggaggccaaggcaagaggatcacttgagcccaggagttctaggccagcctcggaaacacagcaagacctcctctcaataataataataataataataaattggccaggcatgtcggtgggcacctgtagtcccagctacttgaggggctgaggcgggaggatcgcttaagcctggaaggtcgaggctgcagtgagccatgattgtgccactgcactccagcctgagtgacagagttagatgctgtctccaaaaagtaaaaataataacatagataattatgtaatagtttccacaccggagagtctgattcttcgtgttagtctgcattcttggcccgactgcaaagcagcggggacaggcagggattcgtggccaatatcccctgggcctgcctgcccagcccagctttggtcagctccactgtgcgaagctcgaaggggatgccattcttggcgaagatgtagactgaacggcagggctgggacagcagacccatggcgggggcaatggggtggggcgtcggagggcagacctaaacccaggggacgggccctggggacaaacccggggacaggcccgggaacaggaactgcgggcaggaatggctggttgggggcggcggacaggaacggctgggggtaggtgagggatgggcaggaactgctgggtcaccgagcctgcagcggtgcacctcaccaggagccccgagtccggccacgccctcttcactcatcccttggctcctagaactttgggtcaatcagtggcgtgtctgctctctcaccacccctttctgggaatctaggctgcaggtatatttcccactaaaagggaagaggagaggctgggcgcggtggctcacgcctgtaatcccagcactttgggagaccgaggggggtggatcacgaggtcaggagatcgagaccatactggctaaaacggtgaaacccgtctctactaaaaatacaaaaaattagccgggcggggtggcgggcgcctgtagtcccagctacttgggaggctggggcaggagaatggcgtgaacccgggaggcggagcttgcagtgagccgagctcacgccactgcactccagcctgggcgacagagccatactccgtctcaaaaaaaaaaaaaaaaaaaaggaagaggagaaaggaggtgcagcagcctccttgcccagtgcctgggcccagtgcccaggacggaggccagagaggaagggtggctgactgcctgcggggctgccagccccacacctcatgaaggaatgagctgtccctccccagttgctggggtcatatttgttacactctagctaacgcctccccgagatggctgaggccctgtgaggcctatccagaggtttccaacagtgcctggcattgcacagtaaattaatcaccatgacacgagttttgcaaaagagaaaagatttattcacagggcaccaagcaaggatgtgggatagtagctctcaaatccaccttcccgaaaataaggcttagggataagccttgcttccaagcagtagagcacaggccccagccacgctccagggtaggggaccatacaaggatgtgaatagcagtgtcggccttgtgggcctacaacgcagaagggccatgcacttggtttaaagctttgctgttgccatcttaacattcttaacaagttaaaaataagggtccccacattttcatttatagccagtcctgtccaaggagttcaaagatctcatgagggtggacagggcactgtctgctctgggcagtgatgggaccactaacagttgttctccagtctcccagcgcctaccccagggacacaccttcccctggtctctactattctttttttttttcgagacagggtcttgctgttgcccaggctggaatgagtgcagtggtacaaacttagcttactgcagcctcgacctgggctcaaacaatccttctgcctcaccctcccatgtagctcagaccacatgcgcatgccaccaatctgggctaattttttgactttgtagagacggggtcgcactttgtttcccagggtgctcttgaattccttggctcaagtgatcctcccacctcagcctcccaaagtgctgggattataggtgtgatccaccacccctggcctctctcacattcttgacatttaaagttaccatcattgacaaggaacatgggtacactccaatttactcaagaaaaagctcttttctccattgaagacatatgtggcctagctgcttcatattctagttgaggtcttcttgttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagtagcagccttgcctgggagcttgttagaaatatactaacaggctcccacccccaaacccagacctactgaatcagacagagtttattttcataagatcctcaggtgatccaaatgcaccttaaactttgaggagctttgattcagaacctgggctggaggcccctaggggccaccttgttcctcacagactgcaaggtatgtttttttcttgcctcttctctctgtcccaatgtctccttctctctgtgtctgaccctgaggaccctgtgacatcctcccaggggagtttccactgccaaaggcctgattctctagaaactgatgggctcctctagacaccaatctctacctgggctcttgttgaagaagccaatcagctcattggttggcgatcacgtgatatacaacatggctgccttccaagccttatgtgtggacaaggagatagggacaagtaggcatatcatgttctgctacctggtccatcgtctctcctcaggcccccaggatacacgtttatggggagttttcctcccttcccccaatatggtcactcataactttacacccaacagtcaaacaggggtggaagctacagggtttcatgtaaacaataggctaggctgtggggctgagtaaaaggcactggactgtggtaggtcttactccaagatggccaaatggaagggcttttagctttctttgtttttgttttatattttgagatataatgttcaaatttacacttcagaataaaaaagagccacaatttatgcttcatattttttgtagcttcttccctatgcttttgaacaatgtaatcatattttcattatcagatataattcccataccataatatccaccctttcaaagtatactttaaaattcaattggtttaaagccaattcagtggtttttagtatattaacaaagttttgtcaccatcacagttatctaattctagatcattttcatcacccaaaaagaaactctgtacccaataaagagtcactccccattcccctcttcccctagcccctggttaccattcatctactttctacctctgtggataggaagtagctgcctattctggagatttcattcaaatgtaataatgaaatatgtggccttttatgactggcttctttcatttagcataatggtgtcaaggttcatccatgttgtagcatataacggtacttcatcccttcttatggctgaataatattcaattttatggactttttagcaaaacattctaatttttacttctctactgtgcttattgtttgtctttctccacaacaatgtgagcactaaaggcagacatttttgcctattttgttcactactgctttttctgcaccaaacgcattgcctggttgtgggtacttttctagttttaggaaggagaagacaagatataggtcctgactctggttctgcctctcattcatatgctacccttccccttgaagaacttgtttcttcatctacaaaatgggcataatactactactcatcagggtggttgtgaggattaaacaaggtaagagatgtaaaattgcatgttagttatcagatagatttgtgttcccatctagctccaatgagggagaggatttgctctagtctgtccctctgggctctgggcttctaatgggcagacagcttcctccatgatgtttgtagctgttaaggctggcgtagtccctcaagacaagttttttttttgtttgtttgttttttttttgagtcagagtatcgctctgtcaccaggctggagtacagtggtgcgatcttggctcactgcaatctctgcttcccggattcaagcgattctcctgcctcagcctcctgagtagctgggattacaggcatacgccaccacacccagctaattttaagacaagcttttggaattgaactgctgatggtcttccatgaacaattcaacagaaacccagtagcgtacacttccttgtatgcacttgcaccctctctttacatttattacacatttaatgctacctaataattccctatacttttactttatccaatcgttcaacagattccaaccgaaatacatagaagagtgatattccaacttcatcagaccctgagattctatttttaacatttcttccatggattgttgaatgtttccaatgattgatccaccttcccttggccttttctacattacagatttggtggcatgtccatgtctatgttgccaaacttgcctcatagacccagcttgaacacaagatgggtgcttgctgaagagcaggactcattctgttgaacctgcatgttttctcaggtcagattgcttggtggcgcttctttaatttctttcaacagcacattgtagtttgctgtgttgaaatgttgcttttctttggttaaatttattctattttattctttttgatggtattataaatggaagtgtggttttaattttgtttttcatcctttattgcaaatgtatactattgatttttgtgtattaatcttgtaccctgcaaccttgctgaacttattttattttattgagatggagtctcagtcagtcacccaggctggagtgcagtggcttgatcttggcacactgcaacctccacctcctgggctctggtgattctcctgcctttgcctcctgagtagctgggactacaggcatgcgccaccacgcccggctaatttttgtatttttagtagagacggggtttcaccatattggacaggctggtctcaaacttctgacctcatgatctgcccgccttggcctcccaaagtgctgggattacaggtgtgagccaccgtgcccagccttgaacttgtttattagctctaatggtttttaagtgagttaagaatttctgtaatgtcatctgtgaatagagatggttttacttctttctttctgatctagattccaccttgttcctttttcttgcctaattgccctaataagtagaagtagtgtgaatgaacattcttgtcctgttcctgatcttaggggggaaacgcttgatctttcacaatggatgaagtatggtgttagttataggtttttcatagatgctttttgtcaagttgaggaagttcctttctcgtcttcatctgctgagtaattttatcgtaaaaggatgttaggttttgtcaaatgccttctgtgcattaggatgatcatgtgactttctattaacatggtatgctacactgattgatttttgtatgttgaactgcatttgtactcctgggataaatcctacctggtcaaggtgtatgatccttttaatatgctgctggatttgatttgctaatattttgctgaggatttttacatctatatttataaggatattgctttgtaactttattttcttgtaatgtctttttctgtctttggtatcagagtaattctggcctcatagtatgagttgaaaaatatttcttcctgttttatttttttggaagagtttgtgaaggctttgtgttagttcttcaagcttttggttgaattcaccagggaagccatctggtcctgggcttttctttgtggaatttttaaaaataattaatattttaatctctttatttgttacaggcctattaaaattttatctttcttcttaagtcagttttggtagattgtgtgtttctaaaattttcccatttcatctaggttgtctaaattgtccacatatagttattcatagtatttctaaacttttgaatttctctatgaccaatgtgatgtctccattttctttctttctggtttccatttcattttttcatttttgtttttgtttgttttttgagataaggttcttctatgtgcccaggctggagtgcagtggtgcaatcatagctcggtgtaaccttgaactcttggactcgagtgatcctcccacctcggccacccagttagctaagactacaggcttgcaccaccacaccaagctaatttttttaaaaaatatattttttagaaaaaagtctcattgtgttacccaggctgttatcaatctcctggcctcaagtgatccttctgcctctgctttccaaagtgctgggattgcaggtgtgagccattgcacccagcctccactttctttcttggtgaataatttgacccttatttttttcacttggctattctaagtaaaggtttgccaattttgttgatctttgcaaagatccaatttttggttttattgattttattgcttttctattttctatttcatttatctccattctaatctttattatttcctgttttctagtggtgttgggttgagtttgctcttatttttctagttccttaaggtgtaaagttaggttattgattcaagatcattcttctttaacttatgtgtttacagctataaattttgctcttagaactgcttctgctgcatcctataaatctgggcatgttgtgttttcatttttatttgttcaggatactttttgatgtcccttgtgatttcttctttaacccatttgttgtttaagagtgtgctgtttaatttctatgtgcttgtgagttttctagttttccttctgttcttgatttttaactttattccactgtgtccagagaacatactttgtgtgatttcaatcatcttaaatttgagacttaggaccaaatatatgctctatactggagaatattccatgtgctctttagaagaatgcttattctgctcctgtcgggtggaacgttctgttcatgtctagtgtatgcgattggttaatcgtgcttttcaaattccctatttccttgatggtcttctgtagtttttctattactgaaagtggggtattgaagtcaccaactattattactcacaatgtaaccatatttaaccctttacttttaaaattctttttggaaactggaaggatctgtaaccaccacccactcccacatcagaccctatgcatatgccaactgtctgctgctcagcagctgtgatggttgttccagttctttattaggcaaagaacagttgtttttttgtttttttgtttttttttttttaacatttcctttaaggaaggtggctcagattgctaagccagccaggccctgcgggacaggctgcgcctagggtcacctgctcttcttcagcaactcagaaatattctccttgaccattgaatccaatgttgaaaagtcccagtcggccaactgcattagtcgatcatgggcctccctaaagaggccagagccaatattcagctccacctgcatacgccactcagctagcttggagctgttgaggaagacattatagttggctgccatgggctgtagatagacgaagacaaagacgtggtcagcctggggaccagccccacctgggtcctctcccacagcctcaggcccacgtccctaacatctacctatgcaaagaattaggctgctgacccccaaggcctgagcaaggggtcacagactatgtaatagatgtaggtggggatggaggatccagaatccctcagagtcctcagtcactggtcttcttgctccaagccttctgaaccatgctgagagggctcctggcccaggcacttcccacttctccagcctgcgacctcgcatgaatcctgccttcttccagggaaaccccttatcccaggtgtgtatatgtggatgagggagagaactcaggttttttcctccatgtttagcctcccactgtgatcaagctcaggggctaggatgggagacctggcgggcagtctaccctgcagtttcgctggcttactaagagtttggtttgcacccaagatctttgggaagcccaagaatgggtgtgtgtgggtgaaatgtaaggggtggggacgaagcatatggctgaacccttggggcaggccagaatgatttttcctggtgctggtctgccctgcaaacagaccaaggagactaattttcatatcagccagagatctctgggataaggaaaagaatactgcattttctggtcaatccaccaggaccccaggtccctcctctcgggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttcctcccctgttatctttgggatcagcaactggccagggttgggaagaggagggaagaggaggctgcactccagggccacctgccctgccaggtctctgtactcttgtctgctggatagatattgaacacttcccaggatataaagcagtttcacctcttttagcagttctgattggtggaagttgctgggaaccatgtgttcacaaggatttggggagctcagcaggcataagtcctgtgattgattagtgatgtctgtcacaggcatagaattcaaagtagagacacatgtactggttatttgtcatcttctaattttctataggccatactcttttttgtttttgttttttgagatggagtctcactctgtcgcccaggctggagtgcagtggcacaatcttggctcactgccaactccaactcctgggttcaagcaattgtcctgcctcagcgtcctgagtagctgggattacaggtgcccatcaccacacccagctaataattttgtatttttagtagagatggtgtttcacaatgttggcaaggtaggtcttgaactcctgacctcaagtgatctgcccgcctcggcctcccaaagtactgggattacagttgtgagccaccgtacccggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcaggtctggcgggcaccagtgcgatggtgcgctgtacttgcggcacaggtagtaaaggatggccgcgctgcagaaggggccggtcaggggcactgcccttgccttcctgagtgccactacgtcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacgtagggtagcccctggaggtgcagggaggttatggacttaatgcttaagattaggcattatataagccagggcatgaaaggatccatctctctggtgctggatggagggtgagcccgagggggcagaatggacaatgaggtggcgggccagcaactatcgggaaggttgtggtgtctggggatggtggaggccatggggacagagggaaggggacggaggggagacatgcttcggaggggatgtcctaggccttgctgattgatggctggtgtgggaacctccgcagcacaagggctcctttatcatcaccaacagcaaccatgccaaggtaaaaaggtcagggcatggagagagctatcggttaaaaagtggcaggagagacagcaactggctgcaagactcagaacttctttggatcctgatccaaacaaactgccaagaaaatatttaggagataatcagagagttttgaacaggagccacgtattagatgaaatccaggaattactgttaattttatgaggtatcttaatggtatcgtagtgatgctacgctctatcctagcccaggctggagtgcagtggcacaatcagagttcactgcagtcgtgaactcctggcctcaagcgatcctcccgtgtcagcctctcaaagtgctgggattacaggcatgagccaccgcgcccagcctgttgctttttttttttttttttttttttttttaaagaacgcttatctctaagaggtatgttcctgaacgtttattgatttatttacttacttatttttatttttgagatggggtctcactctgttgcccaggctgaagctcaatctttgctcactgcaacctctgcctcccgggctccagcaatccctccacctcagcctcctgagtagctgggactacaggtgcggaccaccatgctggctaacttttgtattttttgtagagatgggggttttgccatgttgtctaggctaggctggtcttgaacacgtgagctcaggccatcccctcacttcagcctctcaaagtgctagaattacaggcatgagctggcccctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgctcgcactgaacctcccaggaggagcagagacagatggtgcaagggccccagggaagacttacctttcacttaagataaatttcccatctttgaggctgggaagcttcctgagggggttgatgtcaatgtattctttgctgtggtggtgacctgggaggagcagggaaggtctgaggctgtgggactccaggggagagagaactgagactcccagagacacaaacgcctccctctctattttctcaagaagagaggactgaggcccggagggacatggcggctcaccccaggtcacagggcaaggcagttgcagaaccggactgggatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagttttggagtccctctgtgctcgggatggagttggagcccacccctctgaccctcactcgggagcagtggagccctgagcctttctgaacactggggaggatgggtgtagacggactgtgcacttctgccccctttgccaacctggtgggcaggtgctgagttcacaaggtcctagaatcccacaacgaagccagggtgcctggtgggagcccagggagtcccagctgctgttcattcccccttctcctcaaaaagcctgttcatctgtggcgtggggactatcattagtggggagtggctaaggtaggctaggcagggacgcagcctacaagccccgtggcatcttttccttccctgtggacctctggggtgattcccttgtctctgtccctgcttctcagaaatgcccctatcaatctgagcgtggtggctcacgcctgtaatcccagcactttggaggctgaggcggggcagatcacttttggtcaggggttcgagaccagcctggccaacatggtgaaactccatctcgactaaaaatacaaaaaatgagccgggcatggtggcgtttgcctataaacccagcaactcgggaggctgagctgggagaatcacttgaacccagtggagattgcagtgagccaagatagcaccactgcactccagcctgggtgacaaagtgaggctctaccaaaaagaaaaagaaaaaaaaagctccaatctgtgtgtcctgcctccccccaggaccaggcctgccaggcagcagtgggagctgacctttcagcagatccacaaactgaaagttgaactggatgtcatgcttcttcgagaagatgtagacggcacggcagggtgctgacagcaggtccatgtagagctccagggccatgttgagacacatgccaggccccacagctgcagctggccagccacagacctgggcctatgtctggccagagtccctggccctgtgccctctccgatctgggcccaggaccctgcattctggaacctcttgtttccctttgtgttgtcataaggccaggaagcctgcaattctcacagcatcaaggattctaaggaggcccaggagtaggctggcagaggcccgtggcaaaggtgtggcagccgtgaccctactctccccctctcacgtgtgtctgtgtcccgtggcgccacctcacagacaccctgtctgagaagggattatgcctgggaattcccagggccggactttgattgcagaacctgacgaaaggggctttgcagggtccagaatgaggaggaggcaatgagaattatccctggaggattctagaagtagaggctgggagcatccacaggtgaatggagcctgaactatgactagaaaggaattgggagaaagagacacaggaacctgggagcttcgggagcagtggggacaccaccaccaggaagtcagggggcactcggcaatgaaagtggcagatgcaataaaacttttaacatattgttgtataatgtacaataatgtaataaaaatacaccccctatacattattgttccaactctagctctatctattgccctcctcatatgaatccctctccccataccccattctctagttaatcttaactaggcctcctgtttatattagccacatcaagcctagctgtctactctatcctgtgatcaggatgagcatctaatttgaaatatgcactcatcggtgcactatgtacagtggcccaaacagtctcatatgaagtcactctagctattatcctcctatcagtcctattaataagtggttcatttaatttgtatatactcattggaacagaagaatttctctggctgctcctaccatcatgacctctggccataatatgacttatttccacactagcagaaaccagccgagcctctttagacctaacagagggggaatcagaattaatctcgggctttaacgtcgaatatgctgcaggcccatttgccctgttctttatagcagactatataaatatcattataataaatgccctgaaggccgcaagaggttcgtgggtgcagtgcacaggagaccatatctggggacagcagctgcagcagaccccaagctgggccatccctgccacttgccaggtggtgcttggcgaaggcaagcagctcccacccgcccggggaatacagcgcgacccccggcggcatgctcttcagcaccaccccaggaggtaccaggatcatctaccactggaaattcctgatggagtgttgaaacttacccgtgaccaaaacactcccaagggatctgcccaccattcccggggtcaccagccctgccagtgatgatccccccaacggaagccagccagagccacctgagcaatagtccagaagataagcagggcgggcagtgaagaagcacagttttgagatggacatttaaagcaccagccatcgcatggagcactgccaagggacccctcaggcccttcctggaggagtcccaccagccaggccttatgaaagtgatcatactaggcaggcattggtgtggggccagtcaccccagccctctctccctcactcgcggcacctgccccctcctctttgtgaacaccagcaggtacctccttgtgcctccgctgatgcaggagcagctgccccaaggggagtaacccctgccagcacaccctgcagctgagggccaggaagtggacaagaatgaaccctttcttccaaatgatcagctcttccagcccctgctgggggccccacgaccccttccttaggttgacgtgcctgggaaagctcacctccccctcttccctaagagaggaaataaaagccaccttcgccctagggcaaaaaataaataaataataaatcccgtaatcactattgtcttcctaggagcactgcataacatatatataccagaactctataccacaaatttcgtcacccaaactctcattttaacaagtctttttttatgaattcgaacatcatattcctgattccattatgatcagctcatatatctccttgaaaaaattttctaccactcacactagtactttcatatgacatatcttcatgccagtcctaacctccagcatcccaccccaaacataagaaatatgtctcacaaaagagttactttgatagaataaattacagaggtttaaacccttttgtttctagaattacaggaattgaacctacccatgagaatccaaaattctccgtgctacataatacaccacatcctatcacaccccacagtaaggacagctaagtaagctattgggcccataccctgaaaatgttggttatacccttcctatactaattaatcctccagtgtatgccatgcagaggagcccagaaacttcctggcctgggttggggctgcagtggccagactgtgcacctggtggcccaggaaggtaactagagccccacgtagaggactgagtgccactcactctatgctttgtgatttaataggtctaggctcagaaatgggactgatcccacttccagtgacagagtaagcctggagacaagcgaagagcatgcagtgtgtttattgcagacagcagggtgcagtgcagtgggctgtacccactcagtggagccactcctgcagcaactgcacctgcttctgggccagctgggggtcctgccgagcctcactgtggttcagaggctggagtatgagcttgtgggcctccaggaagagctcagtaccaagggcagccttcatatgggcctgtcacactgccagccagggccagtcttggaagaggtcgcagccaacggcagtgggctgggaagacagggcagctggggttggggctcagccccatgcccagagtccccccgagggcaggtgggtaggaaagcttcacctgcatcacctccgtcagcaccaagtcttccagggagatctgctccattgccaggaagggcctggccaccaggacccccccatccaggtgctgcagggctggcgtcagcctccccaacagccgctccagctgtgcagcatctgcaggctgtctggagaagtggggcaggagagactgggctgtgaggagaggagcaacttaacccagactcttggaagcctcttgggcctcctctccatcccttcccggctgccattcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtaccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatctgggtgacctacgtcctttccccatctgggcagctccagctggcttagactctagccaggttccagcctccagctttagcccaaaggtgcccctgggtccagcctctgcatcggagctacacaggctgaaatgaggaaggggccacagtgatttggaaagatctccaacccaaggaaagatctcccctctcgcctctgcctccccctacaactctgagccccagaacccaggcagatcctggctctgaccctgggtgggcaccaggtcaccattacctctctgctagtaggaagtcgccatctctgagggcaggcaccttccccagggggttcaccttcaggaactcaggcttcaggtgctcccctggtgggcagaaaggagagaaggctcagtgcagggcctggtccttggcacccactccatggggcccagcccagccacctggctcaccccaagccaactccactgtctgcagctgaaaagggatgtcattctgcctggcaaaagtggatagcatggcagggggctgagtgcatgtccaggaacagcttgggccccattgctgctcctcccacctgccctccccagaggtctgtacctccaggagttgctcagcccttctcggccagtgccttcccccaaaatggggccagaactctgtactcctcctgaagcctattccctccatgactggctgggaggcctgccaagcccctctccccttttctccacctctgtagagtggaggcaggggtggccagtgtccctttgggggtttcagatagaaactcaatgacaattggcttagcaaaaacaaacaaacaaaaaaaaaacaacaaaaaaaaaacaaagggagtggggtgggtggggagatttctcagaaaacttctccagtcataggaggggaggggtgtagaagccactaagagaactggaatcagaacctgtttctgtctccccacttttcctcccctctcctcctctcccctccttcccctcctgtcccctcccctcctctcccctcccctcccttccctttccttccttcccttcctcctttcctcccttctttctttgagacaggatctctgtctccctacacttttttcttttaattctctgtctctttcttgacatagaatcttgctctgtcacccagcctggagttcagtggcacgatcatggcttactgcaatctccaagtcctgtgctccagcagtcattccactacagcctctggagtacctaggactacaggtgcacatgaccataccccactagttaaaaaaaacaaaaacaaaaacaaaaaaacccttgggcctggcagggcggctcgtgcctacaatcccagccctttgggaggccaagatgggctgatcacatgagcccaggacatcaagacgagcctgggcaacgtgccgaaacccagtctctacaaaaaatacaaaaattagctgggcatggtggcgcatgcctgtagtcccagctactcaagagactgaggtggcaggatcacttgagcccaggaggcagaggttgcagtgagccaagatcacgccactgcgctccagcctaggcaacagagccagactctgtctcaaaaaaaaaaaaaagagagagagacagatagggtctcactatgttgtccaagctgatcacaaactcctggcctaaagtgatccttgggtctcagcctcccgagctgattagctgggattgcaggtgtgggctaccacgccctgttatcactccctttctctgagtcagcttttctctctcagactagcctactccatgaactcaggaaatgtcactacaggtggccccagctcccatttacctccccatagggagctcctctctccagttccaatttcaaaactcccaaggaagcattctggttcactcgcttgggccactggccagagggatgggatactctgaaagattcagctagagtcccgggcccagccctggaccatcactgtgcaccctggttagatgccagggctgggattcagggagaagaaaggaggttcccggacagtcattcctgcctcctgcggctgcgggctccctgcacagtcattcctgcctcctgcggctgcgggctccctgcccccatcctgtgcacgaagtgggagctcccgctgtctggcagcagctgctctgcaggggacagtctggacggcagaaagttcatccttaaccccagccttccagtcaaggttcccacaagtctgggacacctgcaagtgtcatatcccgctgggtgaaagtctgagatcccttttagaggatcccattcgctccctcccttctgccaccttccagctccgagaaacagagctctgaacgaaccctcagatgtccatgcgctggggcctttccaggacggcggggcgcagtcctttctgggttggggtgacacctggaaacatgtaaggtccctggcacagggacccctcccagtttcaagcgattctcctgcctcagtctcccgagtagctgggattacaggcgcccaccactgcacccagctaattttttgtgtttttagtagagatggggtttcaccgtgttagccaggatggtcgcgatctcctgacctcgtgactagcccgcctcagcctcccaaagtgctgggattacaggcgtgagccaccatgcagggccaatttttgtattttcagtagagacagggttttaccatattggacaggttggtctcgaactcctgacctcaggtgatctgcctgcattggcctcccaaagtgctgggattacaggcgtgagccaccaagcctggtggtaatttataaggggtggacatttgttggctcatggtcctgaaggctggaaagtccaagatcgaggggccagcatctggccagagctttcttgctgtatcatcccctggtgaaaggataaagagagggtaagagagagcaagaggctgaactcacagcctcaaagtccttttataatccacatcaatccatctgtaacggtggaggcctcatgagataaacacctctcattaggccccacctcccaacactgttgcattggggattacatttccaacacatgctttgtgggggacccattcaaaccacagcacagggacaccttctctttccttcctgtgatatgctgaataatgacccctaaggatatacaagtcctgatctctggaacctgtgaatattaccttctgtggcaaaagggactttgcagaattgattaagaatgttgagatggaggcattgtcttggattatctgagtgagccctaaatgcagtcacaagtatctgtgtaagaggagacagacggagatttgaaacagaagacaggagaagatggaagcagagagatttgaagatgctacattgtgggctttgaagatggaagaaggggctacatgacccaagacaggcagctccaaaagctggaaaaattgaggaaaccaattcccctctcagagcctctggagggtgtgcaaccctattggcacctgggttttggcccagagaaatagattataaagttctggtctccataactgtaagagaatagatttatgttgttttaagccaccaaggtggtggtaatttgttataccatccagaggagaggaacacagattttggtgccaggaagcagggtgctgctataaaaaagaaaatctaggctgggcacagtggctcatgtctgtaatttcaacattttcggatgccaaggtgggtggattacttgagccctggagtttgagactagcctgggcaacatggcaaaaccccgtctctactaaaaatatataaattagctggggatgggccgggagcagtggctcacgcctataatcccagcactttgggtggcaaaggcaggcggatcacgaggtcagaaggttgagaccatcctggcgaacatggtgaaacccagtctctactaaaaatacaaaaaattaaccaggcgtggtggcgggtgcctgttgtcccagctactcaggaggctgaggtagcagaatggcatgaacccaggaggcggagcttgcagagagccaagatcgtgccactgcactccagcctggggaacaaagcgcgactccgtctcaaaaaaaaaaaaaattagttggggatggtagtgcatgcttgtagtcccagctactggggagaccgaggtgggaggattgcttgaggctgggaagtctaggctgcagtgacctgtgactgtgacactgcactccagcctgggcaacagagtcagaccctgtctcaaacaaacaaacaaacaaaaatctaaaaatgtggaagtagctttaaatttgggtgatgtgcagaggccagaaaaattatgaggcccatgatagagaaaacctagattgccttgcacagattgttggtagaaatatggatgttaaagactatagggagggctcacgagtatcaactaaacatggtcagagcaagtctacattgccttacagcatacctaagtcatcataggcagctgtaggtagatatatagatattggctgggtgcagtggctcacgcctgtaatgccagcactttgggaggctgaggtgggtggatcacctgaggtcaggagttcaaaccagcctggccaacatagtgaaaccccgtctctactaaaaatacaaaaattagctaggcgtggtggcatcccagctactagggaggcggaagcaggagaattgctcgaacctgggagacggaggttgcagtgagccaagattgcgccactatactccatcctgggcgaccaagcgagaatctgcctcaaaaaaagaaaaaatagatattaaaaatcctgctgctgaggactctgaagaaatgaggaacgtgtttctggaaactggaggaaggaggatcatttcccagaaaaggagcccgtagggaggtagaaagcttagttgaattgtgtccgatagttatatggtgggtgaacttaaagcaacgaagttggatatttagctgaggagacttccaagcaaagcgttgaaggtgaagcctcatttcttcttgctgtttatggtgaaaagcaagaggaaagtgataaaatgaggaaaaagctgttaagcaaaaagaaaccaaggtttgatgatttgggaaattatcagcctgtgcagattgcaaaagatgctaaaattagaagattcgctgtttggaaaacacaactctatccctgtcctggggatcactcaagacttgtatccatagacaaccagatttctatgggcttgaactctgtgtgtgtgtgtgtgtgtgtgtgtgtgtgtgtgtgtgtgtgtgtgtgtgtgtgtgtagcaaggttgggggagcacagtggaaagaccttgaatttatttgtttattttttagacggagtcttgctctgtcgcccaggctggagtgcaatggcacgatctcagctcactgcaacctccacctccagggtggttcgagcgattctcctgcctcagcctcccgagtagctgggactacaggcgtataccactatgcccagctaatttttgtattgttagtagagatggggtttcaccatgttggtcaggctggcctcaaattcctgacctcaggtgatcaggctggtctcaaactcctgacatcaggagatccaccagcctcggccttccaaggtgctgggattacaggcatgagccaccatgcccagccttattatttatttatttatttttgagacaaagtctccctctgtcacccagactggagtgcagtggcgcaatctctgctcactgcaacctctgtctcccaggttcaagtgattctcccagctcaacctctcaagtagctgggactacaggtgcgcaccaccatgacctgctaatttttgtatttttatttatttatgtattattttattttatttttccataagttattggggtatgggtggtatttggttacatgagtaagttcttttgtagcaatttgtgagattttggtgcacctgtcaccccagcagtatacactgcaccatatttgtagtcttttatccctcaccctcctcccactcttcccctcaagtccccaaagtccattcttatgcctttgcgtcctcatagcttagctcccacatatcagtgaaaacataagatgtttggttttccattcctcagttacttcacttagaataatagtctccaaactcatccaggtcactgcaaatgctgttaattaattccttttcatgactgagtagtattccacatatacatattccatatatattcattccatatatatattccatatatgctcattccatatacatattccatatatgctcattccatatacatattccatatatactcattccatatacgtattccatacgtatgtactccatatacgtattccatacgtatgtactccatatacgtattccatgtatgtattccatacgtatgtattccatgtatgtattccatgtatattttccatatgtatatattccatgtatatattccatatgtatatattccatatatattccttatgtatatattctgtatgtatatactccatgtatatattccgtatatctatattccatatatgtattccgtatgtatatattccatatgtactccatatgtattccatatgttccatatatattccatatattccatataaattccatatattccatatatatcccatatacattccatatattccacatatattccatatacattccatatattccacatatattccgtatattccatatagattccatacatttattccatatatattccatatagattccatatatattcagatatattccatatttatattccatatatggaatatatatgtattccatatatatgtattccgtatatgtatgtattccacatatatattccatatatgtatgtattccacatatatattccatatacgtatattccagatatatactccatatgtatatcccagatatatatattccagatgtatatattccacatatatattccagatgtatatattccatgtgtgtatattccatatatgtatattccatgtgtgtatattccatgtgtattccatatatatattccatgtgtgtattccatatatatagtccatgtgtgtattccctatatatattccctatatatatattccctatatatattccccatgtacattccatatatatattccccatgtacattccatatatattccccatatatattccatatatattccccatatatattccatatatatattccccatatatattccatatatatattccccatatatattccatatatatattccccatatatattccatatatatattccctatatatatattccctatatatattccctatatattccatatatatatatatatatatatatatatatacaccctatatatatattccctatatattccatatatatatggagtctcgctctgttgcccaggctggagtgcagtggcgcgatctctgctcattgcaagctccacctcccaggttcacgccattctcctgcctcagcctcctgagtagctgggactacaggtgccagccaccatgcccagctaattttgttttcgtatttgtagtagagacggggtttcaccatgttagataggatggtctcgatctcccgacctcgtgatccgcccacctcggcctcccaaagtgctaggattacaggcttgagcctccgcgcccggcctctgaattctttttcaggtaaatcagggatttcttcttggtttggatccgttgctggtgaactagtgtgatatttgggggtgttgacgacccttgttttgtcatgttaccacagttggttttctggttccttctcattggggtaggctctgtcagagggaaggtatagggctgaaggttgttgttaagattttttttgtcccagggctattcccttgatgtagtctctcccccttttcctgtggatgtggcttcctgtgagccaaactgcagtgattgttgtttctcttctgggtctagctgcccagtgagtctagtcagctccaggctggtactgggggttgtctgcacagagtcctgtgatgtgaaccgtctatgggtctctcagccatggataccagcacctattctggtggaggcggcggacggtgcagtgcactccgtgagctttggtggtttaatgctctatttttgtgctggttggcctcctgccaggaggtggctctctccagaaagcatcaactgtagtagtgtggagaggggccagtggtgggtggggccctaggactcccaagattatgcgtcctttgtctaccactactagggtgggtaggaaaggaccctcaggtgaggacggtgctaggcatgtctgagatcagactcttcttgggcaggtgttgctgtagctgctgtggaggatgggggtgagatgcccaggtcattggagttgtgtgcctaggagaattatggctgcctctgctgagtcatgcaggttgtcagggaagtgggggaaagccggaagtcacaggcctcatccagctcccatgcaaactgaaggggcggtctcactcccaccatgtcctgcaaacagccctccatctggaaacagcaaacagtgtgtttccagatggagggccagacgaattgaaaacttgcctgaggctttccacctcccagctgccaaagaaaagggctttagttcttcctccgcctgtgaaatctgcaagccagattcacaccctcccctgggttctggcccagaggcttctcaccccattcaaattgttacaaagttcagctagagaattccttctccctgtggagctgtggagttttaccccttgctttctggccaccctcctgatggatccctgtggtgccaggcaggaatgggctgcttggggatccagtgagctcccagggcctttctgctgcttcctctgaccctgtattttgctcggctgagttttgtaacttgactcagctccaggaaaagtcggaaacttcttccacaaacaggccttcagcttctccagtgggggtgtgtgctcaggagaagcgggtctccctttcccacttccacagctggggcactcacagtatttggggtgtctcctgggccctacaggagcaagtctgcttccttcagagggtctgtggatcctctcaggattgctggtttgttctttcagtggatctgcagctaaaattcacaatgcaagcctccacatgctgctctgtccggagctgcaatctggctatgcctcccgtctgccatgatcccgaaatccctctccaatttttatatttttagtagagttggggttttgccatgttggccaggctggtattgaacttctgacctcaagttatctgcccatctcggcctcccaaagtgttggtgtaccaggacaagctgcagacaaaacctctgagacaccaagttaaagaaggaagggctttattcggccgggaacttcagcaagactcacgtctccaacaaccgagctccctgagtgagcaattcttgtcccttttaagggcttacaattctaaggggtctgtgtgagagggtcatgatcaattgagcaagcagggggtacacgactgggggctgcatgcaccagtaattagaatggaacagaacaggacagggattttcacaatgcttttccatacaatgtctggagtctatagataacataactggttaggtcaggggtggatctttaaccaagcccaaggtgcagcgccgggctgtctgcctgtggatttcatttctgccttttagtttttacctctttctttggaagcagaaattgggcataagacaatatgaggggtggtctcctaccttattggggttacaggcatgagccaccgtgcccagccaagaccctgaatttaaatcctgactctgtcattcattagctcctgacctcaagtatgccattaactactttgaatcctggtatccttgctgtcaaaggagatgagagttctgacacttataggtccactgtaagacataatttttaaaatatctgtaaaaactgggccgggcatggtggctcatacctgtaatcccaatactttgggaggtcaaggaaggcagattgcttgagcccaggagtttgagaccagcctgggcaacatgatgaaaccccgtctttaccaaaaattcaaaaaaatttagctaggcattggcacgtgtctgttagtcccatctgctcgggaggctgaagtgggaggatcactggagcccaggaggcagaggttgcagtgagccgagattgtgccactgcactccagcctggcagagtgagaccctgtctctacaaaaatgtaaaataaacttaaaaaatgtcaaagcatgataaagtacaggacataaagaccatgattaatctaacacccatcactacaatctttgcctctgttctggcattcccctatgtgtcttcgcatcaccctccttctgggtgactcctttatgttgtatttttttgtttggtttggtttttttggttagtttgttctgagacagagtcttgctctgttgctcaggctggagtgtagtggtgtgatcttggctcactgctacctctgcctcccaagtttgtacctcagcctcccgagtagttgggattacaggcatgcgccaccatgccctgctaatttttgtatttttagtagagacggggttttgccatgttggccaggctggtctcagactcctggctcaagtgacctgcccacctcagcctcctaaagtgttgggactacaggcatgagccaccacgcccggccaccccactcattttgaatgtaagtagattaccaattctgaaatgggttttgagcagtagcaacattgacacaaatttataatattttcaagaagatacttccttcaatatgtaaaatgcaacagatatcatttgcaatcatacatatgtacatatatacatacacacatataatatatatatctcaccatggaataagtctgagctgaaacatgcattacttaaaaaagaaaacacttacagacaggatcttgctccgtcatccaggctgaagtacagtggcacgattgtggctcactgcagcctcgacctcctgggctcaagtgatcctcccacctcagcctcccaagtagctgggactacaggcatgagctacctcgcctggcctgcatgatctttatgaagaatgtcatagaaagtttttgaaagcgattaaagttcacctaaacaagcagggatctatgctgtatgccatgctattattggggaggaaaaaaattctcctctacattcttagggtctctggagatctggaactaagaataaaactgaaataagacagattaacagaagaaaatcattcaagttttgctaaattttcagtgtacatgggtactttcacaagagaatgaaggcctaaagaagtcactaaagtagaaaaacaataccttttttttttttttttttaagacaaggacgggtgcggtggctcatgcctataatcccagcactttgggaggccaaggcgggcagatcacaaggtcaggagattgagaccatcctggccaacatggtgaaaccccatctctactaaaaatacaaaaaaattagccaggtgcggtggcgggcacctgtagtcccagctactcaggaggctgaggcaggagaatggcatgaatcctggaggcggagcttgcagtgagcggagatcgcaccactgcactccagcctgggtgacagagcaagactctgcctcaaaaaaaaaaaatgacaagacaaagcggcttggattatagggagtaaattgtggagaagggactaggacatacatgcggagcaaaattagaagataaggattatttttagtcgtgtgtttatacagatccattggaaccttgattcacagtcacttgtgatgacaatgttcttctcttcctggtaaagggagggtgctttcttatgggaaattgtgtggcctattcttagatagaaaagggcaggtcagagagtctttcctgcatgtgctatttctcaagtgccttcaactcaaaataattaatactccaaagcagcatatttggggtgacgtgtttttaattccttcatttcccctgctgcagactttcctagaagtttcagatattaaaagctgagttggtggctatggagataagagccagattcataacgagggatctacaaatggggagaagaacatagataagaataggaatgaataagctgaaaggaacaggtctgagcacatttccccttatcctgttaaacacacatcccattgctgggacaaggtcagtacagcagaaggaatgcacctcttttgtttgatggagagtgtttagcttgttctttaacaggtgcagcttaggcactatttgtcccagtggatttacacagaccagccttatccaccaatgatcacacaaactcctccttttgaggctgtcagtgtgtccagggtgcaacaattttggaatacagcagaagctaagctattaacttcttttgttgtggttgctgttgttgttttgagacagaatctcactttgttgagtgcaggctggagtgcagtggtgcgatcatggcttgctgcatccccagcctcctgggctcaagtgatcctcccacctcagcccccagagtagctggaactactactatgccctactaatttttaaactttttgtagagacagtctcactatgctgcccaggctggcctcgaacttctgggctcaagtgatcctccctcctcagactttcaaagtgctgggattagaggcctcagccaccatgcccagattgctttgacatcttgaggccttactgatccaggagagactgcccctccctgggccagctaattcctacagagaataaatgatttgcttatggtgtgccttcgatgggccaatcaaccgattcgtatctccaacataactttaccagccacctttcagcaggttcctgccccaaatcactccagggacaggtaccaggtaacaaaggaccactcctataacccagagcccatcacaattattaaaactagccagtcctaagtctgtttaccctgtcttgccttcttgcaaaaaacacagtaaagccttttgtccaccttttgccctcactcattctgccacctgactgaccctggtgcttccccatggccctgcatggtgtggcatgtcccccctattgtcttgggaactgtgagtaacaaactttcttttacatggctatcacctctgatctgtggcctcgccatacctgaataaagccaaaatcccaggtacattttaaaacaagtctacaagtcaaggaataccaaggatttccagcaacaccagagaggccggcccacgcccggcctgactcttactgttaatcactagttttgcatttctcttgaggaactagtcaggaggagaaaacctagacagcagctctcctggtcaagacccagtcattcagaagcctaaatggcatgcctaggtgcttggctttaaactgttagcaggtatggagtgctctgattgtgttttagaataatattctgggctgggcacggtggctcacgcctgtaatcccagcactttgggaggcggaggcaggcggatcacgaggtcaggagattgagaccatcctggctaagatggtgaaaccccgtctctactaaaaatagaaaaaattagccgggcgtggtggtgggcgcctgtcgtcccagctactcgggaggctgaggcaggagaatggcgtaaacccaggagtcggagcttgcagtgagccgagattgcgccactcattccagcctgggcaacagagcgagactccatctcaaaaaaaaaaaaaaaaaaaaaaagaataatattctggctgctgctggaaggcagccagggaggaagcaaggacattggatactgcagtaatcctggccaaaggcgacttgtgaaaaggggtgggcaactgaaggggcaggagaatgtggcccctctcagtctggagagagctgcagcactaggccaggaaggcactcttctgcggggggataggtcttaaatggggaccatgggattgggtgcagtggctcatgcctgtaatctcaacacttcaggagtctgaggcaggaagaccacttgagcccaggagttggagaccagcctgggcaacatagtgagaccctgtctcaaaaaaaaaaaaaaagacaatttaaaaactagccagatgtgatgcctgtggtcccagctacttgggaggctgaggtgagatgatcacttgatcacttgagccctggaggtcaaggctacactgagccatgatcatcccactgcactccagcctgcgcaacaaagtgagactcttatctcaaaaaaggcgacaggtgggaaccatggggaaccagagaagcaaagctattctcaagttttccagtaaccatcctcttgccaatggtctttctctgaatcttggatttgggaataggattttcctgccttgggaggctcccttgggaaatgggagtgtcacagccacaggcatcaaaagccctagagttgcacttgaatagtgggtagaaagttctgtgcaatgccaggcactgttggaaacctctgggtagggcttacagggccttagccatctgtgggaggcattagctggagtgtaataaatatgaccctcaggactggggagaaacagctcattccttcatgaggtgtggggctggcagccttgcaggcagccagccacccttcccctctggcctccatcctgggcactgagccaggcactgggtaagaaggctgctgcacctcctttctcctcttcccttttagagagaaagatacccccagccgaggatcccagaaaggcgagagcagacgcgccattgattggcccaaagttctccggagccaacctttgagcaaggagggcgtggctgggctccagtctcctagtgaggtgcaccactgcaggcttggtgacccagccgttcctgcccgctgcccccaaccagccgttcctgcccacagttcctgttcccgggcctgtccccgggtttgtccccagggcccgtcccctgggtttaggtctaccctccctcgccccaccccatcgccctcgccatgggtctggagctgtacctggacctgctgtcccagccctgccgttcagtctacatcttcaccaagaacggcatccccttcgagcttcgcaaagtggagctgaccaaagctgggctgggcaggcaggcccaggggatattggctgcggatccccacctgtccccactgctttgcagtcgggccgagaatgcagactaacatgaagaatcagactctctggtgtggaaactattacgtaattatctatgttattatttttactttttggagacaggagctaactctgtcactcaggctggagtgcagtggcacaatcatggctcactgcagcctcgaccttccaggctcaagcgatcctcccatctcagcccctcaagtagctgggactacagatgcccaccgatatgcccggccaatttattattattattattattattattactattgagaggaggtcttcctgtgttgcccaggcaggtctcaaactcctgagctcaggcgatcctctttccttggcctcccaaagtgctgggattacaggcatcagctgtcatgccctgctggttgtttattttaaaagaggcttcatctttgcttagtgaatacaaagcattcttcaaaatacaggttaagagggggcagagcagatgcagcaggagggcagggaaatggagtggggctagaatatcttcaccccatgtgcttggaaaaaacaatgaaactacctccttgtttcctaagtggagtagtccttgtttacctctgcctgggtctcttcccttcttgcctcttctttttttgacacggtctcactctgcagcccaggtagagggcagtggcatgatcccggctcactgcagccttgacctctcaggctcaagtgatcctcccacttcctcctctcaagtagagtagttgggaccacaggcacgcaaccacatccagcaatttcttttttttcctttttttttttttttttggtatttgtggagacgggattttgccatgtagaccaggctgaccttgaactccagagctcaagtgatcctcctgcctcctccttctaaagtgttgagattacagacatgcactaccatgtctggccctgggtctcttccacttttatgtatttcttggcattcttctgccttttcttttcctgcatctgacttgctctatcccatggggcttctcacccagctgaaggggctgctcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagaaggaggaacctgctcagctgactcttcccaactgctgcccttggtacaaccagcttgagtcacctgctacagaacaggggctggacacagaagcagtctgtggagggagaatgggcaggggtgtgcatgtccattcagtagaaggccagagaggcccacatgtaggcctatgatcagactggagcctggcttgactgatgccctctgatccaaacaccaggcacctaatgcggcctctagcactggcctagagtgctaaagtgagtcagacctgggaacccccagtggggagggagccttgagagtttggcacaagaaaggaagaagagctgagccaccgggggctgagtggctgaatggggcagggattcccagcaagaatgaggttggtctgagggttgggaacatgtttggctgggactctggggtattgacaggtcacccagcctggccagtagggcctaaggccccagctgggataggaagctgaatcagagggggcaagcctagagcccagggaggaggctggaggggtctgacctatggatggaactggctgggggtggggtgtgaattacagctccagggaattgtccttgagccatgcttcaaggaactggacacaggaaaggtggccctctgatagggtcagggtctgtgacccagtgactaacagagaggcttcctcttccctgatgcctcccagataggggcctcagaaagctgctgctgggagtttggagtgggggtgggcagagacatcagagaactcagggttctccccactcacctctctgatctcgcctgcaggccagcagcacagtgatgcctttgcccaggtgaatgccctgaggaaggtgccaggccttgaaggatggggacttcaccttggctgagaggtaaccggtccctgggctgctgccgggccttgtggggccagtcagtcagctgtctgtttactgctgatggcttggatcatggactgtgggccctgcaccagccccagggtgaagaatgggtggaggcaggcagaggtgcccagtgttgacaagggctatagaagtcccctcctgcattgtacaagtgaggaaactgaggctggaggaggggagggacttgcacaaggccacagggcccagtctgcttccgggcctcctcaccgccagtcttcccctccgaaaaaaagagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctacgtccttctcctcatggagctcacattccattaatagaagggggagctgacagtaacccatgtaaacatggaacatatcggatgttgatggatgccatggaaaaaataaacagggtaagagtgggggtgtgtgtcattatgagtaggatgttgagggaagactccctggaggaggtggcatctgagcagagagctgtaggaatgtgcaaggcatgaggggaagggtgttctcactggagggaagagtgagggcgaaggctccaggtgggacaatgcatggggttcagactggagagcaacgggccagggtgggtgcagtgagcaggaagagcaggaggtcatgacagaggggagcatgggacactgggaaggctttggctcttaccacaggtagattgagtcgctggagggttttgagcagaggagaactgtgatctgacttacgtcataaaggatccccctggcaggggtgagaaagccactgcagtcatctggcatgcagcgctggagccccagaccaaggtggtggtggtgcagggttggtggggattgtggtcagttctgacttttattgaaatctaactgcagggtttgctgaagggttggaggtgggtgggaaaaatgaaagccaaaaccagcctctaggttggtggctgcatggtggcgtcctttaccgaggccaaatagtgcctccttggtggagctggattcacattcagagcctgggatcactggatggtccaacacccatagaggcatgatgagctctgggggtcagactgcacaacccttcaccataggtgaacaggagatgggacagggtggggagcaatgctgccatgtcacctggaaggctctctccctgctggccttgctcctggccctgtccacgctttggatatgttggggagatatccaacatgctctcgttcttcagactcacagtggatgccccttcctcctggaagccttccctgagcccctgctgaagttcatgacattttgtttcttacttgctgcccttagttgagatgatagtctggccccgtgtagggctgtgtgaccctgggcacttacctaacctctctgagcctcacatccctcctctgcatcatggggatagtgaaaatgccccagaaaatggctgaagagtgttcagggcatgttttctgcccctgccatgtccccccagtgtggctagcttgctgtgtatgaactgcatgtacaaagcacctgaccactggtacccccaggacctgcaggcccgcgcccgtggggatgagtacctgtcatggcagcacatggccctgcagagtagctgctgctgggccatgtggcagaaggcgagccatggagggcagggacatctcccaagatgccaagggatgctgctttcactttacaaaatcctgtttagacctgagaccaaatcctggaatgccagagactgcctaattcacccaacttgtttcctaggagggaaaccaaggaccagagccaaggaaggattcccctaatatgccttaattccagagctatgagcagttaatcctatgctcttttgcatactccaggttgcctgggaatcttgcctttagggggagaaaataaacaaaccctcactttgctacacacataattcgtagatggagaagtatgaagtgaaaaaagtcaaactaggaagaagtgaggagacatttcaataaacgtttgtctgatgtctcggtatgaaaggactttctaaccctcagaacagtgggagaactcaacaaagaaataaccactacatgccagctgcggtagcatctgtaatgagcacacctgtaatcccagcactttgggaggccgaggcaggcagatcacctgagattgggagtttgagaccagcgtgaccaacatggagaaaccccgtctctaccaaaaatgcaaaattagccgggtatggtggcgcatgcctgtaatcccagctactcgggaggctgagtcaggagaattgcttgaatctgggaggcagagattgcagtcagctgagatcacgccattgaactccagccttggcaacaagagcaaaactctgtctcaaaaaacaaacaaacaaaaaaacatatacaaggacatgttgtgtaagaaaaaatggattaaacataaaacaagcaaaaaaccgggaaggatcttgataaaagatatgtcagaaggaggtaatgttctttaagatgctcttagaaacccttaagagaggcctggtatggtggctcacccctgtaatcccagcattttgggaggccaaggtgggcagatcacttgaggtcaggagtttgagaccaccctgggcaacatgatgaaaccccatctatattaaaaatacaaaaattagttgggtgcggtggcacactcaggagactgagacaggagaatcacttgaacctgggaggcggaggttgcagtgagctgacatcataccactgcactcaagctccacttagagcgagactgtctcaaaagcaaacaaagaaaaataagagaaacccatcagacaagagacaggaaaaaaatgagtcatagctcactgcattctagatctcctgggctcaagcgatcctcctgcctccgcccaggtagctagaactacaggtgcacaccacaacactgggattctttttttttttctttttttttgtagaaaacaacgaagggaatcttgctatgttgcctagcctggtcttgaactcctgggctcaagcaatcctcccttcttggcctcccaaagagctgagattacaggtgtcagccactttgcgtgaccacaatttcaatcatatttaaaatgtacaattcaagtgattttgccacactaaccacagactcatgtttaagccacaccaacggatttccatgttttaaataacatattttgccaccccctagtggacagtggctcaccaccggcacaaggggctacataggcagtcaatgggaaccaggcggggacgggaaatgtcgtgaacccaacggtccctgcccagccccacccgcgtccgcaacgtgtaaccacatctcctgactgcccaagagaagcgcagatttccatactgaacatgaaattgcctgacttcgaaatggtggcaaatcattaaaaaaaattttaaactcactttgcattggttattagggtcgaacttggggaagacccctacaggtgtgtgtgtgtctgtatgttaggggtgttcagacctttaatagggctagaaaccaggcaaccacaccgcggaaagcttgaggagagggaaatccaccagacgccaagcaggagggtcagggaagagacagggtggggccactaccgggttaaagacttgtagtgggtggggctacacgtagggccgagacgaccggatttccggaaatcagagccggcacacgtgacttttgtttgcagaagtgggaaggtaccctaggcagccaatcggggagcgctgagtctctgtccagccaatgagaagccaggttgttttagcgcctcgcccctcctctccggtccgcgagccttgggtatctccagcttttttccgccagagctgtttccgttcctctgcccgccatgccgttcctagagctgcacacgaatttccccgccaaccgagtgcccgcggggctggagaaacggctgtgcgccgtcgctgcctccatcttgggcaaacctgcagacgtgagcgtgggccgggcagcactgggcgaggggaagttggtgggccaggggtccggccttgtccctgctctgcctccgcaacagcgaccccgatccctttccccagggaccaccccccaccccattccgcaggccaagctctgactttccgtgcttcacgatcccgcggctccccctccgcacgtctttcccttgtcgccctccccagtcatgacccggacgtgaccttcagggacctcggcctgtactgggatccctgtccccgcgaacactgcgcgtttcggctttcgcgcgctcgggtcgggaccccagacgtagcccgactggctccagcttcgggtaaaacttttcatgttcccctcagcttgtgaacgtgacggtacggccgggcctggccagggcgctgagcgggtccaccgagccctgcgcgcagctgtccatctcctccatcggcgtagtgggcaccgccgaggacaaccgcagccacagtgcccacttctttgagtttctcaccaaggagctagccctgggccaggaccggtgcgcaggggtagtaggcccggaatattattctaaaacacaatcagagtactccattcctgctaacagtttaaagccaaacacctaggcaggccatttaggcttctgaatgactgggtcttgaccaggagagctgctgtctaggttttctcttcctgaccagttcctcaagagaaatgcaaaactagtgattaacagtaagagtcaggcagggcgcggtggctcacgcctgtaatcccagcactttgggaggccgaggcgggcggattatgaggtcaggagatcgagaccatcctgactaacacggtgaaactccgtctctactaaaaatacaaaaaactagccggacgtggtgggcgcctgtagtccccgctactcgggaggctgaggcaggagaatggcgtgaacccgggaggcggagcttgcagtgagccgaaattgcgctactgcacaccagccggggcgacaaagcgagactgtctcaaaaaaataccaaaaaacaagcaaaagaaaacaaaacaaaaacagtaagagtcgtcccaacgcagtggcttatgcctgtaattccagcactttgggaggccgaggcaggcagatcacctgtggttgggagttcgagaccagcctgaccaacatggagaaaccctgtctctactacaaatacaaaattagctgggcgtggtggtgcatgcctgtaatcccagctactcagaaggctgaggcaggagaatcactttaacccgggaggcggaggttgtggtgagctgagattttgccactgaactccagcctgggcaaaaagagcaaaactccttctcaaaaaaacaaacaaacaaacaaaaaaaaaaaacacacacacacacaatccaaaaaccagtaagggtcatgtcctgggaggctaactcagccgactgttaggtcaccatgcttatagccaagaaatgtgggatgctgctgggccctgagcggtcagataaactactttctctgataattagaaggctacaggaaatgttttgttttgttttgttttgggtttctttgtgtgtttttagagacaggatcttgttctgttgccccaggctggagtgctatggctcaatcagagctcactgcagcctcgaactcctgggctcaagcaatcctcccacctcagcctcccaagtagctagaactacaggtatgcatcaccacgcctgactaattaaaaaaaaaatttcttttggttgcgtgtggtgtcttggcacccgtaatcccagcactttgggaggtagaggtgggagcatctcttgagcacaggagtgcagggctagcctgggcaacatggcaagaccctgtctctacaaaaataaaaaagaaatgagctgggcgtggtggggtgcacctgttgtcccagcttcttaggaggctgaggtgggaatattgcttgagcctgggatgtcaaggctgcagtgagccatgactgtgccactgcactccaggctgggcaacagagtgagaccccatctctgaaaaaatatttttttggggagccaggcacagtggctcatggtaatcccagcactttcagaggtggaggtgcacagatcatttgaggtacagagtttgacaccagcctggacaacacggtgaaaccctgtttctactaaaaacacaaaaattagccaggtgtgatagtgcgtgcctataatcccagcttctggggagactgaggcaagagaatcgcttgaacctgggaggtggaggttgcagtgagctgtgatcatgccattgcactccagcctgggcaacagagcaagacactatctcaaaaaaaaaaaaaaaaaagtttgttttgaaatcctggactcaagcaatccccccaacctggacctcccaaagtactaggattataagtatgagctaccacactcagccactttttttttttttgagatggagtctcgctcggttgcccaggctggagtgcagtggcgcgatctcggctcattgcaaggtccgcctcctgggttcatgccattctcctgcctcagcctcccgagtagctgggactacaggcacccaccaccacgcccggctaattttttgtatttttagtagagacggggtttcaccgtgttagccaggatggtctcgatctcctgacctcgtgatccccctgccccggcctcccaaagtgctgggattacaagcgtgagccaccgcacgcggcctcagccacatttattaatttcactcttggcaaacatcagggggaagctgacccacacggcctgggaagggggttgtcttttgcatagagaccatgaccaggtctgggacagaggaaagtcaaataaatcacacattagagttagaagcagaggctcaggctgagcccaggtttattatccaaaatcaaaatgaaatgcagtgattaaaggacacaaggcctcagtgtgcatcattctcattgtggctttcaggcggctgtggaagacagggtggggatggtggcttcgggaggtgaggtgctctgggacttgggcaagtcttaggcaagccattcctgctttctgggcctggctcccatgggccattagaaatgaaaatgctttgtggactgctgaggacggtgcaagggtgaggtttcccagctcaccggatcatggccagcacccagggcatcagcttctgctttatggtggggtctgcaggtgggaagtccttggccttcagaatgacctcatgggcctcctggaagaggtcctcccccactgctgcctccacgcgctgccgccatgtggccagcttgggtcggccttcgaagacttggcagccagcacccacgggctgtggggaaaagggtacagactggggatggatggttgtgagggcagggatgggcagcatctgatttggggaccacagatctccaggaggtgtttgcacacacacttaagcacagtgccatagcccggtgtggcagcataagcaggacttcagcaactagccagggccccctgcctagtgggttcacctgcccacagcactcacatgcatcagctccgtgatggctacgaggtcagctaaggagatgtgaggaccagtaaggaaggccttgttctggaggaacttgtcctcgagcaactgcagggtcacatccaactctgccagggtggctgccagtgtctggggagatactggctcacccaggaaaacagggaacatcacctggggattgggcaggcaaagtcgggagttactggagtagggagttagttttgatttgcatttccctaatgattagtgatgctgagcatcttttcttttttttttttttttgagactgagtcttgctctctcgcccaggctggagtgcagtggggtgatctcggctcactgcaagctccgcctcctgggttcacgccattctcctgcctcagcctcccgagtagctgggactacaggtgcccgccaccacgcccagctaattttttttttatttttagtagagacagggtttcactgtgttagccaggatggtctcaatctcctgaccttgtgatctgcctgcctccgcctcccaaagtgctgggattacaggcgtgagccaccgcgcccggccaagcatcttttcttgtacttgttggccaaaatgataatattctcaacacattgggttaagtaaaatatatcaatttccttttactttttttttttcttttgagacagtgttcagctctgtcacccaggctggagtgaagtggcaccatctcggcacactgccaactttgccccctgggttcaagcaattctcctgcctcagcatcctgagtagctgggattataggcacaggccaccaagcctggctaatttttgtggttttagtagagacaaggtttccccatgttgaccaggctggtctcgaactcctgacctcaggtgatccactgccttggcctcccaaagtgctaggattattggcatgagccactgtgcctggactctttttactttttaaatgtgcctactagaaaatttaaaattacgtatgtggctcactttatacttctatcggacagcacttgactaaatgaactaaattccagagaggcataagccgttcctagatgagctactttcattccaatttcatttccttgggcccaagcaggctgggagaaagactgtcacaggcatgggcttttctgactgagcagcagtttgggaactgggggcagggatgaaaagcagagagatcttacaggcaacatcgtagttggtgattagattccaaagccatgctagactgagctagtgacctgatctcacattcaagatatttgaaaccaaagataaactgaaaccaactaaacctgcaacccagcccacctcctgattagcttagaagagaacagcctcacatcctggctacctgacacagggaagtgcaagccctttcttgggggtgtttattatgcaattcaatctctgctcttcttttatcataatgtctggcacacaaggatacatcatgaggccgggcatggtggctcatgcctacaatcccagcactttgggaggccgagatgggaggatcacctgaggtcaggagttcaagaccagcctggccaacatggtgaaaccctgtctctacaaaaatacaaaaattagccaggcatgatggcaggtgcctgtaattctagctacttgggaggctgaggtgggagaatcgcttgaacccaggaggcggaggttgcagtgagccaagatcgtgccattgcacgccagcctgggcaatggagtgagagtccgtctcaaaaaaataaaaaataatgataatacatcatgagacatgcaaagaagcaggcaaatgtgacccataatcaagagggagaaaacaacaatcaatagaaatagacccgtaggctgggtatggtggctcatgcctgtaatcccaacactttgggaagccaaggaggacgaatcacttcaggtggagagttcgaaaccagcctggccaacatggtgaaacccggtctccactacaaataacaaaagttagccaggtgtgctggtgggtgcctgtaatcccagctacgcaggaggctgaggcaggagaatcgcttgagcctgggaggtggaggttgcagtgagctgagatcgcaccattgcactcagcctgggtgacagagtgagaccccatctcaaaaacaaaacaaaacaaaaaaaccagacccacagaacacctacgtgttgaaattagttgacaaagatttttaggtaacagtgataaatatgttaaagaatttacaagaaaagacagataaaatggatgaacagatggtgaatttcatcagagaagtggaaattctaaaaaacaaccaaatggaatttccagagctgaaaaatacatatctcaaacaaagaatgtattggatgggcttaatagcaatttggcacaacagaggaaagaatctgtgaaggcaaagacaggtcagtagaaataatccaaaactgaaaagaagagactggtgcctgaacacctttggggaatgctctcgctgccgccccccacattcccagcctcaccttatgccacaaggcccggaggcagcttctccgcagagtcgtgtgctgccatgccaggtactcatccacacgggcacgggcctgcaggtcctgagggtaccagtagtcagggaccttatatttgcgcgtcaggtagagcaggatggccacactgtgggtgtgggggtcatgatgggtaagggaagggcactgtgctgggtatttcatacatagtcgcttttttttttttttgatacggagtctcgctctgtcgctcaggctggagtgcagtggtgcgatcttggctcactgcaacctccacctcccgggttcaagtgattctcctgcctcagcctcccaagtagctggaactacaggtgcgtgccaccatgcctggctaattttttgtagttttagtagagatggggtttcaccatattagccaggatggtctcgaactcctgaccttgtgatctgcctgcctcggcctcccaaagtgctgtgattacacgtataagcaaccgcacctggccttttttttttttttttttttttttttttttggagacaaggtcttcctcagtcacccaggctggagtgcagtggtgcagtctcagctcactgcagcttcaatttttataggagtgcaccaccatgcctggctaccttttttcttttttgtagagatgggatctcactgtattgccaggctggtcttaaactcctatcctcaagcaatcctccagccttggcatcccaaagcgctggcattataggcatgaaccactgtgcccagcacacttctttaacctttctgacaatttgccaaagtattagcctcattttccagagaagaaaaccaggcttagaaaggcagagacttgccctagggcacacagctcttaatggcagagctgagaatctttctgaggctaatacccaagcttttcctaccaccaggcaaaatcccacaacagaatgtcttgccaaatgtttagagacagtttctgatcagagaaccagagagagcttccaggagaacggggcatcaaagctgagctttaaagaagctcagttctttccattcggtatccactctcatctgctgggattccgaccagcctctgatggcctgactgttcaaaaaggcttccgtgtccctttgttctttctgtcattctttctgccaagaatcagctcctatctaagctgactggggtagtttggcttcctaaagtaccactcaggaagcactcctgcagctgcaggatcctagaacaacagaacagacaaggccccctggcactctcctccttccctgggttttgagggccgccatggtgatgagatgagcatggacctggaaggacacaggatgtgtccatttggagacacagaaaagctttcaggaacttggggtttcccaaaggttgggcatgcaggccaaaagggcagaaaacctctgtatctgccacgggcctatattctcttttaagctggggctacacacgtgtcccagcttaacgactccgttgtctgtgcagggtgcccaggagctccttttgctcccagccaattgttcaagccacctctgaggagggctgcaggtctctgtgagccacagacctgaaggtgagagtagtgacagaggcagagattgcacattgactctggctggtacctgggggtcacaacgctgagtgacacaaggactcaggacacctggggcaccagggaggaagacgggccctggcagaatgtcagaggaattcatcggaggtgcgtccatcctgagatttcagagatgagctttaaagcacaaactccaggttcttgttaggggaagggtgactctggtgacaaaaggggcagaactggggaaagattggcttttcctgaagaggattcaacttcttgggaccagctgtgatgtaagacgtccatatctggtggctcttccatggggaagacccatcctgggaagctgcagcccagagatggagccaccgggcagcccagatgccactgagccatcgccacacaagcttggccagaggcctgccccacggtgggcaaagctgccatcgtcctctggcctaccctgtctcaaggatactctcaccactcaccagcaaccaaagcactggtgtggaagtaaagtagatatttgcttttctaatcatcagggtgaactggaatagcaggaaggcaagggcctggggtccagtactgactctctgcaggatgcggggcacagagactctctgcctctgaagactttagtttccttgtctatgaaatagagggttagaacaggatggttccagcaggcctggcagcagtcctagggtcccagttacctctccgtcaaggtgaagtccccgtccttcaaggctggcaccttcttgagggggttcacctgggcaaaggcatcgcttaagtgctgacctgggaagagtccagcatggtgggtggtgggaggagaacgctgagcccgccatggcctgtgcccctccctgcaatgctctggccccagtttcacagttcttcttcccaccagtctgcactcctggttggcaaagactggaagggcccctgcgggaggaggaggagaccactccaccggctggtacaaaatagacaacaccccttgctaagtcctgtaggcacagcctcctcccacaggctgcccctctgcaacagagctcactgtgcagggtgtggttcctggacctttgcatgcaccctacccatctcctctttccactattgccagcttcatgaactcacaatcagagcaccccaagctgcacgataggtcacctgaggggactgactaccttgtcccttccaccattaattctaaggcagggtcatgaaacacagagaagtggtctttttctggtatctacctacttagaagcaacttctactggccccaccatgtccctttgttcaccctgccctgggcactgtggagctgtgtgtagcatacctgctaccaccccctgtgccccaaacttttattccccttacagttggggtctcactatgttgcccaggctggtcttgaactactggcctcaagtaatcttcctacttcggcctcccaaagtgctgggattacaggtgtgagccaccatgcccagcctgctaccctctcttcaccctcccttcagactgttccttcaccaggaaaaccctcctctgtctcctgggaaaacacacttccctctgcaccactacatttgacaaccagcttggacgtcctcttgtcccccattccctttcctctactccacactctgcagaggaagtccttgcgcaggacagtgggcagtttgcagaagagattatgtggagaagtttcaggcagagggccagccatggagtgggagccctgggcagaaggcttagccaagtagagtcgccttacttgccccaccagccatacctggattctgcttccaacccctcctactaccccaccctgcactgggcctgggcctgggcctgccagctgagtcctcaagggccttggaggcatgctagagaaacaaaacagggtgtagggctcatcaagccccagggtccccctgctgcttccagcatcagcagcctggggcaacctacctccccagcaggaacaagaggcagaggacaaggtttcgggcggcagaggttgcagtgagctgtgatcctgccactgcactccagcctgggcgacagagcgagactccgtctcaaaaacaaacaaacaaataaacaaaatgccttgggccaggcacagtggctcatgcctgtaatcccagcactttgggaggctaagccggcagatcatttgatgtcaggagttcgagaacagcctgaccaaaattgtgaaatcccatctctgttaaaaatacaaaaaaattagccagacatagtggcacacatttgtaatctagctactcaggaggctgaagcaggagaattgcttgaacccgggaggtggtggttgcagtgattcgagatccgtgccactgcactgcaacaaagcaaaagcaagactctgtctcaaaaaaaaaaggacaaggacaaggtcagaggcaaaacaggaggaacagaggaaggaagggacaaagagggaccccaatgcagactggacgagtgcagagggcagggatggaaagtcacgtcctgagctgtttgctgttgcagaatctcagcagctgggccataaagaagggacttgacgctgtcccagtctctacacttggcacccttgacctctctcatcccacctttccctaggccgaggtcacacctgctttcattttgtttttttttgttttttttttttaagacggggtctcgctagattgccctgacgggagtgcagtggctattcaagggcaccatgatagtgcactgcggcctggaattcctgggctcaagcgatcctcccaccccagcctctcgagttgctgggactacaggcgtgtgcccctgcacccagctgcgcccgtttttgtcctcctgtctggcttctcttcatgatccccacccctttattcggcctcaggggaaccccgtggtctattccgtgagaccgagcagagttttggggagccccgactcttggatctccctgctggctcacctttctctgttcggtctccaaaccagaccagcaatggccccaggaagaaggtggcgctgggagaagttccctaagctatgtatgcctacctgtccccttcctgacttttcggttccccaaacccgaggctggacctacctttaatcagatccacgatgcgcagctcgaagggaatgtcgttcttcttggcaaagatgtaaacagcgcggcagggctgggacagcaggtccaggtacagctccaggcccatagtggggaccgaccgacctgaccggaaaccagagggagtcagcaaactccagtgccaggactcgggtctcggacctcagaccacgcccctgcggctacgcaccccgaccgctgtgccccattgggcggcacggacgcctgggacactctttagtccaattgcgggcggcgggcggcctgtctcagggctgggcccgcctggctcctgtgggatcagggtgggtggccaagagaccgttgtctctcagggggacgcacagagaggccccagtcccatccctttcgtgcctggctcgctcatttcacttagcataatgtcttcaaggtgcatctgtgttgaagcgtgtgtcagaatttcccaccgtccgcattttagaggaggagacagacactgaatgattatagacccagaaagtctggctccaaagtccatcctcttggctcaacactgcagagtccttggtgccagcaagtggcaaagcctcagggcttacgttcagtgttttgtggtcactcgcttcactgcagtcgcactccctggaatgtcacagccttggtcttcctgcccctgccagcacagtgccatctatcgcattccctgggtttatttcttcctttctccaggcctgtgtttctccatctttaaaatgacagggaagctagagccctccagagtccttgcaagtccacccccctggattcatctgctgagccgtaagcccaggcctgccccttgctgccatggagcctgtcaaatagtatcagggtcacatgtcattttctaaaacgaatcccactgaaagtgtgtcagccaacgcataatgttttctagagaataaggaacatttctgcaaataaagtggaagtaacaactgttttattttatttagatagagtctcactctcttgcccagggtagaatgcagtggcatgatcacagctcactacagactccaactcctgggctcaagccatcctcccatctcagcctccccaagtagctgggactacaggtgcgcacaaagacgcccagctagttaaaaaaaatttttttctgtagaggcagggtctcactatgttgcctaggctgatcctcccacctctgccacctgctgggattacagatgtgagccactacaactggccagtaataatgatttttaactggaaaaaaaattaaggaaagatgagaaattcagatttccatgttaaagttttgaaaggaggtagacactcagagaaggcaatggctgccttatcctcacctctggataactccagtcagaggcccaaggaggagctgtcaggattctggttcaaggctcagcctgtcttttaagttcaaaacctaatttggggcgggagtggtggctcattcctataaccccagcaccttgggaggctgaggccggcggatcacctgagttcaggagtttgagaccagcctggccaacttggtgaaaccccatctctgctaaaaatataaaaattatctgggcgtggtggcatgcacctgtaattccagctactcaggaggctgaggcaggagaatcgttgaactctagaggcagaggttgccgtgtgccaagactgcgccattgcactccaggctgggcgacaagagagtaactccaactaaaaaacaaaacaactaatttggtccacgtttcaggattgatcattttctttgggtctgactcacataaaccaactcacaaaggctgtatttattaatttatagaaacaagataaaagtgagagtgtgtgggttggttcgtttgtttgttttttgactttgcccctctctgtcactcaggctgaagtgcagtggtgcaatctctgctcactgcaacctctgcctcctgggttcaagcgattctcgtgcctcagccacccgggtagctgggatttcaggcatgtgccaccatgctcagctaattgtatttttagtagagacagggtttcaccatgttggccaggctggtcttgaactcctggcctcaagtgacctgccagcctcggcctctcaaagtgctgggattacaggcgtgagccaccgtgcccggcctagaaagaagagaaaagtcatttagacagaatgctcccaaccattgctcagtgctctcttggcagtgtagtctcctaggaagcctcgtgggtgttactggccaggaccaggtccgttctgcccatgcacagtaaattaatcactgtgacatgagttttgcaaaagactaaagatttattcacaagggtgccaagcaaggaggtaggataatagctctcaaatccacctccccgaaaataaggcttagggataagccttgcttccaagcaataaagcacagaccccagtcacactcaaggggagggggctatacaaggatgtgaataccagtctgcctgcctcgtgggcctacaacgcagaagggccatgcacttggtttaaaactttgttgttgctgtcttgacattcttaacaatttaaaaataagggtccccacattttcatgtgtagccagtcctgtccaaggagtccaaagaggtcatgagggtggacaggtcactgtctcctctgggcagtgatggggccactagcagttgttctgtagtctcctagcccctaccccagggccacaccttccccatggtctctcacattcttttttttttttttttttttttttttgagacagggtcctgctgttgcccaggctggagtgagtgcagtgctgcaaactcagcttactatagcctcgacctcctgggctcaaacaatccttctgcctcaccctcctgtgtagttcggatcacaggcacatgccaccatgcttggctaattttttgactttgtagagagggcatcacactttgtttcccagggtggtcttgaattcctgggctcaagtgatcctcccacctcagcctcccaaagtgctaggattataaagatgtgatccgccgccccggcctctctcacattcttggcatttaaagttaccgtcattgacaaggaacatgggtacactccaatttactcaagaaaaaaactcttttctccattgaagagatatgtggcctggctgcttcctactctagttgaggtcttctttttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagcagcagccttgcctgggagcttgttagaaatatactaacaggctcccacccccaaacccagacctactgaatcagacagagtctgtattttcataagatcctcagatgatccaaatgcgccttaaactttgaggagctttgatccagaacctgggctggaggcccctgggggccactctgttcctcacagactgcaaggtatgtttttttcttgcctcttctctctgtcctaatgtctccttctctctgtgtctgaccctgaggaccctatgacatcttcccaggggagtttccactgtcaaagagctgattctctctctcttttttttttttttgagacggagtttcgctcttgttgcccaggctggagggcaatggcgtgatctcggcttaccgcgacctctgcctcccaggttgaagcgattctcctgcctcagcctcccgagtagctgggattacaggcatgcatcaccacgcccagctaattttttgtagttttagtagagacagggtttctccatgttggtcaggctggtctcgaactcctgaactcaggtgatctgcccacctcagcctcccaaaggcatgagccaccatgccctactgccagaggcctgattctctagaatctgatgggctcttctagacagcaatctctacctgggctcttgttgaagaagccaatcagctcattggttggaggtcacatgatataaaacatggccatcttccaagccctatgtgtggacaacgagatagggacaagtaggcatatcacgttctgatacctggacccacatctgtcgctgggcccacgtctgtcctcaggcccccaggatatacttttatggggagttttcctcccttcccccaatgtggtcactcataactttacacccaacagtcaaacaggagtggaagctacagagtttcacgcaaacaataggctaggctgtgggactgagtaaaaggcactggactgtggtaggtcttactccaagatggccaaatggaagggcttttagctttctttgtttttgttttatatcctgagacaaaatgttcaatttctacactttagaataaaaagagccatattttatgtttcatattttttgtatgcttcctttcatactcttttgaacaatgcaatcatattttcattatgaggtataattcacataccataatatccgctctttcaaaatatactttaaaattcaattggtttaaagccaattcattggtttttagtatattaacaaagttttgtcaccatcacaattatctaattctagatcattttcatcacccctaaaagaaactctgtacccattaaacagtcactccccatttccctcttctcctagcccctggtaaccattcatctactttctacctctgtggacagtaagtatctgcctattctggacatttcattcaaatttaataatgaaatatgtgagcttttatgactggcttctttcatttaacataatggtgtcaaggttcattcatggtgtagcatataacagtacttcatcccttcctgtggctgaattatattccattttatgtatacaccacattctgtttatccattcaccagttgatggacttttgcattgattctacttttcagctattgtgaatccccatgctgtgatgaacattcacgtacaagtttttgtctggacatatgtcttcagttgtcttgggtatacacctaggaatggaattgctggataatataattctatgttggccgggcacggtggcacatgcctgtaatcccagcactttggaaggctgaggtgggtggatcacctgaggtcaggagttcgagaccagcctggccaacatggcgaaaccccgtctctactaaaaatacaaaaactagctgggcatggtggtgcctgcctgtaattccagcctgtaattccagttactcaggaggctgaggcaggagaattgcttgaaaccaggagacggaggttgcagtgagccgagatggcaccactgcactctagcgtgggtgacagagcaagaatctgtctccaaaaaaaaaaaaaacaaaaaaaacaaaacaaaactaacccatatatatataatatgttatatatacataataatatattttatatatatgtgtatatatgtttaacttttggaggaactgcaagctgttttccaaagcggttatacattttacattctcagcagcagcacacaagggtttcaatttcttcacacatcctcaacaatacttttaatctgtcttttctgttatacccctcatagagtgtgtgaagtgatatctcattgtggtttgattggcaatgtcttgattatagtatctttgtactaagttttgaaattgggaagcatgagtcctacagctttttctttttcaaaattattttgaagattctgagtcactttaatttccaaatgaattttagggccaatttgtcagtttgtgcaaacaggccaagtggaattttaatgcagactgtgttgaatttgacatcttaacattactacaccttccaatcatgaacatgggatgtctttccatttattaaggtcttctttaagttttcccccaacttttaaattatgaaaacatttaaaatccagaaaatgaaaggactagtacaacagcactaatatatgcaaccccagtttcaacttactgttttttgaacataagataccaacatcatgacaccccacctaaggactttttagcaaaacattctaatttctctactgggattattgtttgttgtcttcctccacaataatgtgagcactaaaggtagagacttttgcgtactttgttcactactgcttcctctgcaccaaaaacactgcctggttgtgggtacttttctagttttaggaaggagaagacaagatataggtcctgactctggttctgcctctcattcatatgctactccgaggatcccttccccttgaagaacttgtttcttcatctacgaaatggggataatactactactcatcagggtggttgtgaggattaaacaaggtaagagatgtaaaattgcatgttagttatcagatagttttgttttcccatctagctccatgagggagaggatttgctctagtccgtccgtctgggctctgggcttctaatgggcagacaccttcctccatgatgtttgtagctgcaaagcctggcacagtccctcaagacaagctttttgacttgaactgctgatggtcttccatgcacaattcaacagaaacccagtagcatacacttccttgtatgcacttgcccctctttttacatttattacacattcattgctacctaataatccccgatacttatcttttactttatccaattattcaacagttttcaacagaaatacctagaagagagctattccgacttcattagaccctgagattctatttttaacatttcttccatggattgttgaatgtttccaatgattgatccaccttcccttggcct

SEQ ID NO: 514 - DNA, 49560 bp, Homo sapiens
tcggttggaatctgttgaatgattggataaagtaaaagataagtatagggaattattaggtagcattaaatgtgtaataaatgtaaagagagggagcaagtgcatacaaggaagtgtgcgctactgggtttctgttgaattgttcatggaagaccatcagcagttcaaatccaaaagcctgtcttaaaattagctgagtgtggtggcgtgtgcctgtaattccagctacttgggaggctgaggcaggagaatcacttgaacccaggaagcggcgattgcagtgagccaagatcgcaccactgtactccagcctggtgatagagcgatactccgactcaaaaaaaaaaaaaacttgtcttgagggactatgccaggctttacagctacaaacatcatggaggaagctgtctgcccattagaagcccagagcccggagggacagactagagcaaatcctctccctcgttggagctagatgggaacacaaatctatctgataactaacatgcaattttacatctcttaccttgtttaatcctcacaaccaccctgatgagtagtagtattatccccattttgtagatgaagaaacaagttcttcaaggggaagggatcctcagagtagcatatgaatgagaggcagaaccagagtcaggacctatatcttgtcttctccttcctaaaactagaaaagtacccacaaccaggcaatgcttttggtgcagaaaaagcagtagtgaacaaaataggcaaaaatgtctgcctttagtgctcacattgttgtggagaaagacaaacaataagcacagtagagaagtaaaaattagaatgttttgctaaaaagtccataaaattgaatattattcagccataagaagggatgaagtaccgttatatgctacaacatggatgaaccttgacaccattatgctaaatgaaagaagccagtcataaaaggtcacatatttcattattccatttgaatgaaatctccagaataggcagctacttcctatccacagaggtagaaagtagatgaatggtaaccaggggctaggggaagaggggaatggggagtgactctttattgggtacagagtttcttttttgggtgatgaaaatgatctagaattagataactgtgatggtgacaaaactttgttaatatactaaaaaccactgaattggctttaaaccaattgaattttaaagtatactttgaaagggtggatattatggtatgggaattatatctgataatgaaaatatgattacattgttcaaaagcatagggaagcagctacaaaaaatatgaatcataaattgtggctctttttattctgaagtgtagaaattgaatattatagctcaaaatataaaacaaaaacaaagaaagctaaaagcccttccatttggccatcttggagtaagacctaccacagtccagtgccttttactcagccccacagcctagcctattgtttacatgaaaccctgtagcttccactcctgtttggtgggtgtaaagttatgagtgaccatattgggggaagggaggaaaactccccataaacgtgtatcctgggggcctaaggagagacgatggcccaggtatcagaacatgatatgcctacttgtccctatctccttgtccacacataaggcttggaaggcagccatgttgtatatcacgtgatctccaaccaatgagctgattggcttcttcaacaagagcccaggtagagattggtgtctagaggagcccatcagattctagagaatcaggcctttggcagtggaaactcccctgggaggatgtcatagggtcctcagggtcagacacagagagaaggagacattgggacagagagaagaggcaagaaaaaaacatatcttgcagtctgtgaggaacagagtggcccccaggggcctccacctcaggttctggatcaaagctcctcaaagtttaaggtgcatttggatcacctgaggatcttatgaaaataaactctgtctgattcagtaggtctgggtttgggggtgggagcctgttagtatatttctaacaagctcccaggcaaggctgctactgctgctgatctaatgaccacagtttgaggctggacagagtggctcacacctgtaatcccaacactttgggaggacaaggcaggagggtctcttgagggtagaactttgagaccagcctgggcaacacagcaggacctcgtctctaaaaaacaagagagaagaagaaaaaggaaacaacaagaagactcaactagagtaggaagcagttaggccacatatctcttcaatggagaaaagagctttttcttgagtaaattggagtgtacccatgttccttgtcaatgatggtaactttaaatgtcaagaatgtgagagaggccaggggtggtggatcacacctataatcccagcactgtggggggctgaggtgggaggatcacttgagccaaggaattcgggagcaccctgggaaacaaagtgcgaccccgtctctacaaagtcaaaaaattagcccagactggtggcatgcgcatgtggtctgagctacatgggagggtgaggcagaaggattgtttgagcccaggttgaggctgcagtaagctaagtttgtaccactgcactcattccagcctgggcaacagcaagaccctgtctcgaaaaaaaaaaaaaaaaaagaatagtagagcccaggggaaggtgtggccctggggtaggcgctgggagactggagaacaactgttagtggtcccatcactgcccagagcagacagtgccctgtccaccctcatgagatctttgaactccttggacaggactggctataaatgaaaatgtggggacccttatttttaacttgttaagaatgttaagatggcaacagcaaagctttaaaccaagtgcatggcccttctgcgttgtaggcccacaaggccgacactgctattcacatccttgtatggtcccctaccctggagcgtggctggggcctgtgctctactgcttggaagcaaggcttatccctaagccttattttcgggaaggtggatttgagagctactatcccacatccttgcttggtgccctgtgaataaatcttttctcttttgcaaaactcgtgtcatggtgattaatttactgtgcaatgccaggcactgttggaaacctctggataggcctcacagggcctcagccatctcggggaggcgttagctagagtgtaacaaatatgaccccagcaactggggagggacagctcattccttcatgaggtgtggggctggcagccccgcaggcagtcagccacccttcctctctggcctccgtcctgggcactgggcccaggcactgggcaaggaggctgctgcacctcctttctcctcttcctttttttttattttttgagacggagtatggctctgccgcccaggctggagtgcagtggcgtgagctcggctcactgcaagctccgcctcccgggttcacgccattctcctgccccagcctcccgagtagctgggactacaggcgcccgccaccccgcccggctaattttttgtatttttagtagagacgggtttcaccgttttagccagtatggtctcgatctcctgacctcgtgatccgcccccctcggtatcccaaagtgctgggattacaggcgtgagccaccgcgcccagcctctcctcttcccttttagtgggaaatatacctgcagcctagattcccagaaaggggtggtgagagagcagacacgccactgattgacccgaagttctaggagccaagggatgagtgaagagggcgtggccggactcggggctcctggtgaggtgcaccgctgcaggctcggtgacccagcagttcctgcccaaccctcacctacccccagccgttcctgtccgccgcccccaaccagccattcctgcccgcagttcctgttcccgggcctgtccccgggtttgtccccagggcccgtcccctgggtttaggtctgccctcccacgccccaccccattgcccccgccatgggtctgctgtcccagccctgccgttcagtctacatcttcgccaagaatggcatccccttcgagcttcgcacagtggagctgaccaaagctgggctgggcaggcaggcccaggggatattggccgcggatccctgcctgtccccgctgctttgcagttgggccaagaatgcagactaacacgaagaatcagactctccggtgtggaaactattacataattatctatgttattatttttactttttggagacagcatctaactctgtcactcaggctggagtgcagtggcacaatcatggctcactgcagcctcgaccttccaggcttaagcgatcctcccgcctcagcccctcaagtagctgggactacaggtgcccaccgacatgcctggccaatttattattattattattattgagaggaggtcttgctgtgtttccgaggctggcctagaactcctgggctcaagtgatcctcttgccttggcctcccaaagtgttgggattacaagcatgagccgccatgccccactggttgtctattttaatagaggcttgatctttgcttgtgaatacaaaacattcttcaaaatacaggtttagagagggcacagcaggcacagaacgagggtagggaaatggagtggggcaagaatatcttcaccccatgtgcttggaaaaaacaatgaaactgcctcgttgtttcctaagtaaaatagtccctgtctacccctgcctgtgtctcttccacttttgtattatttgtttgtttatttatttatttatttatttatttatttatttatttatttattacagtgtctcaatctgcagcccaggctagagggcagtggcatgatcccggctcactgcagccttgacctctcaggatcaagtgatcctcccaacttactcctcctaagtagaatagttgggactacaggcacgtccccgtgcccagctacttttttctttggtgtgtgtagacgcatgattttgccatgtagaccaggctgaccttgaactcctgagctcaagtgatcctcctgcctcctccttctaaagtgttgagatcacagacatgcaccaccatgtctggccctgggtctcttccacttttatgtatttcttggcattcttctgccttttccttttcctgcatctgacttgctctatcccatggggcttctcacccagctgaaggggctactcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagagggaggaccctgctcagctgactcttcccaactgctgcccttggtacaaccagcttgagtcacctgctacagaacaggggctggacacagaagcagtctgtggagggagaatgggcaggggtgtgtatgtccattcagtagaagggcaaagaggcccacatgtaggcctatgatcagactggagcctggcttgactgaggtcctctgatccaaacaccaggcacctaatgcggcctctagcactggcctagagtgctaaagtgagtcagacctgggaacccccactggggagggagccttgagagtttggcataagaaagcaagaagagctgagccaccggaggctaagtagctgaatggggcagggattcccagcaagaatgaggttggtctgagggttgggaacatgtttggctgggactctggggtattgacaggtcacccagcctggccagtagggcctaagtccccagctgggataggaagctgaatcagagggggcaagcctagagcccagggaggaggctggaggggtctgacctatggatggaactggctgggggtggggtgtgaattacagctccagggaattgtccttgagccatgcttcaaggagctggacacaggaaagatggccctctgatggggtcaaggtctgtgacccagtgactagcagagaggcttcctcttccctgatgcctcccagataggggcctcagaaagctgctgctgggattttggggtgggggtgggcagagacctcagagaactctgggttatccccactcacctctctgatctttcctgcaggccagcagcacagcgatgcctttgcccaggtgaaccccctgaggaaggtgccgggccttgaaggatggggacttcaccttggctgagaggtaaccggtccgtgggctgctgccgggccttgtggggccagtcggctgtctgttcactgttgatggcttggatcatggactgtgggccctgcaccagccccagggtgaagaatgggtggaggcaggcagaggtgcccagtgttgacaagggttatagaagtcccctcctgcattgtacaagtgaggaaactgaggctggaggaggggagggacttgcacaaggccacagggcccagtctgcttccgggcctcctcaccgccagccttcccctccgaaaaaaggagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctgcgtccttctcctcatggatctcacattccattaatagaagggggagctgacagtaacccatgtaaacatggaacatatcggatgttgatggatgccatggaaaaaataaacagggtaagagtgggggtgtgtgtcattatgagtaggatgctgagggaagactccctggaggaggtggcatctgagcagggagctgtaggaatgtgcaaggcatgaggagaagggtgttctcactggagggaagagtgagggcgaaggctccaggtgggacaatgcatggggttcagactggagagcaacgggccagggtgggtgcagtgagcaggaagagcaggaggtcacgacagaggggagcatgggacactgggaaggctttggctcttaccgcaggtggattgagttgttggagagttttgagcagaggagaactgtgatctgacttacgtcgtaaaggatccccctggcaggggtgagaaagccactgcagtcatctggcatgcagcgctggagccccagaccaaggtggtggtggtgcagggttgcgggggattgtggtcagttctgacttttattgaaatctaactgcagggtttgctgaagggttggaggtgggtgggaaaaatgaaagccaaaaccagcctccaggttggtggccgcatggtggcgtcctttaccgaggccacatagtgcctccttggtggagctggattcacattcagagcctgggatcactggatggtccaacacccataaaggcatgatgagctctgagggtcagactgcacaacccttcaccataggtgaacgggagttgggacagggtgggaagcaatgctgccatgtcacctggaaggctctgtccctgctggccttgctcctggccctgtccacactttggatatgttggggagatatccaacatgctctcgttcttcagactcacactgggtgccccttcctcctggaagccttccctgagcccctgctgaagttcatgacattttgtttcttccttgctgcccttagttgagatgacagtctggccccgtgtagggctgtgtgaccctgggtagttacctaacctctctgagcctcacatccctcctctgcatcatggggatagtgaaaatgccccagaaaacggttgaagagtgttcagggcatgtcttctgcccctgccatgtccccccagtgtggctagcttgctctatatgagctgcatgtacaaagcacctgaccactggtacctccaggacctgcaggcccgcgcccatggggatcagtacctgtcatggcagcacatggccctgcagagtagctgctgctgggccatgtggcagacggtgagccatggagggcagggacacctcccgggatgcccaagggatgctgctttcactttacaaaattctgtttagacctgagaccaaatcctggaatgccagagactgcctaattcacccaacttgtttcataggagggaaaccaaggaccagagccaaggaaggattcccctaatgtgccttaattccacagctaccacctgcacacttacactcacacactgttcgacacacagccacactcacacacacatccacccacgtccacccacagtcacacgatgtatcacattcacacgtatacacccacacacacaatcataacatttacacacagtcacacagttaactcctatacacacatatacacccacacaatcacacaactcactcatattcaacaaagtcacacaactcactcacattgacacacatacacaccaaccccacacacaattcacatacatacacacacatatacacccacatacacaaccacaccattcactgacattaatacaaagtcatcacacagttcactcccacacacacacatacacctcacacacacaggcacacaattcacaccaacaaaatcacacagttcactcattcacacacatacacccacatacacaaattcacactgctcagtcacatttacacaccattcaaattcacacacatatacacctacatacacacagttcactcacatcacacacatatacacccacatacacacagttcactcacatcacacacatatacacccacacataaacacagtcacacaattcactcacgttcacacacacagttcactgacattcgcacacatacacacacaccacacacaggcaattcagtcacatggccgaaagccagtccttaccttcctatagttcctttcccagtgtcacctcagcctttggccctcagcgtccccttcccatgcctggactgcggaagagccctgaacacaccccatcttcatgcctccagcgctagcccgagcccttccctctgccaagagcactaagtgcaactcaagatcacttctagggacccttccctgcccctgctgccaggtgacctgaggatcctgctggtcccgcttgacaatgatgcacagcatggttagttcagctgaggtcgctctcccagacttactgccacctacacagcactaggactgactgtttaactttattctttatttcgtgtactttattggagtgtctgttgaaagcaaaaccatccaataaggaacaatcccaaggcagccagcatggatcaagaaggcacaggctgtggccgccatccccagtgcctgatggggagagggggtggtaatggaaaaggcccaggaaagcaggccagagtgtccctcaaaatatgagaaatcactggaagagagagccagaatgggacctaagacagaagccaccaccaggcacccttaaggcaggacagttgcaatggttacttggaatacttccggctaggagtggtgttgcgggaagtcagggaccccaaacagagggaccggctgaagccatgacagaaaaacgtggattgtgaagattttatggacatttattagttccccaaattaatacttttataatttcttatacctgtctttactgcaatctctaaacataaattgtaaagatttcatggacacttatcacttccccaatcaataccgttgtgatttcctatgcctgtctttactttaatctcttaatcctgtcaaccaaggaggatgtatatggcctcaggaccctgtaataattgcattaactgcacacattgtacaggatgtgtgtttgagcaatatgaaatgtgggcaccttgaaaaaagaacaggataacagcaattgttcagggaataagagagataaccttaaactctgactgctggtgagccaggcggaacagagccacatttctcttctttcaaaagcaaataggagaaatatcgctgaattctttttctcagcatggaacgtccctgagaaagagaatacgcaccaggaggtatcagcttataaacagcacccctgggcgtggcctgtctcttatggtcgagactgcagagatgaaatatactccagtctcccatagcactcccaggcttattaggaagaggaaattcccacctaataaattttggtcagaccagttggtctcaaaaccctgtctcctgataagatgttatcaatgacaatggtgcccgaaacttcattagcaattttaattttgcctcggtcctgtggtcctgtgatcttgccctgcctccacttgccttgtgatattctattaccctcttaagtacttgatgtctgtcactcacacctgttcgcacactccctccccttttgaaaatccctaataaaaacttgctggtttttgtggcttgtggggcatcacggatcctaccaacgtgtgacgtctcccccggatgcccagctttacaatttctctcttttgtactctctccctttatttctcaagccggctgacggttaggaaaaataggaaagaacctacgtgattattggggcaggtcccccgatagagtggcacatgatgggcacagggcaggcttgggaaatggggggccgtaaggccacaagacatgtgggcaggtagcccagagtgtgtctggaacatcctgtttattggtcggcagtgacatctactgtcacatttgagaactgcatccacagccacatgacctcctgtgaagacctcagggcaaactggggaaacctgcccttcttggaaggtgatactaggggggatgagcaacacctttcttggaggtttgaattcttcagggcccctccagcatcttggtcttcctaattcctcccttgatcccccagccctaggggtggtagcttcttgcagtgtttacctccgtgttaatctggattctctctgtcttcggagttctctaatgcctggttaccaattctttatatcaagttctctccgttaaaatcattgtggtggggtccatcccatggatatacatggaggtctgtgtgacaatgtataatcttactatttgcagttattacaaaactgtcctagaagacatgaatgcttgttaaaagaaatcttttaagtttcctagacttcaaagaccgttgctatgccctgtgaaacatcgcctatatcctttaacagtttgcaattcgaattggttacttacttaacattttgttgccctggtgatacaattatgttgactcgttattgtgaggttactttgttattaaccatgatgaggattactagcacatacttttactccatatgtataacacaacaatgtagtaaaaccaataactcttggttctctattcaaagtgtttggaatctttattctgtttaaaacactgatgacatttgccaatttttgagtgttcttcatgttactgatttgtaggagctctttatatattgcagatttagtctcttactggttatgtatgctgcacctgaggagtagcagcactgccaaggacactgagtgtcttgtctgtgcagagcttcacatgaagctggagagaagggactggggcaagagggaaagataaaaaggggcaagtaagtaacagaatgaatccttgttgctaatctcctggcccccatcccagacccttcaggggatcctggcgattcgaagcagcatagcctgataggcctctggtgagggtgttgggagggttttcttggccgcctgttccaggatgctcaagatgatgctgtgggcctcctggcatagctcagcacccaggaaagcctccactcgtccacgccatgctgccagtcgtggccgtccctcaaacagttcatagccgagagccaccggctgtagggacaaggatgaaaaagttgtgggcatacaactttcccagttgtcactgccgacccgaatgctggaaccatgggcagaagtatcagagacatggtccattccccagcccctaagtgaatggaccacaggggcccaggcagtatgttcagccttagagcccaagagcagccagggtgagaccccacacccaggcaggaggcagaagttcagggttctggccccagatcatccagagacttgctctatgattctgggcaaagttctggctttctccaggcctcagtgtttctgtctgcctcatgggtgtgacacgaagagggacactgcccacaggctgagctcacacctgcatcagctcctccagggccatgagatcagccagtgtcacctgctggccagcgaggaagggcctgtcccccaggaacttgtcctccagccattgcagggcctggtccatggcagtcctgttgcgttccaccttctcctcgggcacctggaccccaatgaggggccccaacacctgatgggggcagagagtgggtcagtctatggccccggcctactgccaactactccctgatggccaatcactctccagatggctctcctcacctggacccacaggggtataccaaaggtgccacggatgcagtcggcatgccagcccaggtactcatgaacacgggcacgagcctgcaggtcagatggataccagtggtccggcgtctggtacttacagctcaggtaaatcaggatggccgagctgggaacaaatgggcagtggctataaggacactggcaccaggcatttacccctaactgctcccatctgccagtggggcccgggggcttctctgcatttgaaggactgccctccagcctcgccctccatctccagctccccaacaccaccccctcctcctacgagtctcctcctgtctttgttgccttgggcaccgactcttggctggaccttctgctttgcattttgagaacctcatctctgtgatatgccagcagccgccctgtgaggtagacactcctgttagccttttagcacaagagaaaactcaaggtcagaatggtcaagtgacttgtccgaggcggtgcagctcagaataggctccctggacccctggaaccctgcatggggctggcacacagtggatgctccgtggagtcccttgcatgtccacgcgcttgggtcagggatcacgaggggaggaatgtctttggcccccgtctgacaggcccccagccatcacttctgcagccacctgacctcttgtccttttcctgcccagcagctggacctcaccatgagctgtgcccttgggccatggcattggcctctaggcccggcctgggtagattgggtagtctgcgacaagtcactagaggctcttttcagctagcatttgttgaacaaatgcgcaacagtggaaaaatgttcccttgtcttctcttctaatacccttcagtctgggagtggagaggccctgcggctcagaaaaggctggaagatgagaggtggggggacatgttctgtcagcccctgctcatcccggtcacaccccaagctgtaccttctccccagatacctctcctttctttctttcctttttttttgagacggagtctccctctgtcgcccaggctggagtgggctccctctgtcacccaggctggagtgcagtggtgctatctctgctcattgcaagctccgcctcctgggttcacgccattctcctgcctcagcctccccagtagctgggactacaggcggccgccaccacgccctgctaatgttttgtatttttagtagagacagggtttcaccgtgttacccaggatggtctcgatctcctgacctcgtgatccgcccacctcggcctcccaaagtgctgggattacaggcgtaaaccaccgcgcccggcctttttgagacggagtctagctctgtcgcccaggctggagtgcagtggcgcgatctcagcacactgcaagctccgcctcctgggttcacaccattctcctgcctcagcctccagagtagctgggactacaggcgcccgccaccacgcccggttaactttttttccatttttagtagagacggtgtttcacggtgttagccaggatggtctcggtctcctgacctcgtgatccgcccgccttggcctcccgaagtgccgggatgacaggcgtgagccaccgcgcccggccagatccctcgcctttcccctccctcgctgccccatggggtatgggagggccactggggcccggggccagtggggagagccaaggtcacatgggctccggatgcggtgaggggtgagggaaggagggcacctttcagtcaagatgaaatcaccatccttgagcgtcggcagtttccccaggctgttgatctgcaagaactccttgctcttgtgctgccctgaagaggaagaagtcagaaaaggtcttcagaataaaaacgctgcacctctacaccctccctcctcctccccaagcggagccccacagccctgagaaacagcaaggtctgggactagaggcctggatcagcctcactccctggctgggcctccctgccctgccacattccggggcagctggggggttttggtgggtggggccaggtgcagcaggtggataaagagaagttttctagccggactctggtgggccaggggaggggaggcaaactggggtggctcatctcttcccatctcttaattctcacaacagtatgtccttcttcccgaggtcttctgggctttgtgaatttatatgcgtgcattccacgcaagaactctgtcaactccattcagtattttctttccatccctacagagcagaaggtaacgttatcctccttttcagaaggcaagctaaggttcagagaggctgtgatcccttcaaggccactcagtccacagcattctctggtggcagacgctgcaggaggaggtgagggggctgtgcgggcggcgagacgctcagggcagagcagggcgggggcctgggggtgcactgggtttgtggacacgcggggaaacgggctgggcccacctttgaccaaatccacggtgcgcagctctaaggggatgccattcttcttggcgaagatgtagacggcgcggctgggctgggacaccaggtcaagaaacagctctaggcccatggcgggggcggcaaggacagcggggatggcagtgaaggcgctgagcgcggtgtgggcagcagctgtggcaggatcccggcgcgccgggaaataggggatcaggccccaccccctggggacagcacccaattggagcgcaccacccccggacccgcctcgccccttcggttcctgtccagtcctgccggccaagactccaccaccagatccgtgcgtccctacagggagggcggtcgctatgaacgcacagctgggagggtggagttggagctggggaccctcgactggcagggaggacgcggatgcagggggccgactgcaaggggaaggggaaccggctggacagggagaagcaggtctgcttttcgggatcccggtgccagggaccctgcccagttccaggcgtcgccctgacccagaaacgactgggcgccgccgtcctggaaaggccccagcgcacggacatctgagggttcgttcagagctctgtttctcggcgctgcatggtggcggaagggagggagcgaatgggatcccctaaaagggatcttagagtttcacccagtgggatgtgacacttgcaggtgtcccaaactggtgggaaccttgactggaaggctggggttaaggatgaactttctgccgtccagactgtcccctgcagagcagctgctgccagacagcgggagctgccagacagcgggagctcccacttcgtgcacaggatgggggcagggagcccgcagccgcgggaggcaggaatgactgtccgggaacctcctttcttctccctgaatcccagccctggcatctcaccagggggcacagtgatggtccagggctgggcccgggactctagctgaatctttcagagtatcccatccctctggccagtggcccaagcgagtgaaccagaatgcttccttgggagttttgaaactggaactggagagaggagctccctatggggaggtaaacgggagctggggccacctgtagtgacatttcctgagttcgaggagtagacgagactgagagagaaaagctgactcagagaaagggagtgataacagggcatgctggcccacacctgcaatcccagttactctcacgggatctgtttctctgatgtctgggtatgaaaggactttctaagcctcagaacagtgggagaactcaacaaagaaaaaaccaatacatatacaaggttactttgtggaggaaaaaatggattaaccttaagcaaaaaactgggaaggatctcggtaaaagatacgtcagaaggaagtaatgtcctttaagatgttcttagaaacccatcagacaggtggggtgtggtggttcacgcctgtaatccctgtactttgggaggcagagatgggcggatcagttgaggtcaggagtttgagaccagcctgggcaacacggtgaagccccgtctctactaaaaatacaaaaattagctgggtgcggtggcacactcgggaggctgagacaggagaatcacttgaaccttggaggcagaggtttcagtgagctgagatcataccactgcactccagccgggccactgagcgagactgtctcaaaacaaacaaacgaacaaacaaaaagaagagaaactcatcagacgaagacacaggaaaaaaatgagcgaaggaaatcagcagaggtttcattgaaggacaaagagaaatggtcaatacatggatgaaaacatgtttaacttcagtaataatcaaggaagcacacaccaacacaacatgcacatactgtttttatttatcaaaggcacacatatttttgaaatgagtactcctaattaatatgtacagagcacttacccagtgcccagcacaggggtggcaccctgtgtgtgagacagcatgaaacaggtagacacgcgccctgctgaaagtaagggaccgcctctctggaggatccatcgggcaataaggaggtttccacaccttaactgtgtctgccttgacctctggggcctgggagcagagccccctccagctggtggggaaggaagcgtggtgtgtttgaggacagaatggagagaagttgagtagagcaagtgtagactcttcctatccaaagtgtggtcaatggactgggagtatcagcatcaccagggagcttgttggaaatgcagaggctcaggccccactctgaccttactgattgggagcataaactgtaaccagattccagggaggattcatacacacattcccgtttgataagtggggggtagtaggaggtgaggtgaaaagtggggaggggatggctaccgcactggagaaggctggctttgtgttgaggcctttctcatgagggcagtggggagccatggaaggctttatgcaagagagggtacgggcagattgagattacagaaggatcccactggttgccttgtgtgaggacccagggagaagggggaggctgtccctgtttgagtaggagatgagagctactggtggctatgagtggaaagaagtgagcagaggtgagcagaaatcccaaggactggtgatgataggatgatggtgggaaccaggatgggctttgggcagaccctgacccctctctctgcctgtcggcccaccagataataatccctgtgttcctgggcgagtcagtgccacccgagatgttggcggccactttggctgagctggacggatgcctgcagctgctcgaggacaagttcctgcgggaccaggccttccttactgggccccgtatctctgtggctggcttggtggcaatcacggagctgaggcatgagagtgccatggggtgcggtggcccgctgggcagtggtgtatccgggaagggagctgacatcccagctcatgttgtcttttctggctgtgggaccctgtgtgagtcacttctccttctgagcctcagtgtcctcatctataaaatggggctttacaaacccctcaccgcagctatattaagaggcttccaagtgtccccagggagggggacatcctagcccatcacacacatggtggaggagggaaaatccaatcagagaacccctaaagcaggtcatgctgccttacacttggctatgcccagcccctccgctgactctgtcttcccctagcccatcagtgctggctgctgagtctttgaaagcggacccacggtggcagcatggtgcccaacacgtggaggctgcagtgcgggaggacctcttccaggaggccctcccagctgtcctgaaggccaaggacctgcctccagtagaacctgctgttaaagagaatctgaagaccttaatgcagcttttcttgctgtgagtgcgtgtcccacacttgctgagccactgaggggatgctgtgttggtagaataaagacatggagctgtccgtctccttggttgaagagaagacatatctgcaaaggctctggtccacagttcctccagatatcatgcctgcattccttttgtctcctaccccattccattctagcttccatgtgacctctgaaaagagcttgggcaaacgcttacttgaccctgaccttctgtgtggaactttgtatggttcctcactgcccagaagctaaagtacaagtcattgaactttgcattcaaggccttgctcccactcctccaggtggccccttctgcctgcacactcctaacccctctctgggctcccaccttggcctcttggcctccgctcatgctgttccctcctcatcttcgcctggtgcccttcctggtcttttggcatttggcaccctgtctcttctccagggagacttccctgacctccccagccccagtccaggtcaggcgacctctctgggctcctcagccccagtgtttccttgcgggggatacccccggactgagcatgtatcatcgatgaggggtgacctggtggaaagatgtctgaatcaggatcagccttggtctcctcggtctctctcctcactgtggggcgatgttgtgttccacaagtggggtgcagggctggttcatgaacctccttgcaggaagggaagtccctggttatttcctggccctctcccatgcctcctcataaccttgaccacagtcttctctacaccccactcccggaccactggcttgtccatgccccacacctggtcccagacttgccacctgtccctgccctctccccttaggactgtcatatttacctgtcgtgtgtctcagaccttctgatatctgagtcatctaataaacaaactgctaataggacaagatcatgacagacagagactctgtcggcctttcagtggaggctcctttaagtatgcacacttatagagaattttatacacgtagttgaaattgtacatataaacttgcaaattttttctttcttttttgtgggggaggggggagcctgggtctcactctgtcatctagggtggagtgcagtggcacagtcatagctccctgcagcctagatctcctgcgctcaagcaatcctcctgcctcagccgcccaggtagctaggactacaggcacacaccacagcacccagatttctttctttttttttttttttttgtagaaaataaagaagagaatcttgctatgttgcctagcctgatctttaactcctgggctcaagcaatcctcccttcttagcctcccaaagtgctgagattacaggtgtgagccacattgctcgaccacaacttcagtcatatttgtaatgtacaattcaagtgattttgccacactgaccacactcatgtttaagccacgccaacagagttccatgttttctgatgttttttcgagatggagtctcgctctgtcacccaggctggagtgcaatggcgcgatctcggctcactgcaacctccacctccccggttcaagcgattctcctgcctcagcctcccgagcagctgggattacaacgtctgccaccacgcccggctaatttttgtatctttagtagagacggggtttcgtcatgttggccaggctggtctcaaactcctgacctcaggtgatccgcccgcctggacctcgcaaagtgctgggattacaggcgtgagctaccgtgcccggcctttccatgttttaaagaacatattttgccaccccctggtggacagtggctcaccaccggcacaagaggctacacaggcagatgtcaatggggaccaggcagggacaggtattgtcgtgagcctagccctacccgcgcccccgcgagtaaccacatctcctgactgcccaagcgcagatttccatactgaacatgaaattgcctgacttcgaaatggtggcaaatcattcaaaaaaactttaagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggacgtaagcgtgggccgggcagcacggggcgaggggaggttggtgggccaggggtccggccctgtccctgctccgcctccccgacagtgaccccgaatcttttccccagggaccactccccactcctttcctcacgccaagctctgactttccgtgctccacgatcccgcggctccccctccgcacgtctttcccttgtcgccctccccagtcatgacccgggcgtgaccttcagggaccgcggcccgtatcgggatccctgccccgcgaacactgcgcgtttcggctttcgcgcgctcgggtcccgtccccagaggtagcccggccggctccaacttcgggcaaaacttttcatgtccccctcagcgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggtgcgtaggggtagtaggggatccatgtgggactgccgcagactggagccactgatcctgcctcagggggaaaaacccatttcttgccctgcccagtaaggacacatcagggtctggagctttggggccccctgaccccttaggttcctgctgttaggaccatcttcaaagtgcgagcaggattgaatgaatttctggctctgctcctcagtgtgtaagtctgtgaaccgggaaggctctcttttaacacccccggggcagtgcaagggtcatgtgggattgtctgtgtgctgtacctgccttggcacctgacagggtaggtacacgtggctgaagtgtgattttctagaacttttccaggctggtcagaaggaattctgggtatgttctgaagttacgtattttggacctgtgtcccagccaggttccaggtgaagttcacgggagactcacagagtagtgaaagaccattggcctggatgtctagacatctgctttctgggtcctgcatagctgggggaccccagacaaacttggaaatgaaccatctccagttggcaacctcctcttctgtgaatacaggggaaaagacctccctcccccacaagaagcgtctgcaacccaaacctggcgttctgtgaccgagttaaagtttcctcttgggtaaaagatattcttgagccacatccatgtctaggaggaagtaagggcatgagaagcttgaaaggacactgtccaggcacggtggctcatgcctgtaatcccagcactttgggagaccaaggcgggaggttcatttgacccaggagttgtagaccagtctgggtaacatagtgagatgccatcccccaaaacagttttaaaaattaaccggacatggtggtgtgcacatgtagtctcacttagttggcaggctgaagtgggaggatggtttcagcccaggaggttgaggctgcagtgagctatgattgcgcattgcactccatcctgtgtgacagtgagaccttggctcacaaaaaaagaccttctgaaatggagcctttgttagtccatgaaggtcgatgaggaatggctgatcctgctgggtcctccctcaagctacagaggaataatacagtcagccccctgtatcactgggttacgcatctgttgattcaaacaaccatggattgaaatattagaggaaaaaaaattgataattgcatctatactgaaaatacgtatagactttattccttgtcattattccctaaacaatacaactatttacatagtacgtacattatattaggtattataagtaacccagagattatttaaagtatatgagaggatgtgtgtaggttacatgcaaatattacaccattttatgtaagggacttgagcaaatgtagattctggtttcctctggggattctagaacaaatctcccacggatactcagggaaaactgttactctaacaacaagtgttatacacttaccatgtgctaggtcctctacaggtactttacactcatgatcccatttgatccttacaatccctatccactctccctttgctcagacaagacatgctatccccatgaggtagataatctccattatgccaattttatgatgagaagactaaggctcttcatactcccccgccctcagccaggctgtcccaagctgtggcgctcctcactgaaaactgctgtcacctctgagaggggcatgttggcttatggcacagacattagtggtgggggggccaccctgtgcccaacctttgagaaaacaggtgtctgaggtactgtgtccttagggagtctgcaattaggaggaggcagattgcccctcagcccacagactgacagagatgatggagtgtgcagcacacacgatgaggctactgtgttgagtgtctgtcctaggtgggtcatgctgatgtgcagccaccattccacacctgagtgtcccactgccctgctgggggttggggaatgctcattaccgggatgagcacttttgcaaaatgggctgaggtgggaggatcacttaagcccaggaattcaagaccaccctgggaaacaaagtgcgaccccatctctacaaagtcatacaattagcccagcatggtggcatgagcctgtgatccaaactacatgggaggctgaggcagaaggtttgtttaggcccaggaggtcgaggctgcaataatctgagtttccaccactgcactcactccatgctggctgcctttggattgttcctaattggatggttttgctttcaacagacactccaataaagtacacgaaataaagaataaagttaaacagtcagtcccagtgctgtgtaggtggcagtaagtctgggagagcgacctcggctgaactaactgtggtgtgcatcattgttaagcagggccagcaggatcctcatgtcacctggcaggaggagggacagggaagggtccctagaagtgaccttgagttgcacttagtgctcttggcagagggaagggcttgggctagtgctggaggcatgaagatggggtgtgttcagggctctccagcagtccaggcatgggaaggggacgctgagggccaaaggcggaggtgacactgggaagggaactagcaaggtgaggactggcttttggccatgtgactgaattgcctgtgtggtgcgtgtgtatgtgtgcgaatgtcagtgaactgtgtgtgagtgaattgtgtgtttatgtgtgggtgtatatgtgtgtgatgtgagtgaactgtgtacatgggtgtatacgtgaattttagtgaattgtgtgtaaatgtgagcagtgtgaatttgagtatgtgggtggataagtgaattgtgattttgttggtgtgaattgtgtgcctgtgtgtgacggggagtatgtgtgtgtgtgagtgaactgtgtgatgactatgaatgtcagtgaatgctgtgattgtgtgtgtgtgtgtacgtgtgtggggatttggtctatatgtgtgaatttgagttgtgtgactttgttggatgtgagtgaattatgtgactgggtgtatatgtgtgtgtacacgagttaactgtgtgtaaatggtatgattgtatatgtgtgtgaatgtgatgaatcgtgactagatgcgggtggatgtgtgtatgtgcatggtgtgtccatgagtgtgtaagtgtgcaggtggcacagttgcaacaggagagaagacacaggaagccttacctgccattcatccccccagctgtcctcccagcctggggacccctgggctggaaaggttatgaaaagtggtgctactgccaggaaggggtgatggggcagctgggaggacggtttgagtcttgccaaagggagggagtcgaagcttgcaaccctggggaggaggaggggcagactggggaccctgcttctggaaaaccagcgaccaacccccaaagggacacaggcaacccctgcctccactctacagtggggaaaaggggagagtggcgtggcaggctgcccagccagtcatggagggagtagacttcaggaggagtacagaggtctggtcccattttggggctgaggacaggagcctcaggtcagcagtctgcaggaaggccccagctggaccagctgctcacaccttcccacaggcctgcagatgggtgtggagagcagagcctccaggctgagtctcccagccccagatctgagcagtctaaatcatccccctccaggttccctacggtcttatccaccagccctgctgcccatggtggccccagatgcccaggagagataatagaaggtaagaagtcatgtttgaatgaggaagctctcttcatttatttcatatgaggatgaagaagaggattatgtgatcacaggaatgttgcatgcgggataatccaaagctggttatctccaggccctcactctgccaagagatctctctggaagaagcagccagttcacagatgccctggatccctccgtgcccaatcataaaaaagtcatgaccgtccctatcttgccaatctgccaggactccaaggggaaaaagcggataagtatccttcaggagacagagaaaaagatatcatcagctccttggctaataccacatcttgcaagacccctgccaggtactcccactgtgggtactcaggacagcctgcctcagtccaccaggcattttgcaaacctgctcatcccaataatgattttccccaacccccagcagggcagtgggacactcaggtgtgggaggtagccgcacatcatgacccagctaggacagacacacaatacagtagcctcggtgtgtgtgccgtacactctatcatctccatcagtttgtgtactgaggggtaccctgcctcctaattgcaggctccctaagggcacagtacctcagccacctgttttctcaaaggctgagcacagggtgaccccccaccccaccaaccccgccactaatgtctgggccataagtgaacatgcccctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatgcaattatcaattttttttcctctaatatttcaatccatggttgtttgaatcaacagatgcgtaacccagtgatacagggggctgactgtattattcctctgtagcttgagggaggacccagcaggatcagccattcctcatcgaccttcatggactaacaaaggctccatttcagaaggtctttttttgtgagccaaggtctcactgtcacacaggatggagtgcaatgcgcaatcatagctcactgcagcctcaacctcctgggctgaaaccatcctcccacttcagcctgccaactaagtgagactacatgtgcacaccaccatgtccggttaatttttaaaactgttttgggggatggcatctcactatgttacccagactggtctacaactcctgggtcaaatgaacctcccgccttggtctcccaaagtgctgggattacaggcatgagccaccgtgcctggacagtgtcctttcaagcttctcatgcccttacttcctcctagacatggatgtggctcaagaatatcttttacccaagaggaaactttaactcggtcacagaacgccaggtttgggttgcagacgcttcttgtgggggagggaggtcttttcccctgtattcacagaagaggaggttgccaactggagatggttcatttccaagtttgtctggggtcccccagctatgcaggacccagaaagcagatgtctagacatccaggccaatggtctttcactactctgtgagtctcccgtgaacttcacctggaacctggctgggacacaggtccaaaatacgtaacttcagaacatacccagaattccttctgaccagcctggaaaagttctagaaaatcacacttcagccacgtgtacctaccctgtcaggtgccaaggcaggtacagcacacagacaatcccacatgacccttgcactgccccgggggtgttaaaagagagccttcccggttcacagacttacacactgaggagcagagccagaaattcattcaatcctgctcgcactttgaagatggtcctaacagcaggaacctaaggggtcagggggccccaaagctccagaccctgatgtgtccttactgggcagggcaagaaatgggtttttccccctgaggcaggatcagtggctccagtctgcggcagtcccacatggatcccctactacccctacgcaccggtcctggcccagggctagctccttggtgagaaactcaaagaagtgggcgctgtggctgcggttgtcctcggcggtgcccactacgccgatggaggagatggacagctgcgcgcagggctcggtggacccgctcagcgccatggccaggcccggccgtaccgtcacgttcacgcgctgagggggacatgaaaagttttgcccgaagttggagccggccgggctacctctggggacgggacccgagcgcgcgaaagccgaaacgcgcagtgttcgcggggcagggatcccgatacgggccgcggtccctgaaggtcacgcccgggtcatgactggggagggcgacaagggaaagacgtgcggagggggagccgcgggatcgtggagcacggaaagtcagagcttggcgtgaggaaaggagtggggagtggtccctggggaaaagattcggggtcactgtcggggaggcggagcagggacagggccggacccctggcccaccaacctcccctcgccccgtgctgcccggcccacgcttacgtccgcaggtttgcccaggatggaggcagcggcggcgcagagtcgtttctccagccccgcgggcactcggttggcgggcaaattcgtgtccagctccaggaacggcatggcgggcagaggaacggaaacagctctggcggaagaaaagctgggggtacccaaggctcgcggaccagggaggaggggcgaggcgccacagcaacctggcttctcattggctggacagagactcggcgctccccgattggctgcctagggtacctcccgcttctgcaaacaaaagtcacgtgtgccggctgatttccggaagtcccatcgtctccgccctacgtgtagccccacccactacaggtctttaacccggtagtggacccaccctgtctcccccgaccctcctgcctggcgccaggtgggtttccctctcaagcttccgcgctgtggtcgcccggttcctagccctattagaggtctgaacaccacacccccgacacacaaggacacacacacacctataggggtcttccccaggctcgaccctaataaccaatacaacgggagcttaaagtttttttgaatgatttgccaccatttcgaagtcaggcaatttcatgttcagtatggaaatctgcgcttgggcagtcaggagatgtggttactcgcgggggcgcgggtagggctaggctcacgacaatacctgtccctgcctggtccccattgacatctgcctgtgtagcctcttgtgccggtggtgagccactgtccaccagggggtggcaaaatatgttctttaaaacatggaaaggccgggcacggtagctcacgcctgtaatcccagcactttgcgaggtccaggcgggcggatcacctgaggtcaggagtttgagaccagcctggccaacatgacgaaaccccgtctctactaaagatacaaaaattagccgggcgtggtggcagacgttgtaatcccagctgctcgggaggctgaggcaggagaatcgcttgaaccggggaggtggaggttgcagtgagccgagatcgcgccattgcactccagcctgggtgacagagcgagactccatctcgaaaaaacatcagaaaacatggaactctgttggcgtggcttaaacatgagtgtggtcagtgtggcaaaatcacttgaattgtacattacaaatatgactgaagttgtggtcgagcaatgtggctcacacctgtaatctcagcactttgggaggctaagaagggaggattgcttgagcccaggagttaaagatcaggctaggcaacatagcaagattctcttctttattttctacaaaaaaaaaaaaaaaaaagaaagaaatctgggtgctgtggtgtgtgcctgtagtcctagctacctgggcggctgaggcaggaggattgcttgagcgcaggagatctaggctgcagggagctatgactgtgccactgcactccaccctagatgacagagtgagacccaggctcccccctcccccacaaaaaagaaagaaaaaatttgcaagtttatatgtacaatttcaactacgtgtataaaattctctataagtgtgcatacttaaaggagcctccactgaaaggccgacagagtctctgtctgtcatgatcttgtcctattagcagtttgtttattagatgactcagatatcagaaggtctgagacacacgacaggtaaatatgacagtcctaaggggagagggcagggacaggtggcaagtctgggaccaggtgtggggcatggacaagccagtggtccgggagtggggtgtagagaagactgtggtcaaggttatgaggaggcatgggagagggccaggaaataaccagggacttcccttcctgcaaggaggttcatgaaccagccctgcaccccacttgtggaacacaacatcgccccacagtgaggagagagaccgaggagaccaaggctgatcctgattcagacatctttccaccaggtcacccctcatcgatgatacatgctcagtccgggggtatcccccgcaaggaaacactggggctgaggagcccagagaggtcgcctgacctggactggggctggggaggtcagggaagtctccctggagaagagacagggtgccaaatgccaaaagaccaggaagggcaccaggcgaagatgaggagggaacagcatgagcggaggccaagaggccaaggtgggagcccagagaggggttaggagtgtgcaggcagaaggggccacctggaggagtgggagcaaggccttgaatgcaaagttcaatgacttgtactttagcttctgggcagtgaggaaccatacaaagttccacacagaaggtcagggtcaagtaagcgtttgcccaagctcttttcagaggtcacatggaagctagaatggaatggggtaggagacaaaaggaatgcaggcatgatatctggaggaactgtggaccagagcctttgcagatatgtcttctcttcaaccaaggagacggacagctccatgtctttattctaccaacacagcatcccctcagtggctcagcaagtgtgggacacgcactcacagcaagaaaagctgcattaaggtcttcagattctctttaacagcaggttctactggaggcaggtccttggccttcaggacagctgggagggcctcctggaagaggtcctcccgcactgcagcctccacgtgttgggcaccatgctgccaccgtgggtccgctttcaaagactcagcagccagcactgatgggctaggggaagacagagtcagcggaggggctgggcatagccaagtgtaaggcagcatgacctgctttaggggttctctgattggattttccctcctccaccatgtgtgtgatgggctaggatgtccccctccctggggacacttggaagcctcttaatatagctgcggtgaggggtttgtaaagccccattttatagatgaggacactgaggctcagaaggagaagtgactcacacagggtcccacagccagaaaagacaacatgagctgggatgtcagctcccttcccggatacaccactgcccagcgggccaccgcaccccatggcactctcatgcctcagctccgtgattgccaccaagccagccacagagatacggggcccagtaaggaaggcctggtcccgcaggaacttgtcctcgagcagctgcaggcatccgtccagctcagccaaagtggccgccaacatctcgggtggcactgactcgcccaggaacacagggattattatctggtgggccgacaggcagagagaggggtcagggtctgcccaaagcccatcctggttcccaccatcatcctatcatcaccagtccttgggatttctgctcacctctgctcacttctttccactcatagccaccagtagctctcatctcctactcaaacagggacagcctcccccttctccctgggtcctcacacaaggcaaccagtgggatccttctgtaatctcaatctgcccgtaccctctcttgcataaagccttccatggctccccactgccctcatgagaaaggcctcaacacaaagccagccttctccagtgcggtagccatcccctccccacttttcacctcacctcctactaccccccacttatcaaacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaaggcagacacagttaaggtgtggaaacctccttattgcccgatggatcctccagagaggcggtcccttactttcagcagggcgcgtgtctacctgtttcatgctgtctcacacacagggtgccacccctgtgctgggcactgggtaagtgctctgtacatattaattaggagtactcatttcaaaaatatgtgtgcctttgataaataaaaacagtatgtgcatgttgtgttggtgtgtgcttccttgattattactgaagttaaacatgttttcatccatgtattgaccatttctctttgtccttcaatgaaacctctgctgatttccttcgctcatttttttcctgtgtcttcgtctgatgagtttctcttctttttgtttgttcgtttgtttgttttgagacagtctcgctcagtggcccggctggagtgcagtggtatgatctcagctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtgagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttaaccccagccttccagtcaaggttcccaccagtttgggacacctgcaagtgtcacatcccactgggtgaaactctaagatcccttttaggggatcccattcgctccctcccttccgccaccatgcagcgccgagaaacagagctctgaacgaaccctcagatgtccgtgcgctggggcctttccaggacggcggcgcccagtcgtttctgggtcagggcgacgcctggaactgggcagggtccctggcaccgggatcccgaaaagcagacctgcttctccctgtccagccggttccccttccccttgcagtcggccccctgcatccgcgtcctccctgccagtcgagggtccccagctccaactccaccctcccagctgtgcgttcatagcgaccgccctccctgtagggacgcacggatctggtggtggagtcttggccggcaggactggacaggaaccgaaggggcgaggcgggtccgggggtggtgcgctccaattgggtgctgtccccagggggtggggcctgatcccctatttcccggcgcgccgggatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaaggtgggcccagcccgtttccccgcgtgtccacaaacccagtgcacccccaggcccccgccctgctctgccctgagcgtctcgccgcccgcacagccccctcacctcctcctgcagcgtctgccaccagagaatgctgtggactgagtggccttgaagggatcacagcctctctgaaccttagcttgccttctgaaaaggaggataacgttaccttctgctctgtagggatggaaagaaaatactgaatggagttgacagagttcttgcgtggaatgcacgcatataaattcacaaagcccagaagacctcgggaagaaggacatactgttgtgagaattaagagatgggaagagatgagccaccccagtttgcctcccctcccctggcccaccagagtccggctagaaaacttctctttatccacctgctgcacctggccccacccaccaaaaccccccagctgccccggaatgtggcagggcagggaggcccagccagggagtgaggctgatccaggcctctagtcccagaccttgctgtttctcagggctgtggggctccgcttggggaggaggagggagggtgtagaggtgcagcgtttttactctgaagaccttttctgacttcttcctcttcagggcagcacaagagcaaggagttcttgcagatcaacagcctggggaaactgccgacgctcaaggatggtgatttcatcttgaccgaaaggtgccctccttccctcacccctcaccgcatccggagcccatgtgaccttggctctccccactggccccgggccccagtggccctcccataccccatggggcagcgagggaggggaaaggcgagggatctggccgggcgcggtggctcacgcctgtcatcccggcacttcgggaggccaaggcgggcggatcacgaggtcaggagaccgagaccatcctggctaacaccgtgaaacaccgtctctactaaaaatggaaaaaaaagttaaccgggcgtggtggcgggcgcctgtagtcccagctactctggaggctgaggcaggagaatggtgtgaacccaggaggcggagcttgcagtgtgctgagatcgcgccactgcactccagcctgggcgacagagctagactccgtctcaaaaaggccgggcgcggtggctcacgcctgtaatcccagcactttgggaggccgaggtgggcggatcacgaggtcaggagatcgagaccatcctggctaacacggtgaaaccctgtctctactaaaaatacaaaacattagcagggcgtggtggcggccgcctgtagtcccagctactggggaggctgaggcaggagaatggcgtgaactcaggaggcggagcttgcaatgagcagaggtcgcgccactgcactccagcctgggtgacagagggagcccactccagcctgggcgacagagggagactccgtctcaaaaaaaaaggaaagaaagaaaggagaggtatctggggagaaggtacagcttggggtgtgtccgggatgagcaggggctgacagaacatgtccccccacctctcatcttcagccttttctgagccgcagggcctctccactcccagactgaagggtattagaagagaagacaagggaacatttttccactgttgcgcatttgttcaacaaatgctagctgaaaagagcctctagtgacttgtcgcagactacccaatctacccaggccgggcctagaggccaatgccatggcccaagggcacagctcatggtgaggtccagctgctgggcaggaaaaggacaagaggtcaggtggctgcagaggtgatggctgggggcctgtcagacgggggccaaagacattcctcccctcgtgatccctgacccaagcgcgtggacatgcaagggactccacggagcatccactgtgtgccagccccatgcagggttccaggggtccagggagcctattctgagctgcaccgcctcggacaagtcacttgaccattctgaccttgagttttctcttgtgctaaaaggctaacaggagtgtctacctcacagggcggctgctggcatatcacagagatgaggttctcaaaatgcaaagcagaaggtccagccaagagtcggtgcccaaggcaacaaagacaggaggagactcgtaggaggagggggtggtgttggggagctggagatggagggcgaggctggagggcagtccttcaaatgcagagaagcccccgggccccactggcagatgggagcagttaggggtaaatgcctggtgccagtgtccttatagccactgcccatttgttcccagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgaggagagccatctggagagtgattggccatcagggagtagttggcagtaggccggggccatagactgacccactctctgcccccatcaggtgttggggccactcattggggtccaggtgcccaaggagaaggtggaacgcaacaggactgccatggaccaggccctgcaatggctggaggacaagttcctgggggacaggcccttcctcgctggccagcaggtgacactggctgatctcatggccctggaggagctgatgcaggtgtgagctcagcctgtgggcagtgtccctcttcgtgtcacacccatgaggcagacagaaacactgaggactggagaaagccagaactttgcccagaatcatagagcaagtctctggatgatctggggccagaaccctgaacttctgcctcctgcctgggtgtggggtctcaccctggctgctcttgggctctaaggctgaacatactgcctgggcccctgtggtccattcacttaggggctggggaatggaccatgtctctgatacttctgcccatggttccagcattcgggtcggcagtgacaactgggaaagttgtatgcccacaactttttcatccttgtccctacagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaaccaagagttattggttttactacattgttgtgttatacatatggagtaaaagtatgtgctagtaatcctcatcatggttaataacaaagtaacctcacaataacgagtcaacataattgtatcaccagggcaacaaaatgttaagtaagtaaccaattcgaattgcaaactgttaaaggatataggcgatgtttcacagggcatagcaacggtctttgaagtctaggaaacttaaaagatttcttttaacaagcattcatgtcttctaggacagttttgtaataactgcaaatagtaagattatacattgtcacacagacctccatgtatatccatgggatggaccccaccacaatgattttaacggagagaacttgatataaagaattggtaaccaggcattagagaactccgaagacagagagaatccagattaacacggaggtaaacactgcaagaagctaccacccctagggctgggggatcaagggaggaattaggaagaccaagatgctggaggggccctgaagaattcaaacctccaagaaaggtgttgctcatcccccctagcatcaccttccaagaagggcaggtttccccagtttgccctgaggtcttcacaggaggccatgtggctgtggatgcagttctcaaatgtgacagtagatgtcactgctgaccaataaacaggatgttccagacacactctgcgctacctgcccacatgtcttgtggctttggggcctatttcccatgcctgacctgtgcccaccatgtgccactctattgggggacctgccccaataatcacgtagattgtttcctatttttcctaagtgtcggccggcttgagaaataaagggacagagtacaaaagagagaaattgtaaagctgtgcatccgggggagacgtcacacgttagtaggatctgtgatgccccacaagccacaaaaaccagcaagtttttattagggattttcaaaaggggagggagtgtgcaaataggtgtgagtgacagacatcaagtacttaacagggtaatagaatatcacaaggcaagtggaggcagggcgagatcacaggatcacaggaccgaggcaaaattaaaattgctaatgaagtttcgggcaccattgtcattgataacatcttatcaggagacagggttttgagaccaaccggtctcaccaaaatttattaggcgggaatttcctcttcctaataagcctgggagcactatgggagactggagtctatctcacctctgcagtctcgaccataagagagaggccacgcccggggggctgtttataagccgatacctccaggtgcgtattctctttctcagggacattccatgctgagaaaaagaattcagcgatatttctcccatttgcttttgaaagaagagaaatatggctgtgttctgcccggctcaccggtggtcagagtttaaggttatctctcttattccctgaacaattgctgttatcctcttcttttttcaaggtgctcagatttcatattgctcaaacacacatcctgtacaatttgtgcagttaatgcaattattaaagggtcctgaggcgacatacatcttcctcagctgacaggattaagagattaaagacaggtataggaaatcataagggtgttgattggggaagtgataagtgtccatgaaatctttacaatttatgtttagagattgcagtaaagacaggcataagaaactataatagtattaatttggggaactaataaatgtccataaaatcttcacactccacgttcttctgtcatggcttcagccggtccctctgtttggggtcactgacttcctgtaacaccactcctagccggaagtattccaagtaaccattgcaactgtcctgccttaagggtgcctggtgatggcttctgtcttaggtcccattctggctctctcttccagtgatttctcatactttgggggacactctggcctgctttcctgggccttttccattaccaccccctctccccatcaggcactggggatggcggccacagcctatgccttcttgatccatgctggctgccttgggattgttccttattggatggttttgctttcaacagacactccaataaagtacacgaaataaagaataaagttaaacagtcagtccccgtgctgtgtaggtggcagtaagtctgggagagcgacctcagctgaactaaccatgctgtgcatcattgtcaagcgggaccagcaggatccttaggtcacctggcaggaggaggggcagggaagggtccctagaagtgatcttgagttgcacttagtgctcttggcagagggaagggcttgggctagtgctggaggcatgaagatggggtgtgttcagggctctccagcagtccaggcatgggaaggggacgctgagggccaaaggctaaggtgacactgggaagggaaccatagcaaggtgaggaatggctttcggccatgtgactgaattgcctgtgtgtggtgcgtgtgtacgtgtgtgaatgtcagtgaactgtgtgtgtgaacgtgagtgaattgtgtaactttgtttatgtgtgggtgtatatgtgtgtgatgtgagtgaactgtgtgtatgtgggtgtatatgtgtgtgatgtgagtgaactgtgtgtatgtgggtgtatatgtgtgtggtgtgagtgaactgtgtgtaagtaggtgtatatgtgtgtgaatttgaatggtgtgtaaatgtgactgagcagtgtgaatttgtgtatgtgggtgtatgtgtgtgagtgaactgtgtgattttgttggtgtgaattgtgtgcctgtgtgtgtgaggtgtgtgtgtgtgtgtgactgaactgtgtgatgactttgtattaatgtcagtgaatggtgtggttgtgtatgtgggtgtatatgtgtgtgtatgtatgtgaattgtgtgtggggttggtgtgtatgtgtgtcaatgtgagtgagttgtgtgactgttgaatatgagtgaattatgtgattgtgtgggtgtatatgtgtgtacaggagttaactgtgtgactgtgtgtaaatgttatgattgtgtgtgtgggtgtatatgtgtgaatgtgatacatcgtgtgactgtgggtggacgtgggtggatgtgtgtgtgagtgtgcgtggctgtgtgtcgaacagtgtgtgagtgtaagtgtgcaggtggtagctgtggaattaaggcacattaggggaatccttccttggctctggtccttggtttccctcctatgaaacaagttgggtgaattaggcagtctctggcattccaggatttggtctcaggtctaaacaggattttgtaaagtgaaagcagcatcccttgggcatcccgggaggtgtccctgccctccatggctcaccttctgccacatggcccagcagcagctactctgcagggccatgtgctgccatgacaggtactgatccccatgggcgcgggcctgcaggtcctggaggtaccagtggtcaggtgctttgtacatgcagctcatatagagcaagctagccacactggggggacatggcaggggcagaagacatgccctgaacactcttcagccattttctggggcattttcactatccccatgatgcagaggagggatgtgaggctcagagaggttaggtaactgcccagggtcacacagccctacacggggccagattatcatctcaactaatggcagcaaggaagaaacaaaatgtcatgaacttcagcaggggctcagggaaggcttccaggaggaaggggcacccagtgtgagtctgaagaatgagagcaagttgggtatctccccaacatatccaaagcatggacagggccaggagcaaggccagcagggagagagccttccaggtgacatggcagcattgctccccaccccgtcccatctcctgttcacctatggtgaagggttgtgcagtctgacccccagagctcatcatgcctctatgggtgttggaccatccagtgatcccaggctctgaatgtgaatccagctccaccaaggaggcactatgtggcctcggtaaaggacgccaccatgcggccaccaacctggaggctggttttggctttcatttttcccacccacctccaacccttcagcacaccctgcagttagagtttcaagaaaagtcagaaccgaccatcaccccaccaaccctgcaccaccaccaccttggtctggggctccagcgctgcatgccagatgactgcagtggctttctcacccctgccagggggatcctttatgacgtaagtcagatcacagttctcctctgctcaaaatactccagcgactcaatccccctgcggtaagagccaaagccttcccagtgtcccatgctcccctctgtcgtgacctcctgctcttcctgctcactacacccaccctggcccgttgctctccagtctgaaccccatgcattgtcccacctggagccttcgccctcactcttccctccagccagaacacccttctcctcatgccttgcacattcctacagctctctgctcagatgccacttcctccagggagtcttccctcaacatcctactcacacacccccaatcttaccctgtttattttttccatggcatccatcaacatccgatatgttccatgtttacatgggttactgtcagctcccccttctattaatggaatgtgagatccatgaggagaaggacgtagacacgttcactgctcaagccccagggcttaaatggggtctggccctggtggatgtttagcaaatagccactgaagctcgctgagtggtccctcgactctccagggaaacagcacttgccccacaggatttgtgggcaaaatggtagcactaagatgcctggtacagccgctcctcgaaacttagcactctccttttttcggaggggaaggctggcggtgaggaggcccggaagcagactgggccctgtggccttgtgcaagtccctcccctcctccagcctcagtttcctcacttgtacaatgcaggaggggacttctataacccttgtcaacactgggcaccactgcctgcctccacccattcttcaccctggggctggtgcagggcccacagtccatgatccaagccatcaacagtgaacagacagccgactggccccacaaggcccggcagcagcccacggaccggttacctctcagccaaggtgaagtccccatccttcaaggcccggcaccttcctcagggggttcacctgggcaaaggcatcgctgtgctgctggcctgcaggagagatcagagaggtgagtggggataacccagagttctctgaggtctctgcccacccccaccccaaaatcccagcagcagctttctgaggcccctatctgggaggcatcagggaagaggaagcctctctgctagtcactgggtcacagaccttgaccccatcagagggccatctttcctgtgtccagctccttgaagcatggctcaaggacaattccctggagctgtaattcacaccccacccccagccagttccatccataggtcagacccctccagcctcctccctgggctctaggcttgccccctctgattcagcttcctatcccagctggggacttaggccctactggccaggctgggtgacctgtcaataccccagagtcccagccaaacatgttcccaaccctcagaccaacctcattcttgctgggaatccctgccccattcagccactcagcccccggtggctcagctcttcttcctttcttatgccaaactctcaaggctccctccccactgggggttcccaggtctgactcactttagcattctaggccagtgctagaggccgcattaggtgcctggtgtttggatcagaggacctcagtcaagccaggctccagtctgatcataggcctacatgtgggcctctttgcccttctactgaatggacatgcacacccctgcccattctccctccacagactgcttctgtgtccagcccctgttctgtagcaggtgactcaagctggttgtaccaagggcagcagttgggaagagtcagctgagcagggtcctccctctggcctgcccagggggctctggctctgctctctgccctactgcttagttatagccctgcctcctccactgaattgtgctccagctgcatctctgtatgccagccagaccagcaaacgctggagctcagggtgagggtgctggcctcccccactgccctgccacagggccctccagcctctagcctctaggagtagccccttcagctgggtgagaagccccatgggatagagcaagtcagatgcaggaaaaagaaaagacagaagaatgccaagaaatacataaaagtggaagagacccagggccagacatggtggtgcatgtctgtgatctcaacactttagaaggaggaggcaggaggatcacttgagctcaggagctcaaggtcagcctggtctacatggcaaaatcacgcgtctacacacaccaaaaaaaaaaaaaaaaaaagtagctgggcacggggacgtgcctgtagtcccaactattctacttaggaggagtaagttgggaggatcacttgatcctgagaggtcaaggctgcagtgagccgggatcatgccactgccctctagcctgggctgcagattgagacactgtaataaataaataaataaataaataaataaataaataaacaaacaataaaaaagtggaagagacacaggcaggggtagacagggactattttacttaggaaacaacgaggcagtttgttttttccaagcacatggggtgaagatattcttgccccactccatttccctaccctcgttctgtgcctgctgtgccctctctaaacctgtattttgaagaatgttttgtattcacaagcaaagatcaagcctctattaaaatagacaaccagtggggcatggcggctcatgcctgtaatcccaacactttgggaggccaaggcaagaggatcacttgagcccaggagttctaggccagcctcggaaacacagcaagacctcctctcaataataataataataataataaattggccaggcatgtcggtgggcacctgtagtcccagctacttgaggggctgaggcgggaggatcgcttaagcctggaaggtcgaggctgcagtgagccatgattgtgccactgcactccagcctgagtgacagagttagatgctgtctccaaaaagtaaaaataataacatagataattatgtaatagtttccacaccggagagtctgattcttcgtgttagtctgcattcttggcccgactgcaaagcagcggggacaggcagggattcgtggccaatatcccctgggcctgcctgcccagcccagctttggtcagctccactgtgcgaagctcgaaggggatgccattcttggcgaagatgtagactgaacggcagggctgggacagcagacccatggcgggggcaatggggtggggcgtcggagggcagacctaaacccaggggacgggccctggggacaaacccggggacaggcccgggaacaggaactgcgggcaggaatggctggttgggggcggcggacaggaacggctgggggtaggtgagggatgggcaggaactgctgggtcaccgagcctgcagcggtgcacctcaccaggagccccgagtccggccacgccctcttcactcatcccttggctcctagaactttgggtcaatcagtggcgtgtctgctctctcaccacccctttctgggaatctaggctgcaggtatatttcccactaaaagggaagaggagaggctgggcgcggtggctcacgcctgtaatcccagcactttgggagaccgaggggggtggatcacgaggtcaggagatcgagaccatactggctaaaacggtgaaacccgtctctactaaaaatacaaaaaattagccgggcggggtggcgggcgcctgtagtcccagctacttgggaggctggggcaggagaatggcgtgaacccgggaggcggagcttgcagtgagccgagctcacgccactgcactccagcctgggcgacagagccatactccgtctcaaaaaaaaaaaaaaaaaaaaggaagaggagaaaggaggtgcagcagcctccttgcccagtgcctgggcccagtgcccaggacggaggccagagaggaagggtggctgactgcctgcggggctgccagccccacacctcatgaaggaatgagctgtccctccccagttgctggggtcatatttgttacactctagctaacgcctccccgagatggctgaggccctgtgaggcctatccagaggtttccaacagtgcctggcattgcacagtaaattaatcaccatgacacgagttttgcaaaagagaaaagatttattcacagggcaccaagcaaggatgtgggatagtagctctcaaatccaccttcccgaaaataaggcttagggataagccttgcttccaagcagtagagcacaggccccagccacgctccagggtaggggaccatacaaggatgtgaatagcagtgtcggccttgtgggcctacaacgcagaagggccatgcacttggtttaaagctttgctgttgccatcttaacattcttaacaagttaaaaataagggtccccacattttcatttatagccagtcctgtccaaggagttcaaagatctcatgagggtggacagggcactgtctgctctgggcagtgatgggaccactaacagttgttctccagtctcccagcgcctaccccagggacacaccttcccctggtctctactattctttttttttttcgagacagggtcttgctgttgcccaggctggaatgagtgcagtggtacaaacttagcttactgcagcctcgacctgggctcaaacaatccttctgcctcaccctcccatgtagctcagaccacatgcgcatgccaccaatctgggctaattttttgactttgtagagacggggtcgcactttgtttcccagggtgctcttgaattccttggctcaagtgatcctcccacctcagcctcccaaagtgctgggattataggtgtgatccaccacccctggcctctctcacattcttgacatttaaagttaccatcattgacaaggaacatgggtacactccaatttactcaagaaaaagctcttttctccattgaagacatatgtggcctagctgcttcatattctagttgaggtcttcttgttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagtagcagccttgcctgggagcttgttagaaatatactaacaggctcccacccccaaacccagacctactgaatcagacagagtttattttcataagatcctcaggtgatccaaatgcaccttaaactttgaggagctttgattcagaacctgggctggaggcccctaggggccaccttgttcctcacagactgcaaggtatgtttttttcttgcctcttctctctgtcccaatgtctccttctctctgtgtctgaccctgaggaccctgtgacatcctcccaggggagtttccactgccaaaggcctgattctctagaaactgatgggctcctctagacaccaatctctacctgggctcttgttgaagaagccaatcagctcattggttggcgatcacgtgatatacaacatggctgccttccaagccttatgtgtggacaaggagatagggacaagtaggcatatcatgttctgctacctggtccatcgtctctcctcaggcccccaggatacacgtttatggggagttttcctcccttcccccaatatggtcactcataactttacacccaacagtcaaacaggggtggaagctacagggtttcatgtaaacaataggctaggctgtggggctgagtaaaaggcactggactgtggtaggtcttactccaagatggccaaatggaagggcttttagctttctttgtttttgttttatattttgagatataatgttcaaatttacacttcagaataaaaaagagccacaatttatgcttcatattttttgtagcttcttccctatgcttttgaacaatgtaatcatattttcattatcagatataattcccataccataatatccaccctttcaaagtatactttaaaattcaattggtttaaagccaattcagtggtttttagtatattaacaaagttttgtcaccatcacagttatctaattctagatcattttcatcacccaaaaagaaactctgtacccaataaagagtcactccccattcccctcttcccctagcccctggttaccattcatctactttctacctctgtggataggaagtagctgcctattctggagatttcattcaaatgtaataatgaaatatgtggccttttatgactggcttctttcatttagcataatggtgtcaaggttcatccatgttgtagcatataacggtacttcatcccttcttatggctgaataatattcaattttatggactttttagcaaaacattctaatttttacttctctactgtgcttattgtttgtctttctccacaacaatgtgagcactaaaggcagacatttttgcctattttgttcactactgctttttctgcaccaaacgcattgcctggttgtgggtacttttctagttttaggaaggagaagacaagatataggtcctgactctggttctgcctctcattcatatgctacccttccccttgaagaacttgtttcttcatctacaaaatgggcataatactactactcatcagggtggttgtgaggattaaacaaggtaagagatgtaaaattgcatgttagttatcagatagatttgtgttcccatctagctccaatgagggagaggatttgctctagtctgtccctctgggctctgggcttctaatgggcagacagcttcctccatgatgtttgtagctgttaaggctggcgtagtccctcaagacaagttttttttttgtttgtttgttttttttttgagtcagagtatcgctctgtcaccaggctggagtacagtggtgcgatcttggctcactgcaatctctgcttcccggattcaagcgattctcctgcctcagcctcctgagtagctgggattacaggcatacgccaccacacccagctaattttaagacaagcttttggaattgaactgctgatggtcttccatgaacaattcaacagaaacccagtagcgtacacttccttgtatgcacttgcaccctctctttacatttatta

SEQ ID NO: 515 - DNA, 77301 bp, Homo sapiens
ataaaaaagtcatgaccgtccctatcttgccaatctgccaggactccaaggggaaaaagcggataagtatccttcaggagacagagaaaaagatatcatcagctccttggctaataccacatcttgcaagacccctgccaggtactcccactgtgggtactcaggacagcctgcctcagtccaccaggcattttgcaaacctgctcatcccaataatgattttccccaacccccagcagggcagtgggacactcaggtgtgggaggtagccgcacatcatgacccagctaggacagacacacaatacagtagcctcggtgtgtgtgccgtacactctatcatctccatcagtttgtgtactgaggggtaccctgcctcctaattgcaggctccctaagggcacagtacctcagccacctgttttctcaaaggctgagcacagggtgaccccccaccccaccaaccccgccactaatgtctgggccataagtgaacatgcccctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatgcaattatcaattttttttcctctaatatttcaatccatggttgtttgaatcaacagatgcgtaacccagtgatacagggggctgactgtattattcctctgtagcttgagggaggacccagcaggatcagccattcctcatcgaccttcatggactaacaaaggctccatttcagaaggtctttttttgtgagccaaggtctcactgtcacacaggatggagtgcaatgcgcaatcatagctcactgcagcctcaacctcctgggctgaaaccatcctcccacttcagcctgccaactaagtgagactacatgtgcacaccaccatgtccggttaatttttaaaactgttttgggggatggcatctcactatgttacccagactggtctacaactcctgggtcaaatgaacctcccgccttggtctcccaaagtgctgggattacaggcatgagccaccgtgcctggacagtgtcctttcaagcttctcatgcccttacttcctcctagacatggatgtggctcaagaatatcttttacccaagaggaaactttaactcggtcacagaacgccaggtttgggttgcagacgcttcttgtgggggagggaggtcttttcccctgtattcacagaagaggaggttgccaactggagatggttcatttccaagtttgtctggggtcccccagctatgcaggacccagaaagcagatgtctagacatccaggccaatggtctttcactactctgtgagtctcccgtgaacttcacctggaacctggctgggacacaggtccaaaatacgtaacttcagaacatacccagaattccttctgaccagcctggaaaagttctagaaaatcacacttcagccacgtgtacctaccctgtcaggtgccaaggcaggtacagcacacagacaatcccacatgacccttgcactgccccgggggtgttaaaagagagccttcccggttcacagacttacacactgaggagcagagccagaaattcattcaatcctgctcgcactttgaagatggtcctaacagcaggaacctaaggggtcagggggccccaaagctccagaccctgatgtgtccttactgggcagggcaagaaatgggtttttccccctgaggcaggatcagtggctccagtctgcggcagtcccacatggatcccctactacccctacgcaccggtcctggcccagggctagctccttggtgagaaactcaaagaagtgggcgctgtggctgcggttgtcctcggcggtgcccactacgccgatggaggagatggacagctgcgcgcagggctcggtggacccgctcagcgccatggccaggcccggccgtaccgtcacgttcacgcgctgagggggacatgaaaagttttgcccgaagttggagccggccgggctacctctggggacgggacccgagcgcgcgaaagccgaaacgcgcagtgttcgcggggcagggatcccgatacgggccgcggtccctgaaggtcacgcccgggtcatgactggggagggcgacaagggaaagacgtgcggagggggagccgcgggatcgtggagcacggaaagtcagagcttggcgtgaggaaaggagtggggagtggtccctggggaaaagattcggggtcactgtcggggaggcggagcagggacagggccggacccctggcccaccaacctcccctcgccccgtgctgcccggcccacgcttacgtccgcaggtttgcccaggatggaggcagcggcggcgcagagtcgtttctccagccccgcgggcactcggttggcgggcaaattcgtgtccagctccaggaacggcatggcgggcagaggaacggaaacagctctggcggaagaaaagctgggggtacccaaggctcgcggaccagggaggaggggcgaggcgccacagcaacctggcttctcattggctggacagagactcggcgctccccgattggctgcctagggtacctcccgcttctgcaaacaaaagtcacgtgtgccggctgatttccggaagtcccatcgtctccgccctacgtgtagccccacccactacaggtctttaacccggtagtggacccaccctgtctcccccgaccctcctgcctggcgccaggtgggtttccctctcaagcttccgcgctgtggtcgcccggttcctagccctattagaggtctgaacaccacacccccgacacacaaggacacacacacacctataggggtcttccccaggctcgaccctaataaccaatacaacgggagcttaaagtttttttgaatgatttgccaccatttcgaagtcaggcaatttcatgttcagtatggaaatctgcgcttgggcagtcaggagatgtggttactcgcgggggcgcgggtagggctaggctcacgacaatacctgtccctgcctggtccccattgacatctgcctgtgtagcctcttgtgccggtggtgagccactgtccaccagggggtggcaaaatatgttctttaaaacatggaaaggccgggcacggtagctcacgcctgtaatcccagcactttgcgaggtccaggcgggcggatcacctgaggtcaggagtttgagaccagcctggccaacatgacgaaaccccgtctctactaaagatacaaaaattagccgggcgtggtggcagacgttgtaatcccagctgctcgggaggctgaggcaggagaatcgcttgaaccggggaggtggaggttgcagtgagccgagatcgcgccattgcactccagcctgggtgacagagcgagactccatctcgaaaaaacatcagaaaacatggaactctgttggcgtggcttaaacatgagtgtggtcagtgtggcaaaatcacttgaattgtacattacaaatatgactgaagttgtggtcgagcaatgtggctcacacctgtaatctcagcactttgggaggctaagaagggaggattgcttgagcccaggagttaaagatcaggctaggcaacatagcaagattctcttctttattttctacaaaaaaaaaaaaaaaaaagaaagaaatctgggtgctgtggtgtgtgcctgtagtcctagctacctgggcggctgaggcaggaggattgcttgagcgcaggagatctaggctgcagggagctatgactgtgccactgcactccaccctagatgacagagtgagacccaggctcccccctcccccacaaaaaagaaagaaaaaatttgcaagtttatatgtacaatttcaactacgtgtataaaattctctataagtgtgcatacttaaaggagcctccactgaaaggccgacagagtctctgtctgtcatgatcttgtcctattagcagtttgtttattagatgactcagatatcagaaggtctgagacacacgacaggtaaatatgacagtcctaaggggagagggcagggacaggtggcaagtctgggaccaggtgtggggcatggacaagccagtggtccgggagtggggtgtagagaagactgtggtcaaggttatgaggaggcatgggagagggccaggaaataaccagggacttcccttcctgcaaggaggttcatgaaccagccctgcaccccacttgtggaacacaacatcgccccacagtgaggagagagaccgaggagaccaaggctgatcctgattcagacatctttccaccaggtcacccctcatcgatgatacatgctcagtccgggggtatcccccgcaaggaaacactggggctgaggagcccagagaggtcgcctgacctggactggggctggggaggtcagggaagtctccctggagaagagacagggtgccaaatgccaaaagaccaggaagggcaccaggcgaagatgaggagggaacagcatgagcggaggccaagaggccaaggtgggagcccagagaggggttaggagtgtgcaggcagaaggggccacctggaggagtgggagcaaggccttgaatgcaaagttcaatgacttgtactttagcttctgggcagtgaggaaccatacaaagttccacacagaaggtcagggtcaagtaagcgtttgcccaagctcttttcagaggtcacatggaagctagaatggaatggggtaggagacaaaaggaatgcaggcatgatatctggaggaactgtggaccagagcctttgcagatatgtcttctcttcaaccaaggagacggacagctccatgtctttattctaccaacacagcatcccctcagtggctcagcaagtgtgggacacgcactcacagcaagaaaagctgcattaaggtcttcagattctctttaacagcaggttctactggaggcaggtccttggccttcaggacagctgggagggcctcctggaagaggtcctcccgcactgcagcctccacgtgttgggcaccatgctgccaccgtgggtccgctttcaaagactcagcagccagcactgatgggctaggggaagacagagtcagcggaggggctgggcatagccaagtgtaaggcagcatgacctgctttaggggttctctgattggattttccctcctccaccatgtgtgtgatgggctaggatgtccccctccctggggacacttggaagcctcttaatatagctgcggtgaggggtttgtaaagccccattttatagatgaggacactgaggctcagaaggagaagtgactcacacagggtcccacagccagaaaagacaacatgagctgggatgtcagctcccttcccggatacaccactgcccagcgggccaccgcaccccatggcactctcatgcctcagctccgtgattgccaccaagccagccacagagatacggggcccagtaaggaaggcctggtcccgcaggaacttgtcctcgagcagctgcaggcatccgtccagctcagccaaagtggccgccaacatctcgggtggcactgactcgcccaggaacacagggattattatctggtgggccgacaggcagagagaggggtcagggtctgcccaaagcccatcctggttcccaccatcatcctatcatcaccagtccttgggatttctgctcacctctgctcacttctttccactcatagccaccagtagctctcatctcctactcaaacagggacagcctcccccttctccctgggtcctcacacaaggcaaccagtgggatccttctgtaatctcaatctgcccgtaccctctcttgcataaagccttccatggctccccactgccctcatgagaaaggcctcaacacaaagccagccttctccagtgcggtagccatcccctccccacttttcacctcacctcctactaccccccacttatcaaacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaaggcagacacagttaaggtgtggaaacctccttattgcccgatggatcctccagagaggcggtcccttactttcagcagggcgcgtgtctacctgtttcatgctgtctcacacacagggtgccacccctgtgctgggcactgggtaagtgctctgtacatattaattaggagtactcatttcaaaaatatgtgtgcctttgataaataaaaacagtatgtgcatgttgtgttggtgtgtgcttccttgattattactgaagttaaacatgttttcatccatgtattgaccatttctctttgtccttcaatgaaacctctgctgatttccttcgctcatttttttcctgtgtcttcgtctgatgagtttctcttctttttgtttgttcgtttgtttgttttgagacagtctcgctcagtggcccggctggagtgcagtggtatgatctcagctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtgagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttaaccccagccttccagtcaaggttcccaccagtttgggacacctgcaagtgtcacatcccactgggtgaaactctaagatcccttttaggggatcccattcgctccctcccttccgccaccatgcagcgccgagaaacagagctctgaacgaaccctcagatgtccgtgcgctggggcctttccaggacggcggcgcccagtcgtttctgggtcagggcgacgcctggaactgggcagggtccctggcaccgggatcccgaaaagcagacctgcttctccctgtccagccggttccccttccccttgcagtcggccccctgcatccgcgtcctccctgccagtcgagggtccccagctccaactccaccctcccagctgtgcgttcatagcgaccgccctccctgtagggacgcacggatctggtggtggagtcttggccggcaggactggacaggaaccgaaggggcgaggcgggtccgggggtggtgcgctccaattgggtgctgtccccagggggtggggcctgatcccctatttcccggcgcgccgggatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaaggtgggcccagcccgtttccccgcgtgtccacaaacccagtgcacccccaggcccccgccctgctctgccctgagcgtctcgccgcccgcacagccccctcacctcctcctgcagcgtctgccaccagagaatgctgtggactgagtggccttgaagggatcacagcctctctgaaccttagcttgccttctgaaaaggaggataacgttaccttctgctctgtagggatggaaagaaaatactgaatggagttgacagagttcttgcgtggaatgcacgcatataaattcacaaagcccagaagacctcgggaagaaggacatactgttgtgagaattaagagatgggaagagatgagccaccccagtttgcctcccctcccctggcccaccagagtccggctagaaaacttctctttatccacctgctgcacctggccccacccaccaaaaccccccagctgccccggaatgtggcagggcagggaggcccagccagggagtgaggctgatccaggcctctagtcccagaccttgctgtttctcagggctgtggggctccgcttggggaggaggagggagggtgtagaggtgcagcgtttttactctgaagaccttttctgacttcttcctcttcagggcagcacaagagcaaggagttcttgcagatcaacagcctggggaaactgccgacgctcaaggatggtgatttcatcttgaccgaaaggtgccctccttccctcacccctcaccgcatccggagcccatgtgaccttggctctccccactggccccgggccccagtggccctcccataccccatggggcagcgagggaggggaaaggcgagggatctggccgggcgcggtggctcacgcctgtcatcccggcacttcgggaggccaaggcgggcggatcacgaggtcaggagaccgagaccatcctggctaacaccgtgaaacaccgtctctactaaaaatggaaaaaaaagttaaccgggcgtggtggcgggcgcctgtagtcccagctactctggaggctgaggcaggagaatggtgtgaacccaggaggcggagcttgcagtgtgctgagatcgcgccactgcactccagcctgggcgacagagctagactccgtctcaaaaaggccgggcgcggtggctcacgcctgtaatcccagcactttgggaggccgaggtgggcggatcacgaggtcaggagatcgagaccatcctggctaacacggtgaaaccctgtctctactaaaaatacaaaacattagcagggcgtggtggcggccgcctgtagtcccagctactggggaggctgaggcaggagaatggcgtgaactcaggaggcggagcttgcaatgagcagaggtcgcgccactgcactccagcctgggtgacagagggagcccactccagcctgggcgacagagggagactccgtctcaaaaaaaaaggaaagaaagaaaggagaggtatctggggagaaggtacagcttggggtgtgtccgggatgagcaggggctgacagaacatgtccccccacctctcatcttcagccttttctgagccgcagggcctctccactcccagactgaagggtattagaagagaagacaagggaacatttttccactgttgcgcatttgttcaacaaatgctagctgaaaagagcctctagtgacttgtcgcagactacccaatctacccaggccgggcctagaggccaatgccatggcccaagggcacagctcatggtgaggtccagctgctgggcaggaaaaggacaagaggtcaggtggctgcagaggtgatggctgggggcctgtcagacgggggccaaagacattcctcccctcgtgatccctgacccaagcgcgtggacatgcaagggactccacggagcatccactgtgtgccagccccatgcagggttccaggggtccagggagcctattctgagctgcaccgcctcggacaagtcacttgaccattctgaccttgagttttctcttgtgctaaaaggctaacaggagtgtctacctcacagggcggctgctggcatatcacagagatgaggttctcaaaatgcaaagcagaaggtccagccaagagtcggtgcccaaggcaacaaagacaggaggagactcgtaggaggagggggtggtgttggggagctggagatggagggcgaggctggagggcagtccttcaaatgcagagaagcccccgggccccactggcagatgggagcagttaggggtaaatgcctggtgccagtgtccttatagccactgcccatttgttcccagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgaggagagccatctggagagtgattggccatcagggagtagttggcagtaggccggggccatagactgacccactctctgcccccatcaggtgttggggccactcattggggtccaggtgcccaaggagaaggtggaacgcaacaggactgccatggaccaggccctgcaatggctggaggacaagttcctgggggacaggcccttcctcgctggccagcaggtgacactggctgatctcatggccctggaggagctgatgcaggtgtgagctcagcctgtgggcagtgtccctcttcgtgtcacacccatgaggcagacagaaacactgaggactggagaaagccagaactttgcccagaatcatagagcaagtctctggatgatctggggccagaaccctgaacttctgcctcctgcctgggtgtggggtctcaccctggctgctcttgggctctaaggctgaacatactgcctgggcccctgtggtccattcacttaggggctggggaatggaccatgtctctgatacttctgcccatggttccagcattcgggtcggcagtgacaactgggaaagttgtatgcccacaactttttcatccttgtccctacagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaaccaagagttattggttttactacattgttgtgttatacatatggagtaaaagtatgtgctagtaatcctcatcatggttaataacaaagtaacctcacaataacgagtcaacataattgtatcaccagggcaacaaaatgttaagtaagtaaccaattcgaattgcaaactgttaaaggatataggcgatgtttcacagggcatagcaacggtctttgaagtctaggaaacttaaaagatttcttttaacaagcattcatgtcttctaggacagttttgtaataactgcaaatagtaagattatacattgtcacacagacctccatgtatatccatgggatggaccccaccacaatgattttaacggagagaacttgatataaagaattggtaaccaggcattagagaactccgaagacagagagaatccagattaacacggaggtaaacactgcaagaagctaccacccctagggctgggggatcaagggaggaattaggaagaccaagatgctggaggggccctgaagaattcaaacctccaagaaaggtgttgctcatcccccctagcatcaccttccaagaagggcaggtttccccagtttgccctgaggtcttcacaggaggccatgtggctgtggatgcagttctcaaatgtgacagtagatgtcactgctgaccaataaacaggatgttccagacacactctgcgctacctgcccacatgtcttgtggctttggggcctatttcccatgcctgacctgtgcccaccatgtgccactctattgggggacctgccccaataatcacgtagattgtttcctatttttcctaagtgtcggccggcttgagaaataaagggacagagtacaaaagagagaaattgtaaagctgtgcatccgggggagacgtcacacgttagtaggatctgtgatgccccacaagccacaaaaaccagcaagtttttattagggattttcaaaaggggagggagtgtgcaaataggtgtgagtgacagacatcaagtacttaacagggtaatagaatatcacaaggcaagtggaggcagggcgagatcacaggatcacaggaccgaggcaaaattaaaattgctaatgaagtttcgggcaccattgtcattgataacatcttatcaggagacagggttttgagaccaaccggtctcaccaaaatttattaggcgggaatttcctcttcctaataagcctgggagcactatgggagactggagtctatctcacctctgcagtctcgaccataagagagaggccacgcccggggggctgtttataagccgatacctccaggtgcgtattctctttctcagggacattccatgctgagaaaaagaattcagcgatatttctcccatttgcttttgaaagaagagaaatatggctgtgttctgcccggctcaccggtggtcagagtttaaggttatctctcttattccctgaacaattgctgttatcctcttcttttttcaaggtgctcagatttcatattgctcaaacacacatcctgtacaatttgtgcagttaatgcaattattaaagggtcctgaggcgacatacatcttcctcagctgacaggattaagagattaaagacaggtataggaaatcataagggtgttgattggggaagtgataagtgtccatgaaatctttacaatttatgtttagagattgcagtaaagacaggcataagaaactataatagtattaatttggggaactaataaatgtccataaaatcttcacactccacgttcttctgtcatggcttcagccggtccctctgtttggggtcactgacttcctgtaacaccactcctagccggaagtattccaagtaaccattgcaactgtcctgccttaagggtgcctggtgatggcttctgtcttaggtcccattctggctctctcttccagtgatttctcatactttgggggacactctggcctgctttcctgggccttttccattaccaccccctctccccatcaggcactggggatggcggccacagcctatgccttcttgatccatgctggctgccttgggattgttccttattggatggttttgctttcaacagacactccaataaagtacacgaaataaagaataaagttaaacagtcagtccccgtgctgtgtaggtggcagtaagtctgggagagcgacctcagctgaactaaccatgctgtgcatcattgtcaagcgggaccagcaggatccttaggtcacctggcaggaggaggggcagggaagggtccctagaagtgatcttgagttgcacttagtgctcttggcagagggaagggcttgggctagtgctggaggcatgaagatggggtgtgttcagggctctccagcagtccaggcatgggaaggggacgctgagggccaaaggctaaggtgacactgggaagggaaccatagcaaggtgaggaatggctttcggccatgtgactgaattgcctgtgtgtggtgcgtgtgtacgtgtgtgaatgtcagtgaactgtgtgtgtgaacgtgagtgaattgtgtaactttgtttatgtgtgggtgtatatgtgtgtgatgtgagtgaactgtgtgtatgtgggtgtatatgtgtgtgatgtgagtgaactgtgtgtatgtgggtgtatatgtgtgtggtgtgagtgaactgtgtgtaagtaggtgtatatgtgtgtgaatttgaatggtgtgtaaatgtgactgagcagtgtgaatttgtgtatgtgggtgtatgtgtgtgagtgaactgtgtgattttgttggtgtgaattgtgtgcctgtgtgtgtgaggtgtgtgtgtgtgtgtgactgaactgtgtgatgactttgtattaatgtcagtgaatggtgtggttgtgtatgtgggtgtatatgtgtgtgtatgtatgtgaattgtgtgtggggttggtgtgtatgtgtgtcaatgtgagtgagttgtgtgactgttgaatatgagtgaattatgtgattgtgtgggtgtatatgtgtgtacaggagttaactgtgtgactgtgtgtaaatgttatgattgtgtgtgtgggtgtatatgtgtgaatgtgatacatcgtgtgactgtgggtggacgtgggtggatgtgtgtgtgagtgtgcgtggctgtgtgtcgaacagtgtgtgagtgtaagtgtgcaggtggtagctgtggaattaaggcacattaggggaatccttccttggctctggtccttggtttccctcctatgaaacaagttgggtgaattaggcagtctctggcattccaggatttggtctcaggtctaaacaggattttgtaaagtgaaagcagcatcccttgggcatcccgggaggtgtccctgccctccatggctcaccttctgccacatggcccagcagcagctactctgcagggccatgtgctgccatgacaggtactgatccccatgggcgcgggcctgcaggtcctggaggtaccagtggtcaggtgctttgtacatgcagctcatatagagcaagctagccacactggggggacatggcaggggcagaagacatgccctgaacactcttcagccattttctggggcattttcactatccccatgatgcagaggagggatgtgaggctcagagaggttaggtaactgcccagggtcacacagccctacacggggccagattatcatctcaactaatggcagcaaggaagaaacaaaatgtcatgaacttcagcaggggctcagggaaggcttccaggaggaaggggcacccagtgtgagtctgaagaatgagagcaagttgggtatctccccaacatatccaaagcatggacagggccaggagcaaggccagcagggagagagccttccaggtgacatggcagcattgctccccaccccgtcccatctcctgttcacctatggtgaagggttgtgcagtctgacccccagagctcatcatgcctctatgggtgttggaccatccagtgatcccaggctctgaatgtgaatccagctccaccaaggaggcactatgtggcctcggtaaaggacgccaccatgcggccaccaacctggaggctggttttggctttcatttttcccacccacctccaacccttcagcacaccctgcagttagagtttcaagaaaagtcagaaccgaccatcaccccaccaaccctgcaccaccaccaccttggtctggggctccagcgctgcatgccagatgactgcagtggctttctcacccctgccagggggatcctttatgacgtaagtcagatcacagttctcctctgctcaaaatactccagcgactcaatccccctgcggtaagagccaaagccttcccagtgtcccatgctcccctctgtcgtgacctcctgctcttcctgctcactacacccaccctggcccgttgctctccagtctgaaccccatgcattgtcccacctggagccttcgccctcactcttccctccagccagaacacccttctcctcatgccttgcacattcctacagctctctgctcagatgccacttcctccagggagtcttccctcaacatcctactcacacacccccaatcttaccctgtttattttttccatggcatccatcaacatccgatatgttccatgtttacatgggttactgtcagctcccccttctattaatggaatgtgagatccatgaggagaaggacgtagacacgttcactgctcaagccccagggcttaaatggggtctggccctggtggatgtttagcaaatagccactgaagctcgctgagtggtccctcgactctccagggaaacagcacttgccccacaggatttgtgggcaaaatggtagcactaagatgcctggtacagccgctcctcgaaacttagcactctccttttttcggaggggaaggctggcggtgaggaggcccggaagcagactgggccctgtggccttgtgcaagtccctcccctcctccagcctcagtttcctcacttgtacaatgcaggaggggacttctataacccttgtcaacactgggcaccactgcctgcctccacccattcttcaccctggggctggtgcagggcccacagtccatgatccaagccatcaacagtgaacagacagccgactggccccacaaggcccggcagcagcccacggaccggttacctctcagccaaggtgaagtccccatccttcaaggcccggcaccttcctcagggggttcacctgggcaaaggcatcgctgtgctgctggcctgcaggagagatcagagaggtgagtggggataacccagagttctctgaggtctctgcccacccccaccccaaaatcccagcagcagctttctgaggcccctatctgggaggcatcagggaagaggaagcctctctgctagtcactgggtcacagaccttgaccccatcagagggccatctttcctgtgtccagctccttgaagcatggctcaaggacaattccctggagctgtaattcacaccccacccccagccagttccatccataggtcagacccctccagcctcctccctgggctctaggcttgccccctctgattcagcttcctatcccagctggggacttaggccctactggccaggctgggtgacctgtcaataccccagagtcccagccaaacatgttcccaaccctcagaccaacctcattcttgctgggaatccctgccccattcagccactcagcccccggtggctcagctcttcttcctttcttatgccaaactctcaaggctccctccccactgggggttcccaggtctgactcactttagcattctaggccagtgctagaggccgcattaggtgcctggtgtttggatcagaggacctcagtcaagccaggctccagtctgatcataggcctacatgtgggcctctttgcccttctactgaatggacatgcacacccctgcccattctccctccacagactgcttctgtgtccagcccctgttctgtagcaggtgactcaagctggttgtaccaagggcagcagttgggaagagtcagctgagcagggtcctccctctggcctgcccagggggctctggctctgctctctgccctactgcttagttatagccctgcctcctccactgaattgtgctccagctgcatctctgtatgccagccagaccagcaaacgctggagctcagggtgagggtgctggcctcccccactgccctgccacagggccctccagcctctagcctctaggagtagccccttcagctgggtgagaagccccatgggatagagcaagtcagatgcaggaaaaagaaaagacagaagaatgccaagaaatacataaaagtggaagagacccagggccagacatggtggtgcatgtctgtgatctcaacactttagaaggaggaggcaggaggatcacttgagctcaggagctcaaggtcagcctggtctacatggcaaaatcacgcgtctacacacaccaaaaaaaaaaaaaaaaaaagtagctgggcacggggacgtgcctgtagtcccaactattctacttaggaggagtaagttgggaggatcacttgatcctgagaggtcaaggctgcagtgagccgggatcatgccactgccctctagcctgggctgcagattgagacactgtaataaataaataaataaataaataaataaataaataaacaaacaataaaaaagtggaagagacacaggcaggggtagacagggactattttacttaggaaacaacgaggcagtttgttttttccaagcacatggggtgaagatattcttgccccactccatttccctaccctcgttctgtgcctgctgtgccctctctaaacctgtattttgaagaatgttttgtattcacaagcaaagatcaagcctctattaaaatagacaaccagtggggcatggcggctcatgcctgtaatcccaacactttgggaggccaaggcaagaggatcacttgagcccaggagttctaggccagcctcggaaacacagcaagacctcctctcaataataataataataataataaattggccaggcatgtcggtgggcacctgtagtcccagctacttgaggggctgaggcgggaggatcgcttaagcctggaaggtcgaggctgcagtgagccatgattgtgccactgcactccagcctgagtgacagagttagatgctgtctccaaaaagtaaaaataataacatagataattatgtaatagtttccacaccggagagtctgattcttcgtgttagtctgcattcttggcccgactgcaaagcagcggggacaggcagggattcgtggccaatatcccctgggcctgcctgcccagcccagctttggtcagctccactgtgcgaagctcgaaggggatgccattcttggcgaagatgtagactgaacggcagggctgggacagcagacccatggcgggggcaatggggtggggcgtcggagggcagacctaaacccaggggacgggccctggggacaaacccggggacaggcccgggaacaggaactgcgggcaggaatggctggttgggggcggcggacaggaacggctgggggtaggtgagggatgggcaggaactgctgggtcaccgagcctgcagcggtgcacctcaccaggagccccgagtccggccacgccctcttcactcatcccttggctcctagaactttgggtcaatcagtggcgtgtctgctctctcaccacccctttctgggaatctaggctgcaggtatatttcccactaaaagggaagaggagaggctgggcgcggtggctcacgcctgtaatcccagcactttgggagaccgaggggggtggatcacgaggtcaggagatcgagaccatactggctaaaacggtgaaacccgtctctactaaaaatacaaaaaattagccgggcggggtggcgggcgcctgtagtcccagctacttgggaggctggggcaggagaatggcgtgaacccgggaggcggagcttgcagtgagccgagctcacgccactgcactccagcctgggcgacagagccatactccgtctcaaaaaaaaaaaaaaaaaaaaggaagaggagaaaggaggtgcagcagcctccttgcccagtgcctgggcccagtgcccaggacggaggccagagaggaagggtggctgactgcctgcggggctgccagccccacacctcatgaaggaatgagctgtccctccccagttgctggggtcatatttgttacactctagctaacgcctccccgagatggctgaggccctgtgaggcctatccagaggtttccaacagtgcctggcattgcacagtaaattaatcaccatgacacgagttttgcaaaagagaaaagatttattcacagggcaccaagcaaggatgtgggatagtagctctcaaatccaccttcccgaaaataaggcttagggataagccttgcttccaagcagtagagcacaggccccagccacgctccagggtaggggaccatacaaggatgtgaatagcagtgtcggccttgtgggcctacaacgcagaagggccatgcacttggtttaaagctttgctgttgccatcttaacattcttaacaagttaaaaataagggtccccacattttcatttatagccagtcctgtccaaggagttcaaagatctcatgagggtggacagggcactgtctgctctgggcagtgatgggaccactaacagttgttctccagtctcccagcgcctaccccagggacacaccttcccctggtctctactattctttttttttttcgagacagggtcttgctgttgcccaggctggaatgagtgcagtggtacaaacttagcttactgcagcctcgacctgggctcaaacaatccttctgcctcaccctcccatgtagctcagaccacatgcgcatgccaccaatctgggctaattttttgactttgtagagacggggtcgcactttgtttcccagggtgctcttgaattccttggctcaagtgatcctcccacctcagcctcccaaagtgctgggattataggtgtgatccaccacccctggcctctctcacattcttgacatttaaagttaccatcattgacaaggaacatgggtacactccaatttactcaagaaaaagctcttttctccattgaagacatatgtggcctagctgcttcatattctagttgaggtcttcttgttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagtagcagccttgcctgggagcttgttagaaatatactaacaggctcccacccccaaacccagacctactgaatcagacagagtttattttcataagatcctcaggtgatccaaatgcaccttaaactttgaggagctttgattcagaacctgggctggaggcccctaggggccaccttgttcctcacagactgcaaggtatgtttttttcttgcctcttctctctgtcccaatgtctccttctctctgtgtctgaccctgaggaccctgtgacatcctcccaggggagtttccactgccaaaggcctgattctctagaaactgatgggctcctctagacaccaatctctacctgggctcttgttgaagaagccaatcagctcattggttggcgatcacgtgatatacaacatggctgccttccaagccttatgtgtggacaaggagatagggacaagtaggcatatcatgttctgctacctggtccatcgtctctcctcaggcccccaggatacacgtttatggggagttttcctcccttcccccaatatggtcactcataactttacacccaacagtcaaacaggggtggaagctacagggtttcatgtaaacaataggctaggctgtggggctgagtaaaaggcactggactgtggtaggtcttactccaagatggccaaatggaagggcttttagctttctttgtttttgttttatattttgagatataatgttcaaatttacacttcagaataaaaaagagccacaatttatgcttcatattttttgtagcttcttccctatgcttttgaacaatgtaatcatattttcattatcagatataattcccataccataatatccaccctttcaaagtatactttaaaattcaattggtttaaagccaattcagtggtttttagtatattaacaaagttttgtcaccatcacagttatctaattctagatcattttcatcacccaaaaagaaactctgtacccaataaagagtcactccccattcccctcttcccctagcccctggttaccattcatctactttctacctctgtggataggaagtagctgcctattctggagatttcattcaaatgtaataatgaaatatgtggccttttatgactggcttctttcatttagcataatggtgtcaaggttcatccatgttgtagcatataacggtacttcatcccttcttatggctgaataatattcaattttatggactttttagcaaaacattctaatttttacttctctactgtgcttattgtttgtctttctccacaacaatgtgagcactaaaggcagacatttttgcctattttgttcactactgctttttctgcaccaaacgcattgcctggttgtgggtacttttctagttttaggaaggagaagacaagatataggtcctgactctggttctgcctctcattcatatgctacccttccccttgaagaacttgtttcttcatctacaaaatgggcataatactactactcatcagggtggttgtgaggattaaacaaggtaagagatgtaaaattgcatgttagttatcagatagatttgtgttcccatctagctccaatgagggagaggatttgctctagtctgtccctctgggctctgggcttctaatgggcagacagcttcctccatgatgtttgtagctgttaaggctggcgtagtccctcaagacaagttttttttttgtttgtttgttttttttttgagtcagagtatcgctctgtcaccaggctggagtacagtggtgcgatcttggctcactgcaatctctgcttcccggattcaagcgattctcctgcctcagcctcctgagtagctgggattacaggcatacgccaccacacccagctaattttaagacaagcttttggaattgaactgctgatggtcttccatgaacaattcaacagaaacccagtagcgtacacttccttgtatgcacttgcaccctctctttacatttattacacatttaatgctacctaataattccctatacttttactttatccaatcgttcaacagattccaaccgaaatacatagaagagtgatattccaacttcatcagaccctgagattctatttttaacatttcttccatggattgttgaatgtttccaatgattgatccaccttcccttggccttttctacattacagatttggtggcatgtccatgtctatgttgccaaacttgcctcatagacccagcttgaacacaagatgggtgcttgctgaagagcaggactcattctgttgaacctgcatgttttctcaggtcagattgcttggtggcgcttctttaatttctttcaacagcacattgtagtttgctgtgttgaaatgttgcttttctttggttaaatttattctattttattctttttgatggtattataaatggaagtgtggttttaattttgtttttcatcctttattgcaaatgtatactattgatttttgtgtattaatcttgtaccctgcaaccttgctgaacttattttattttattgagatggagtctcagtcagtcacccaggctggagtgcagtggcttgatcttggcacactgcaacctccacctcctgggctctggtgattctcctgcctttgcctcctgagtagctgggactacaggcatgcgccaccacgcccggctaatttttgtatttttagtagagacggggtttcaccatattggacaggctggtctcaaacttctgacctcatgatctgcccgccttggcctcccaaagtgctgggattacaggtgtgagccaccgtgcccagccttgaacttgtttattagctctaatggtttttaagtgagttaagaatttctgtaatgtcatctgtgaatagagatggttttacttctttctttctgatctagattccaccttgttcctttttcttgcctaattgccctaataagtagaagtagtgtgaatgaacattcttgtcctgttcctgatcttaggggggaaacgcttgatctttcacaatggatgaagtatggtgttagttataggtttttcatagatgctttttgtcaagttgaggaagttcctttctcgtcttcatctgctgagtaattttatcgtaaaaggatgttaggttttgtcaaatgccttctgtgcattaggatgatcatgtgactttctattaacatggtatgctacactgattgatttttgtatgttgaactgcatttgtactcctgggataaatcctacctggtcaaggtgtatgatccttttaatatgctgctggatttgatttgctaatattttgctgaggatttttacatctatatttataaggatattgctttgtaactttattttcttgtaatgtctttttctgtctttggtatcagagtaattctggcctcatagtatgagttgaaaaatatttcttcctgttttatttttttggaagagtttgtgaaggctttgtgttagttcttcaagcttttggttgaattcaccagggaagccatctggtcctgggcttttctttgtggaatttttaaaaataattaatattttaatctctttatttgttacaggcctattaaaattttatctttcttcttaagtcagttttggtagattgtgtgtttctaaaattttcccatttcatctaggttgtctaaattgtccacatatagttattcatagtatttctaaacttttgaatttctctatgaccaatgtgatgtctccattttctttctttctggtttccatttcattttttcatttttgtttttgtttgttttttgagataaggttcttctatgtgcccaggctggagtgcagtggtgcaatcatagctcggtgtaaccttgaactcttggactcgagtgatcctcccacctcggccacccagttagctaagactacaggcttgcaccaccacaccaagctaatttttttaaaaaatatattttttagaaaaaagtctcattgtgttacccaggctgttatcaatctcctggcctcaagtgatccttctgcctctgctttccaaagtgctgggattgcaggtgtgagccattgcacccagcctccactttctttcttggtgaataatttgacccttatttttttcacttggctattctaagtaaaggtttgccaattttgttgatctttgcaaagatccaatttttggttttattgattttattgcttttctattttctatttcatttatctccattctaatctttattatttcctgttttctagtggtgttgggttgagtttgctcttatttttctagttccttaaggtgtaaagttaggttattgattcaagatcattcttctttaacttatgtgtttacagctataaattttgctcttagaactgcttctgctgcatcctataaatctgggcatgttgtgttttcatttttatttgttcaggatactttttgatgtcccttgtgatttcttctttaacccatttgttgtttaagagtgtgctgtttaatttctatgtgcttgtgagttttctagttttccttctgttcttgatttttaactttattccactgtgtccagagaacatactttgtgtgatttcaatcatcttaaatttgagacttaggaccaaatatatgctctatactggagaatattccatgtgctctttagaagaatgcttattctgctcctgtcgggtggaacgttctgttcatgtctagtgtatgcgattggttaatcgtgcttttcaaattccctatttccttgatggtcttctgtagtttttctattactgaaagtggggtattgaagtcaccaactattattactcacaatgtaaccatatttaaccctttacttttaaaattctttttggaaactggaaggatctgtaaccaccacccactcccacatcagaccctatgcatatgccaactgtctgctgctcagcagctgtgatggttgttccagttctttattaggcaaagaacagttgtttttttgtttttttgtttttttttttttaacatttcctttaaggaaggtggctcagattgctaagccagccaggccctgcgggacaggctgcgcctagggtcacctgctcttcttcagcaactcagaaatattctccttgaccattgaatccaatgttgaaaagtcccagtcggccaactgcattagtcgatcatgggcctccctaaagaggccagagccaatattcagctccacctgcatacgccactcagctagcttggagctgttgaggaagacattatagttggctgccatgggctgtagatagacgaagacaaagacgtggtcagcctggggaccagccccacctgggtcctctcccacagcctcaggcccacgtccctaacatctacctatgcaaagaattaggctgctgacccccaaggcctgagcaaggggtcacagactatgtaatagatgtaggtggggatggaggatccagaatccctcagagtcctcagtcactggtcttcttgctccaagccttctgaaccatgctgagagggctcctggcccaggcacttcccacttctccagcctgcgacctcgcatgaatcctgccttcttccagggaaaccccttatcccaggtgtgtatatgtggatgagggagagaactcaggttttttcctccatgtttagcctcccactgtgatcaagctcaggggctaggatgggagacctggcgggcagtctaccctgcagtttcgctggcttactaagagtttggtttgcacccaagatctttgggaagcccaagaatgggtgtgtgtgggtgaaatgtaaggggtggggacgaagcatatggctgaacccttggggcaggccagaatgatttttcctggtgctggtctgccctgcaaacagaccaaggagactaattttcatatcagccagagatctctgggataaggaaaagaatactgcattttctggtcaatccaccaggaccccaggtccctcctctcgggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttcctcccctgttatctttgggatcagcaactggccagggttgggaagaggagggaagaggaggctgcactccagggccacctgccctgccaggtctctgtactcttgtctgctggatagatattgaacacttcccaggatataaagcagtttcacctcttttagcagttctgattggtggaagttgctgggaaccatgtgttcacaaggatttggggagctcagcaggcataagtcctgtgattgattagtgatgtctgtcacaggcatagaattcaaagtagagacacatgtactggttatttgtcatcttctaattttctataggccatactcttttttgtttttgttttttgagatggagtctcactctgtcgcccaggctggagtgcagtggcacaatcttggctcactgccaactccaactcctgggttcaagcaattgtcctgcctcagcgtcctgagtagctgggattacaggtgcccatcaccacacccagctaataattttgtatttttagtagagatggtgtttcacaatgttggcaaggtaggtcttgaactcctgacctcaagtgatctgcccgcctcggcctcccaaagtactgggattacagttgtgagccaccgtacccggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcaggtctggcgggcaccagtgcgatggtgcgctgtacttgcggcacaggtagtaaaggatggccgcgctgcagaaggggccggtcaggggcactgcccttgccttcctgagtgccactacgtcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacgtagggtagcccctggaggtgcagggaggttatggacttaatgcttaagattaggcattatataagccagggcatgaaaggatccatctctctggtgctggatggagggtgagcccgagggggcagaatggacaatgaggtggcgggccagcaactatcgggaaggttgtggtgtctggggatggtggaggccatggggacagagggaaggggacggaggggagacatgcttcggaggggatgtcctaggccttgctgattgatggctggtgtgggaacctccgcagcacaagggctcctttatcatcaccaacagcaaccatgccaaggtaaaaaggtcagggcatggagagagctatcggttaaaaagtggcaggagagacagcaactggctgcaagactcagaacttctttggatcctgatccaaacaaactgccaagaaaatatttaggagataatcagagagttttgaacaggagccacgtattagatgaaatccaggaattactgttaattttatgaggtatcttaatggtatcgtagtgatgctacgctctatcctagcccaggctggagtgcagtggcacaatcagagttcactgcagtcgtgaactcctggcctcaagcgatcctcccgtgtcagcctctcaaagtgctgggattacaggcatgagccaccgcgcccagcctgttgctttttttttttttttttttttttttttaaagaacgcttatctctaagaggtatgttcctgaacgtttattgatttatttacttacttatttttatttttgagatggggtctcactctgttgcccaggctgaagctcaatctttgctcactgcaacctctgcctcccgggctccagcaatccctccacctcagcctcctgagtagctgggactacaggtgcggaccaccatgctggctaacttttgtattttttgtagagatgggggttttgccatgttgtctaggctaggctggtcttgaacacgtgagctcaggccatcccctcacttcagcctctcaaagtgctagaattacaggcatgagctggcccctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgctcgcactgaacctcccaggaggagcagagacagatggtgcaagggccccagggaagacttacctttcacttaagataaatttcccatctttgaggctgggaagcttcctgagggggttgatgtcaatgtattctttgctgtggtggtgacctgggaggagcagggaaggtctgaggctgtgggactccaggggagagagaactgagactcccagagacacaaacgcctccctctctattttctcaagaagagaggactgaggcccggagggacatggcggctcaccccaggtcacagggcaaggcagttgcagaaccggactgggatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagttttggagtccctctgtgctcgggatggagttggagcccacccctctgaccctcactcgggagcagtggagccctgagcctttctgaacactggggaggatgggtgtagacggactgtgcacttctgccccctttgccaacctggtgggcaggtgctgagttcacaaggtcctagaatcccacaacgaagccagggtgcctggtgggagcccagggagtcccagctgctgttcattcccccttctcctcaaaaagcctgttcatctgtggcgtggggactatcattagtggggagtggctaaggtaggctaggcagggacgcagcctacaagccccgtggcatcttttccttccctgtggacctctggggtgattcccttgtctctgtccctgcttctcagaaatgcccctatcaatctgagcgtggtggctcacgcctgtaatcccagcactttggaggctgaggcggggcagatcacttttggtcaggggttcgagaccagcctggccaacatggtgaaactccatctcgactaaaaatacaaaaaatgagccgggcatggtggcgtttgcctataaacccagcaactcgggaggctgagctgggagaatcacttgaacccagtggagattgcagtgagccaagatagcaccactgcactccagcctgggtgacaaagtgaggctctaccaaaaagaaaaagaaaaaaaaagctccaatctgtgtgtcctgcctccccccaggaccaggcctgccaggcagcagtgggagctgacctttcagcagatccacaaactgaaagttgaactggatgtcatgcttcttcgagaagatgtagacggcacggcagggtgctgacagcaggtccatgtagagctccagggccatgttgagacacatgccaggccccacagctgcagctggccagccacagacctgggcctatgtctggccagagtccctggccctgtgccctctccgatctgggcccaggaccctgcattctggaacctcttgtttccctttgtgttgtcataaggccaggaagcctgcaattctcacagcatcaaggattctaaggaggcccaggagtaggctggcagaggcccgtggcaaaggtgtggcagccgtgaccctactctccccctctcacgtgtgtctgtgtcccgtggcgccacctcacagacaccctgtctgagaagggattatgcctgggaattcccagggccggactttgattgcagaacctgacgaaaggggctttgcagggtccagaatgaggaggaggcaatgagaattatccctggaggattctagaagtagaggctgggagcatccacaggtgaatggagcctgaactatgactagaaaggaattgggagaaagagacacaggaacctgggagcttcgggagcagtggggacaccaccaccaggaagtcagggggcactcggcaatgaaagtggcagatgcaataaaacttttaacatattgttgtataatgtacaataatgtaataaaaatacaccccctatacattattgttccaactctagctctatctattgccctcctcatatgaatccctctccccataccccattctctagttaatcttaactaggcctcctgtttatattagccacatcaagcctagctgtctactctatcctgtgatcaggatgagcatctaatttgaaatatgcactcatcggtgcactatgtacagtggcccaaacagtctcatatgaagtcactctagctattatcctcctatcagtcctattaataagtggttcatttaatttgtatatactcattggaacagaagaatttctctggctgctcctaccatcatgacctctggccataatatgacttatttccacactagcagaaaccagccgagcctctttagacctaacagagggggaatcagaattaatctcgggctttaacgtcgaatatgctgcaggcccatttgccctgttctttatagcagactatataaatatcattataataaatgccctgaaggccgcaagaggttcgtgggtgcagtgcacaggagaccatatctggggacagcagctgcagcagaccccaagctgggccatccctgccacttgccaggtggtgcttggcgaaggcaagcagctcccacccgcccggggaatacagcgcgacccccggcggcatgctcttcagcaccaccccaggaggtaccaggatcatctaccactggaaattcctgatggagtgttgaaacttacccgtgaccaaaacactcccaagggatctgcccaccattcccggggtcaccagccctgccagtgatgatccccccaacggaagccagccagagccacctgagcaatagtccagaagataagcagggcgggcagtgaagaagcacagttttgagatggacatttaaagcaccagccatcgcatggagcactgccaagggacccctcaggcccttcctggaggagtcccaccagccaggccttatgaaagtgatcatactaggcaggcattggtgtggggccagtcaccccagccctctctccctcactcgcggcacctgccccctcctctttgtgaacaccagcaggtacctccttgtgcctccgctgatgcaggagcagctgccccaaggggagtaacccctgccagcacaccctgcagctgagggccaggaagtggacaagaatgaaccctttcttccaaatgatcagctcttccagcccctgctgggggccccacgaccccttccttaggttgacgtgcctgggaaagctcacctccccctcttccctaagagaggaaataaaagccaccttcgccctagggcaaaaaataaataaataataaatcccgtaatcactattgtcttcctaggagcactgcataacatatatataccagaactctataccacaaatttcgtcacccaaactctcattttaacaagtctttttttatgaattcgaacatcatattcctgattccattatgatcagctcatatatctccttgaaaaaattttctaccactcacactagtactttcatatgacatatcttcatgccagtcctaacctccagcatcccaccccaaacataagaaatatgtctcacaaaagagttactttgatagaataaattacagaggtttaaacccttttgtttctagaattacaggaattgaacctacccatgagaatccaaaattctccgtgctacataatacaccacatcctatcacaccccacagtaaggacagctaagtaagctattgggcccataccctgaaaatgttggttatacccttcctatactaattaatcctccagtgtatgccatgcagaggagcccagaaacttcctggcctgggttggggctgcagtggccagactgtgcacctggtggcccaggaaggtaactagagccccacgtagaggactgagtgccactcactctatgctttgtgatttaataggtctaggctcagaaatgggactgatcccacttccagtgacagagtaagcctggagacaagcgaagagcatgcagtgtgtttattgcagacagcagggtgcagtgcagtgggctgtacccactcagtggagccactcctgcagcaactgcacctgcttctgggccagctgggggtcctgccgagcctcactgtggttcagaggctggagtatgagcttgtgggcctccaggaagagctcagtaccaagggcagccttcatatgggcctgtcacactgccagccagggccagtcttggaagaggtcgcagccaacggcagtgggctgggaagacagggcagctggggttggggctcagccccatgcccagagtccccccgagggcaggtgggtaggaaagcttcacctgcatcacctccgtcagcaccaagtcttccagggagatctgctccattgccaggaagggcctggccaccaggacccccccatccaggtgctgcagggctggcgtcagcctccccaacagccgctccagctgtgcagcatctgcaggctgtctggagaagtggggcaggagagactgggctgtgaggagaggagcaacttaacccagactcttggaagcctcttgggcctcctctccatcccttcccggctgccattcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtaccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatctgggtgacctacgtcctttccccatctgggcagctccagctggcttagactctagccaggttccagcctccagctttagcccaaaggtgcccctgggtccagcctctgcatcggagctacacaggctgaaatgaggaaggggccacagtgatttggaaagatctccaacccaaggaaagatctcccctctcgcctctgcctccccctacaactctgagccccagaacccaggcagatcctggctctgaccctgggtgggcaccaggtcaccattacctctctgctagtaggaagtcgccatctctgagggcaggcaccttccccagggggttcaccttcaggaactcaggcttcaggtgctcccctggtgggcagaaaggagagaaggctcagtgcagggcctggtccttggcacccactccatggggcccagcccagccacctggctcaccccaagccaactccactgtctgcagctgaaaagggatgtcattctgcctggcaaaagtggatagcatggcagggggctgagtgcatgtccaggaacagcttgggccccattgctgctcctcccacctgccctccccagaggtctgtacctccaggagttgctcagcccttctcggccagtgccttcccccaaaatggggccagaactctgtactcctcctgaagcctattccctccatgactggctgggaggcctgccaagcccctctccccttttctccacctctgtagagtggaggcaggggtggccagtgtccctttgggggtttcagatagaaactcaatgacaattggcttagcaaaaacaaacaaacaaaaaaaaaacaacaaaaaaaaaacaaagggagtggggtgggtggggagatttctcagaaaacttctccagtcataggaggggaggggtgtagaagccactaagagaactggaatcagaacctgtttctgtctccccacttttcctcccctctcctcctctcccctccttcccctcctgtcccctcccctcctctcccctcccctcccttccctttccttccttcccttcctcctttcctcccttctttctttgagacaggatctctgtctccctacacttttttcttttaattctctgtctctttcttgacatagaatcttgctctgtcacccagcctggagttcagtggcacgatcatggcttactgcaatctccaagtcctgtgctccagcagtcattccactacagcctctggagtacctaggactacaggtgcacatgaccataccccactagttaaaaaaaacaaaaacaaaaacaaaaaaacccttgggcctggcagggcggctcgtgcctacaatcccagccctttgggaggccaagatgggctgatcacatgagcccaggacatcaagacgagcctgggcaacgtgccgaaacccagtctctacaaaaaatacaaaaattagctgggcatggtggcgcatgcctgtagtcccagctactcaagagactgaggtggcaggatcacttgagcccaggaggcagaggttgcagtgagccaagatcacgccactgcgctccagcctaggcaacagagccagactctgtctcaaaaaaaaaaaaaagagagagagacagatagggtctcactatgttgtccaagctgatcacaaactcctggcctaaagtgatccttgggtctcagcctcccgagctgattagctgggattgcaggtgtgggctaccacgccctgttatcactccctttctctgagtcagcttttctctctcagactagcctactccatgaactcaggaaatgtcactacaggtggccccagctcccatttacctccccatagggagctcctctctccagttccaatttcaaaactcccaaggaagcattctggttcactcgcttgggccactggccagagggatgggatactctgaaagattcagctagagtcccgggcccagccctggaccatcactgtgcaccctggttagatgccagggctgggattcagggagaagaaaggaggttcccggacagtcattcctgcctcctgcggctgcgggctccctgcacagtcattcctgcctcctgcggctgcgggctccctgcccccatcctgtgcacgaagtgggagctcccgctgtctggcagcagctgctctgcaggggacagtctggacggcagaaagttcatccttaaccccagccttccagtcaaggttcccacaagtctgggacacctgcaagtgtcatatcccgctgggtgaaagtctgagatcccttttagaggatcccattcgctccctcccttctgccaccttccagctccgagaaacagagctctgaacgaaccctcagatgtccatgcgctggggcctttccaggacggcggggcgcagtcctttctgggttggggtgacacctggaaacatgtaaggtccctggcacagggacccctcccagtttcaagcgattctcctgcctcagtctcccgagtagctgggattacaggcgcccaccactgcacccagctaattttttgtgtttttagtagagatggggtttcaccgtgttagccaggatggtcgcgatctcctgacctcgtgactagcccgcctcagcctcccaaagtgctgggattacaggcgtgagccaccatgcagggccaatttttgtattttcagtagagacagggttttaccatattggacaggttggtctcgaactcctgacctcaggtgatctgcctgcattggcctcccaaagtgctgggattacaggcgtgagccaccaagcctggtggtaatttataaggggtggacatttgttggctcatggtcctgaaggctggaaagtccaagatcgaggggccagcatctggccagagctttcttgctgtatcatcccctggtgaaaggataaagagagggtaagagagagcaagaggctgaactcacagcctcaaagtccttttataatccacatcaatccatctgtaacggtggaggcctcatgagataaacacctctcattaggccccacctcccaacactgttgcattggggattacatttccaacacatgctttgtgggggacccattcaaaccacagcacagggacaccttctctttccttcctgtgatatgctgaataatgacccctaaggatatacaagtcctgatctctggaacctgtgaatattaccttctgtggcaaaagggactttgcagaattgattaagaatgttgagatggaggcattgtcttggattatctgagtgagccctaaatgcagtcacaagtatctgtgtaagaggagacagacggagatttgaaacagaagacaggagaagatggaagcagagagatttgaagatgctacattgtgggctttgaagatggaagaaggggctacatgacccaagacaggcagctccaaaagctggaaaaattgaggaaaccaattcccctctcagagcctctggagggtgtgcaaccctattggcacctgggttttggcccagagaaatagattataaagttctggtctccataactgtaagagaatagatttatgttgttttaagccaccaaggtggtggtaatttgttataccatccagaggagaggaacacagattttggtgccaggaagcagggtgctgctataaaaaagaaaatctaggctgggcacagtggctcatgtctgtaatttcaacattttcggatgccaaggtgggtggattacttgagccctggagtttgagactagcctgggcaacatggcaaaaccccgtctctactaaaaatatataaattagctggggatgggccgggagcagtggctcacgcctataatcccagcactttgggtggcaaaggcaggcggatcacgaggtcagaaggttgagaccatcctggcgaacatggtgaaacccagtctctactaaaaatacaaaaaattaaccaggcgtggtggcgggtgcctgttgtcccagctactcaggaggctgaggtagcagaatggcatgaacccaggaggcggagcttgcagagagccaagatcgtgccactgcactccagcctggggaacaaagcgcgactccgtctcaaaaaaaaaaaaaattagttggggatggtagtgcatgcttgtagtcccagctactggggagaccgaggtgggaggattgcttgaggctgggaagtctaggctgcagtgacctgtgactgtgacactgcactccagcctgggcaacagagtcagaccctgtctcaaacaaacaaacaaacaaaaatctaaaaatgtggaagtagctttaaatttgggtgatgtgcagaggccagaaaaattatgaggcccatgatagagaaaacctagattgccttgcacagattgttggtagaaatatggatgttaaagactatagggagggctcacgagtatcaactaaacatggtcagagcaagtctacattgccttacagcatacctaagtcatcataggcagctgtaggtagatatatagatattggctgggtgcagtggctcacgcctgtaatgccagcactttgggaggctgaggtgggtggatcacctgaggtcaggagttcaaaccagcctggccaacatagtgaaaccccgtctctactaaaaatacaaaaattagctaggcgtggtggcatcccagctactagggaggcggaagcaggagaattgctcgaacctgggagacggaggttgcagtgagccaagattgcgccactatactccatcctgggcgaccaagcgagaatctgcctcaaaaaaagaaaaaatagatattaaaaatcctgctgctgaggactctgaagaaatgaggaacgtgtttctggaaactggaggaaggaggatcatttcccagaaaaggagcccgtagggaggtagaaagcttagttgaattgtgtccgatagttatatggtgggtgaacttaaagcaacgaagttggatatttagctgaggagacttccaagcaaagcgttgaaggtgaagcctcatttcttcttgctgtttatggtgaaaagcaagaggaaagtgataaaatgaggaaaaagctgttaagcaaaaagaaaccaaggtttgatgatttgggaaattatcagcctgtgcagattgcaaaagatgctaaaattagaagattcgctgtttggaaaacacaactctatccctgtcctggggatcactcaagacttgtatccatagacaaccagatttctatgggcttgaactctgtgtgtgtgtgtgtgtgtgtgtgtgtgtgtgtgtgtgtgtgtgtgtgtgtgtgtgtagcaaggttgggggagcacagtggaaagaccttgaatttatttgtttattttttagacggagtcttgctctgtcgcccaggctggagtgcaatggcacgatctcagctcactgcaacctccacctccagggtggttcgagcgattctcctgcctcagcctcccgagtagctgggactacaggcgtataccactatgcccagctaatttttgtattgttagtagagatggggtttcaccatgttggtcaggctggcctcaaattcctgacctcaggtgatcaggctggtctcaaactcctgacatcaggagatccaccagcctcggccttccaaggtgctgggattacaggcatgagccaccatgcccagccttattatttatttatttatttttgagacaaagtctccctctgtcacccagactggagtgcagtggcgcaatctctgctcactgcaacctctgtctcccaggttcaagtgattctcccagctcaacctctcaagtagctgggactacaggtgcgcaccaccatgacctgctaatttttgtatttttatttatttatgtattattttattttatttttccataagttattggggtatgggtggtatttggttacatgagtaagttcttttgtagcaatttgtgagattttggtgcacctgtcaccccagcagtatacactgcaccatatttgtagtcttttatccctcaccctcctcccactcttcccctcaagtccccaaagtccattcttatgcctttgcgtcctcatagcttagctcccacatatcagtgaaaacataagatgtttggttttccattcctcagttacttcacttagaataatagtctccaaactcatccaggtcactgcaaatgctgttaattaattccttttcatgactgagtagtattccacatatacatattccatatatattcattccatatatatattccatatatgctcattccatatacatattccatatatgctcattccatatacatattccatatatactcattccatatacgtattccatacgtatgtactccatatacgtattccatacgtatgtactccatatacgtattccatgtatgtattccatacgtatgtattccatgtatgtattccatgtatattttccatatgtatatattccatgtatatattccatatgtatatattccatatatattccttatgtatatattctgtatgtatatactccatgtatatattccgtatatctatattccatatatgtattccgtatgtatatattccatatgtactccatatgtattccatatgttccatatatattccatatattccatataaattccatatattccatatatatcccatatacattccatatattccacatatattccatatacattccatatattccacatatattccgtatattccatatagattccatacatttattccatatatattccatatagattccatatatattcagatatattccatatttatattccatatatggaatatatatgtattccatatatatgtattccgtatatgtatgtattccacatatatattccatatatgtatgtattccacatatatattccatatacgtatattccagatatatactccatatgtatatcccagatatatatattccagatgtatatattccacatatatattccagatgtatatattccatgtgtgtatattccatatatgtatattccatgtgtgtatattccatgtgtattccatatatatattccatgtgtgtattccatatatatagtccatgtgtgtattccctatatatattccctatatatatattccctatatatattccccatgtacattccatatatatattccccatgtacattccatatatattccccatatatattccatatatattccccatatatattccatatatatattccccatatatattccatatatatattccccatatatattccatatatatattccccatatatattccatatatatattccctatatatatattccctatatatattccctatatattccatatatatatatatatatatatatatatatacaccctatatatatattccctatatattccatatatatatggagtctcgctctgttgcccaggctggagtgcagtggcgcgatctctgctcattgcaagctccacctcccaggttcacgccattctcctgcctcagcctcctgagtagctgggactacaggtgccagccaccatgcccagctaattttgttttcgtatttgtagtagagacggggtttcaccatgttagataggatggtctcgatctcccgacctcgtgatccgcccacctcggcctcccaaagtgctaggattacaggcttgagcctccgcgcccggcctctgaattctttttcaggtaaatcagggatttcttcttggtttggatccgttgctggtgaactagtgtgatatttgggggtgttgacgacccttgttttgtcatgttaccacagttggttttctggttccttctcattggggtaggctctgtcagagggaaggtatagggctgaaggttgttgttaagattttttttgtcccagggctattcccttgatgtagtctctcccccttttcctgtggatgtggcttcctgtgagccaaactgcagtgattgttgtttctcttctgggtctagctgcccagtgagtctagtcagctccaggctggtactgggggttgtctgcacagagtcctgtgatgtgaaccgtctatgggtctctcagccatggataccagcacctattctggtggaggcggcggacggtgcagtgcactccgtgagctttggtggtttaatgctctatttttgtgctggttggcctcctgccaggaggtggctctctccagaaagcatcaactgtagtagtgtggagaggggccagtggtgggtggggccctaggactcccaagattatgcgtcctttgtctaccactactagggtgggtaggaaaggaccctcaggtgaggacggtgctaggcatgtctgagatcagactcttcttgggcaggtgttgctgtagctgctgtggaggatgggggtgagatgcccaggtcattggagttgtgtgcctaggagaattatggctgcctctgctgagtcatgcaggttgtcagggaagtgggggaaagccggaagtcacaggcctcatccagctcccatgcaaactgaaggggcggtctcactcccaccatgtcctgcaaacagccctccatctggaaacagcaaacagtgtgtttccagatggagggccagacgaattgaaaacttgcctgaggctttccacctcccagctgccaaagaaaagggctttagttcttcctccgcctgtgaaatctgcaagccagattcacaccctcccctgggttctggcccagaggcttctcaccccattcaaattgttacaaagttcagctagagaattccttctccctgtggagctgtggagttttaccccttgctttctggccaccctcctgatggatccctgtggtgccaggcaggaatgggctgcttggggatccagtgagctcccagggcctttctgctgcttcctctgaccctgtattttgctcggctgagttttgtaacttgactcagctccaggaaaagtcggaaacttcttccacaaacaggccttcagcttctccagtgggggtgtgtgctcaggagaagcgggtctccctttcccacttccacagctggggcactcacagtatttggggtgtctcctgggccctacaggagcaagtctgcttccttcagagggtctgtggatcctctcaggattgctggtttgttctttcagtggatctgcagctaaaattcacaatgcaagcctccacatgctgctctgtccggagctgcaatctggctatgcctcccgtctgccatgatcccgaaatccctctccaatttttatatttttagtagagttggggttttgccatgttggccaggctggtattgaacttctgacctcaagttatctgcccatctcggcctcccaaagtgttggtgtaccaggacaagctgcagacaaaacctctgagacaccaagttaaagaaggaagggctttattcggccgggaacttcagcaagactcacgtctccaacaaccgagctccctgagtgagcaattcttgtcccttttaagggcttacaattctaaggggtctgtgtgagagggtcatgatcaattgagcaagcagggggtacacgactgggggctgcatgcaccagtaattagaatggaacagaacaggacagggattttcacaatgcttttccatacaatgtctggagtctatagataacataactggttaggtcaggggtggatctttaaccaagcccaaggtgcagcgccgggctgtctgcctgtggatttcatttctgccttttagtttttacctctttctttggaagcagaaattgggcataagacaatatgaggggtggtctcctaccttattggggttacaggcatgagccaccgtgcccagccaagaccctgaatttaaatcctgactctgtcattcattagctcctgacctcaagtatgccattaactactttgaatcctggtatccttgctgtcaaaggagatgagagttctgacacttataggtccactgtaagacataatttttaaaatatctgtaaaaactgggccgggcatggtggctcatacctgtaatcccaatactttgggaggtcaaggaaggcagattgcttgagcccaggagtttgagaccagcctgggcaacatgatgaaaccccgtctttaccaaaaattcaaaaaaatttagctaggcattggcacgtgtctgttagtcccatctgctcgggaggctgaagtgggaggatcactggagcccaggaggcagaggttgcagtgagccgagattgtgccactgcactccagcctggcagagtgagaccctgtctctacaaaaatgtaaaataaacttaaaaaatgtcaaagcatgataaagtacaggacataaagaccatgattaatctaacacccatcactacaatctttgcctctgttctggcattcccctatgtgtcttcgcatcaccctccttctgggtgactcctttatgttgtatttttttgtttggtttggtttttttggttagtttgttctgagacagagtcttgctctgttgctcaggctggagtgtagtggtgtgatcttggctcactgctacctctgcctcccaagtttgtacctcagcctcccgagtagttgggattacaggcatgcgccaccatgccctgctaatttttgtatttttagtagagacggggttttgccatgttggccaggctggtctcagactcctggctcaagtgacctgcccacctcagcctcctaaagtgttgggactacaggcatgagccaccacgcccggccaccccactcattttgaatgtaagtagattaccaattctgaaatgggttttgagcagtagcaacattgacacaaatttataatattttcaagaagatacttccttcaatatgtaaaatgcaacagatatcatttgcaatcatacatatgtacatatatacatacacacatataatatatatatctcaccatggaataagtctgagctgaaacatgcattacttaaaaaagaaaacacttacagacaggatcttgctccgtcatccaggctgaagtacagtggcacgattgtggctcactgcagcctcgacctcctgggctcaagtgatcctcccacctcagcctcccaagtagctgggactacaggcatgagctacctcgcctggcctgcatgatctttatgaagaatgtcatagaaagtttttgaaagcgattaaagttcacctaaacaagcagggatctatgctgtatgccatgctattattggggaggaaaaaaattctcctctacattcttagggtctctggagatctggaactaagaataaaactgaaataagacagattaacagaagaaaatcattcaagttttgctaaattttcagtgtacatgggtactttcacaagagaatgaaggcctaaagaagtcactaaagtagaaaaacaataccttttttttttttttttttaagacaaggacgggtgcggtggctcatgcctataatcccagcactttgggaggccaaggcgggcagatcacaaggtcaggagattgagaccatcctggccaacatggtgaaaccccatctctactaaaaatacaaaaaaattagccaggtgcggtggcgggcacctgtagtcccagctactcaggaggctgaggcaggagaatggcatgaatcctggaggcggagcttgcagtgagcggagatcgcaccactgcactccagcctgggtgacagagcaagactctgcctcaaaaaaaaaaaatgacaagacaaagcggcttggattatagggagtaaattgtggagaagggactaggacatacatgcggagcaaaattagaagataaggattatttttagtcgtgtgtttatacagatccattggaaccttgattcacagtcacttgtgatgacaatgttcttctcttcctggtaaagggagggtgctttcttatgggaaattgtgtggcctattcttagatagaaaagggcaggtcagagagtctttcctgcatgtgctatttctcaagtgccttcaactcaaaataattaatactccaaagcagcatatttggggtgacgtgtttttaattccttcatttcccctgctgcagactttcctagaagtttcagatattaaaagctgagttggtggctatggagataagagccagattcataacgagggatctacaaatggggagaagaacatagataagaataggaatgaataagctgaaaggaacaggtctgagcacatttccccttatcctgttaaacacacatcccattgctgggacaaggtcagtacagcagaaggaatgcacctcttttgtttgatggagagtgtttagcttgttctttaacaggtgcagcttaggcactatttgtcccagtggatttacacagaccagccttatccaccaatgatcacacaaactcctccttttgaggctgtcagtgtgtccagggtgcaacaattttggaatacagcagaagctaagctattaacttcttttgttgtggttgctgttgttgttttgagacagaatctcactttgttgagtgcaggctggagtgcagtggtgcgatcatggcttgctgcatccccagcctcctgggctcaagtgatcctcccacctcagcccccagagtagctggaactactactatgccctactaatttttaaactttttgtagagacagtctcactatgctgcccaggctggcctcgaacttctgggctcaagtgatcctccctcctcagactttcaaagtgctgggattagaggcctcagccaccatgcccagattgctttgacatcttgaggccttactgatccaggagagactgcccctccctgggccagctaattcctacagagaataaatgatttgcttatggtgtgccttcgatgggccaatcaaccgattcgtatctccaacataactttaccagccacctttcagcaggttcctgccccaaatcactccagggacaggtaccaggtaacaaaggaccactcctataacccagagcccatcacaattattaaaactagccagtcctaagtctgtttaccctgtcttgccttcttgcaaaaaacacagtaaagccttttgtccaccttttgccctcactcattctgccacctgactgaccctggtgcttccccatggccctgcatggtgtggcatgtcccccctattgtcttgggaactgtgagtaacaaactttcttttacatggctatcacctctgatctgtggcctcgccatacctgaataaagccaaaatcccaggtacattttaaaacaagtctacaagtcaaggaataccaaggatttccagcaacaccagagaggccggcccacgcccggcctgactcttactgttaatcactagttttgcatttctcttgaggaactagtcaggaggagaaaacctagacagcagctctcctggtcaagacccagtcattcagaagcctaaatggcatgcctaggtgcttggctttaaactgttagcaggtatggagtgctctgattgtgttttagaataatattctgggctgggcacggtggctcacgcctgtaatcccagcactttgggaggcggaggcaggcggatcacgaggtcaggagattgagaccatcctggctaagatggtgaaaccccgtctctactaaaaatagaaaaaattagccgggcgtggtggtgggcgcctgtcgtcccagctactcgggaggctgaggcaggagaatggcgtaaacccaggagtcggagcttgcagtgagccgagattgcgccactcattccagcctgggcaacagagcgagactccatctcaaaaaaaaaaaaaaaaaaaaaaagaataatattctggctgctgctggaaggcagccagggaggaagcaaggacattggatactgcagtaatcctggccaaaggcgacttgtgaaaaggggtgggcaactgaaggggcaggagaatgtggcccctctcagtctggagagagctgcagcactaggccaggaaggcactcttctgcggggggataggtcttaaatggggaccatgggattgggtgcagtggctcatgcctgtaatctcaacacttcaggagtctgaggcaggaagaccacttgagcccaggagttggagaccagcctgggcaacatagtgagaccctgtctcaaaaaaaaaaaaaaagacaatttaaaaactagccagatgtgatgcctgtggtcccagctacttgggaggctgaggtgagatgatcacttgatcacttgagccctggaggtcaaggctacactgagccatgatcatcccactgcactccagcctgcgcaacaaagtgagactcttatctcaaaaaaggcgacaggtgggaaccatggggaaccagagaagcaaagctattctcaagttttccagtaaccatcctcttgccaatggtctttctctgaatcttggatttgggaataggattttcctgccttgggaggctcccttgggaaatgggagtgtcacagccacaggcatcaaaagccctagagttgcacttgaatagtgggtagaaagttctgtgcaatgccaggcactgttggaaacctctgggtagggcttacagggccttagccatctgtgggaggcattagctggagtgtaataaatatgaccctcaggactggggagaaacagctcattccttcatgaggtgtggggctggcagccttgcaggcagccagccacccttcccctctggcctccatcctgggcactgagccaggcactgggtaagaaggctgctgcacctcctttctcctcttcccttttagagagaaagatacccccagccgaggatcccagaaaggcgagagcagacgcgccattgattggcccaaagttctccggagccaacctttgagcaaggagggcgtggctgggctccagtctcctagtgaggtgcaccactgcaggcttggtgacccagccgttcctgcccgctgcccccaaccagccgttcctgcccacagttcctgttcccgggcctgtccccgggtttgtccccagggcccgtcccctgggtttaggtctaccctccctcgccccaccccatcgccctcgccatgggtctggagctgtacctggacctgctgtcccagccctgccgttcagtctacatcttcaccaagaacggcatccccttcgagcttcgcaaagtggagctgaccaaagctgggctgggcaggcaggcccaggggatattggctgcggatccccacctgtccccactgctttgcagtcgggccgagaatgcagactaacatgaagaatcagactctctggtgtggaaactattacgtaattatctatgttattatttttactttttggagacaggagctaactctgtcactcaggctggagtgcagtggcacaatcatggctcactgcagcctcgaccttccaggctcaagcgatcctcccatctcagcccctcaagtagctgggactacagatgcccaccgatatgcccggccaatttattattattattattattattattactattgagaggaggtcttcctgtgttgcccaggcaggtctcaaactcctgagctcaggcgatcctctttccttggcctcccaaagtgctgggattacaggcatcagctgtcatgccctgctggttgtttattttaaaagaggcttcatctttgcttagtgaatacaaagcattcttcaaaatacaggttaagagggggcagagcagatgcagcaggagggcagggaaatggagtggggctagaatatcttcaccccatgtgcttggaaaaaacaatgaaactacctccttgtttcctaagtggagtagtccttgtttacctctgcctgggtctcttcccttcttgcctcttctttttttgacacggtctcactctgcagcccaggtagagggcagtggcatgatcccggctcactgcagccttgacctctcaggctcaagtgatcctcccacttcctcctctcaagtagagtagttgggaccacaggcacgcaaccacatccagcaatttcttttttttcctttttttttttttttttggtatttgtggagacgggattttgccatgtagaccaggctgaccttgaactccagagctcaagtgatcctcctgcctcctccttctaaagtgttgagattacagacatgcactaccatgtctggccctgggtctcttccacttttatgtatttcttggcattcttctgccttttcttttcctgcatctgacttgctctatcccatggggcttctcacccagctgaaggggctgctcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagaaggaggaacctgctcagctgactcttcccaactgctgcccttggtacaaccagcttgagtcacctgctacagaacaggggctggacacagaagcagtctgtggagggagaatgggcaggggtgtgcatgtccattcagtagaaggccagagaggcccacatgtaggcctatgatcagactggagcctggcttgactgatgccctctgatccaaacaccaggcacctaatgcggcctctagcactggcctagagtgctaaagtgagtcagacctgggaacccccagtggggagggagccttgagagtttggcacaagaaaggaagaagagctgagccaccgggggctgagtggctgaatggggcagggattcccagcaagaatgaggttggtctgagggttgggaacatgtttggctgggactctggggtattgacaggtcacccagcctggccagtagggcctaaggccccagctgggataggaagctgaatcagagggggcaagcctagagcccagggaggaggctggaggggtctgacctatggatggaactggctgggggtggggtgtgaattacagctccagggaattgtccttgagccatgcttcaaggaactggacacaggaaaggtggccctctgatagggtcagggtctgtgacccagtgactaacagagaggcttcctcttccctgatgcctcccagataggggcctcagaaagctgctgctgggagtttggagtgggggtgggcagagacatcagagaactcagggttctccccactcacctctctgatctcgcctgcaggccagcagcacagtgatgcctttgcccaggtgaatgccctgaggaaggtgccaggccttgaaggatggggacttcaccttggctgagaggtaaccggtccctgggctgctgccgggccttgtggggccagtcagtcagctgtctgtttactgctgatggcttggatcatggactgtgggccctgcaccagccccagggtgaagaatgggtggaggcaggcagaggtgcccagtgttgacaagggctatagaagtcccctcctgcattgtacaagtgaggaaactgaggctggaggaggggagggacttgcacaaggccacagggcccagtctgcttccgggcctcctcaccgccagtcttcccctccgaaaaaaagagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctacgtccttctcctcatggagctcacattccattaatagaagggggagctgacagtaacccatgtaaacatggaacatatcggatgttgatggatgccatggaaaaaataaacagggtaagagtgggggtgtgtgtcattatgagtaggatgttgagggaagactccctggaggaggtggcatctgagcagagagctgtaggaatgtgcaaggcatgaggggaagggtgttctcactggagggaagagtgagggcgaaggctccaggtgggacaatgcatggggttcagactggagagcaacgggccagggtgggtgcagtgagcaggaagagcaggaggtcatgacagaggggagcatgggacactgggaaggctttggctcttaccacaggtagattgagtcgctggagggttttgagcagaggagaactgtgatctgacttacgtcataaaggatccccctggcaggggtgagaaagccactgcagtcatctggcatgcagcgctggagccccagaccaaggtggtggtggtgcagggttggtggggattgtggtcagttctgacttttattgaaatctaactgcagggtttgctgaagggttggaggtgggtgggaaaaatgaaagccaaaaccagcctctaggttggtggctgcatggtggcgtcctttaccgaggccaaatagtgcctccttggtggagctggattcacattcagagcctgggatcactggatggtccaacacccatagaggcatgatgagctctgggggtcagactgcacaacccttcaccataggtgaacaggagatgggacagggtggggagcaatgctgccatgtcacctggaaggctctctccctgctggccttgctcctggccctgtccacgctttggatatgttggggagatatccaacatgctctcgttcttcagactcacagtggatgccccttcctcctggaagccttccctgagcccctgctgaagttcatgacattttgtttcttacttgctgcccttagttgagatgatagtctggccccgtgtagggctgtgtgaccctgggcacttacctaacctctctgagcctcacatccctcctctgcatcatggggatagtgaaaatgccccagaaaatggctgaagagtgttcagggcatgttttctgcccctgccatgtccccccagtgtggctagcttgctgtgtatgaactgcatgtacaaagcacctgaccactggtacccccaggacctgcaggcccgcgcccgtggggatgagtacctgtcatggcagcacatggccctgcagagtagctgctgctgggccatgtggcagaaggcgagccatggagggcagggacatctcccaagatgccaagggatgctgctttcactttacaaaatcctgtttagacctgagaccaaatcctggaatgccagagactgcctaattcacccaacttgtttcctaggagggaaaccaaggaccagagccaaggaaggattcccctaatatgccttaattccagagctatgagcagttaatcctatgctcttttgcatactccaggttgcctgggaatcttgcctttagggggagaaaataaacaaaccctcactttgctacacacataattcgtagatggagaagtatgaagtgaaaaaagtcaaactaggaagaagtgaggagacatttcaataaacgtttgtctgatgtctcggtatgaaaggactttctaaccctcagaacagtgggagaactcaacaaagaaataaccactacatgccagctgcggtagcatctgtaatgagcacacctgtaatcccagcactttgggaggccgaggcaggcagatcacctgagattgggagtttgagaccagcgtgaccaacatggagaaaccccgtctctaccaaaaatgcaaaattagccgggtatggtggcgcatgcctgtaatcccagctactcgggaggctgagtcaggagaattgcttgaatctgggaggcagagattgcagtcagctgagatcacgccattgaactccagccttggcaacaagagcaaaactctgtctcaaaaaacaaacaaacaaaaaaacatatacaaggacatgttgtgtaagaaaaaatggattaaacataaaacaagcaaaaaaccgggaaggatcttgataaaagatatgtcagaaggaggtaatgttctttaagatgctcttagaaacccttaagagaggcctggtatggtggctcacccctgtaatcccagcattttgggaggccaaggtgggcagatcacttgaggtcaggagtttgagaccaccctgggcaacatgatgaaaccccatctatattaaaaatacaaaaattagttgggtgcggtggcacactcaggagactgagacaggagaatcacttgaacctgggaggcggaggttgcagtgagctgacatcataccactgcactcaagctccacttagagcgagactgtctcaaaagcaaacaaagaaaaataagagaaacccatcagacaagagacaggaaaaaaatgagtcatagctcactgcattctagatctcctgggctcaagcgatcctcctgcctccgcccaggtagctagaactacaggtgcacaccacaacactgggattctttttttttttctttttttttgtagaaaacaacgaagggaatcttgctatgttgcctagcctggtcttgaactcctgggctcaagcaatcctcccttcttggcctcccaaagagctgagattacaggtgtcagccactttgcgtgaccacaatttcaatcatatttaaaatgtacaattcaagtgattttgccacactaaccacagactcatgtttaagccacaccaacggatttccatgttttaaataacatattttgccaccccctagtggacagtggctcaccaccggcacaaggggctacataggcagtcaatgggaaccaggcggggacgggaaatgtcgtgaacccaacggtccctgcccagccccacccgcgtccgcaacgtgtaaccacatctcctgactgcccaagagaagcgcagatttccatactgaacatgaaattgcctgacttcgaaatggtggcaaatcattaaaaaaaattttaaactcactttgcattggttattagggtcgaacttggggaagacccctacaggtgtgtgtgtgtctgtatgttaggggtgttcagacctttaatagggctagaaaccaggcaaccacaccgcggaaagcttgaggagagggaaatccaccagacgccaagcaggagggtcagggaagagacagggtggggccactaccgggttaaagacttgtagtgggtggggctacacgtagggccgagacgaccggatttccggaaatcagagccggcacacgtgacttttgtttgcagaagtgggaaggtaccctaggcagccaatcggggagcgctgagtctctgtccagccaatgagaagccaggttgttttagcgcctcgcccctcctctccggtccgcgagccttgggtatctccagcttttttccgccagagctgtttccgttcctctgcccgccatgccgttcctagagctgcacacgaatttccccgccaaccgagtgcccgcggggctggagaaacggctgtgcgccgtcgctgcctccatcttgggcaaacctgcagacgtgagcgtgggccgggcagcactgggcgaggggaagttggtgggccaggggtccggccttgtccctgctctgcctccgcaacagcgaccccgatccctttccccagggaccaccccccaccccattccgcaggccaagctctgactttccgtgcttcacgatcccgcggctccccctccgcacgtctttcccttgtcgccctccccagtcatgacccggacgtgaccttcagggacctcggcctgtactgggatccctgtccccgcgaacactgcgcgtttcggctttcgcgcgctcgggtcgggaccccagacgtagcccgactggctccagcttcgggtaaaacttttcatgttcccctcagcttgtgaacgtgacggtacggccgggcctggccagggcgctgagcgggtccaccgagccctgcgcgcagctgtccatctcctccatcggcgtagtgggcaccgccgaggacaaccgcagccacagtgcccacttctttgagtttctcaccaaggagctagccctgggccaggaccggtgcgcaggggtagtaggcccggaatattattctaaaacacaatcagagtactccattcctgctaacagtttaaagccaaacacctaggcaggccatttaggcttctgaatgactgggtcttgaccaggagagctgctgtctaggttttctcttcctgaccagttcctcaagagaaatgcaaaactagtgattaacagtaagagtcaggcagggcgcggtggctcacgcctgtaatcccagcactttgggaggccgaggcgggcggattatgaggtcaggagatcgagaccatcctgactaacacggtgaaactccgtctctactaaaaatacaaaaaactagccggacgtggtgggcgcctgtagtccccgctactcgggaggctgaggcaggagaatggcgtgaacccgggaggcggagcttgcagtgagccgaaattgcgctactgcacaccagccggggcgacaaagcgagactgtctcaaaaaaataccaaaaaacaagcaaaagaaaacaaaacaaaaacagtaagagtcgtcccaacgcagtggcttatgcctgtaattccagcactttgggaggccgaggcaggcagatcacctgtggttgggagttcgagaccagcctgaccaacatggagaaaccctgtctctactacaaatacaaaattagctgggcgtggtggtgcatgcctgtaatcccagctactcagaaggctgaggcaggagaatcactttaacccgggaggcggaggttgtggtgagctgagattttgccactgaactccagcctgggcaaaaagagcaaaactccttctcaaaaaaacaaacaaacaaacaaaaaaaaaaaacacacacacacacaatccaaaaaccagtaagggtcatgtcctgggaggctaactcagccgactgttaggtcaccatgcttatagccaagaaatgtgggatgctgctgggccctgagcggtcagataaactactttctctgataattagaaggctacaggaaatgttttgttttgttttgttttgggtttctttgtgtgtttttagagacaggatcttgttctgttgccccaggctggagtgctatggctcaatcagagctcactgcagcctcgaactcctgggctcaagcaatcctcccacctcagcctcccaagtagctagaactacaggtatgcatcaccacgcctgactaattaaaaaaaaaatttcttttggttgcgtgtggtgtcttggcacccgtaatcccagcactttgggaggtagaggtgggagcatctcttgagcacaggagtgcagggctagcctgggcaacatggcaagaccctgtctctacaaaaataaaaaagaaatgagctgggcgtggtggggtgcacctgttgtcccagcttcttaggaggctgaggtgggaatattgcttgagcctgggatgtcaaggctgcagtgagccatgactgtgccactgcactccaggctgggcaacagagtgagaccccatctctgaaaaaatatttttttggggagccaggcacagtggctcatggtaatcccagcactttcagaggtggaggtgcacagatcatttgaggtacagagtttgacaccagcctggacaacacggtgaaaccctgtttctactaaaaacacaaaaattagccaggtgtgatagtgcgtgcctataatcccagcttctggggagactgaggcaagagaatcgcttgaacctgggaggtggaggttgcagtgagctgtgatcatgccattgcactccagcctgggcaacagagcaagacactatctcaaaaaaaaaaaaaaaaaagtttgttttgaaatcctggactcaagcaatccccccaacctggacctcccaaagtactaggattataagtatgagctaccacactcagccactttttttttttttgagatggagtctcgctcggttgcccaggctggagtgcagtggcgcgatctcggctcattgcaaggtccgcctcctgggttcatgccattctcctgcctcagcctcccgagtagctgggactacaggcacccaccaccacgcccggctaattttttgtatttttagtagagacggggtttcaccgtgttagccaggatggtctcgatctcctgacctcgtgatccccctgccccggcctcccaaagtgctgggattacaagcgtgagccaccgcacgcggcctcagccacatttattaatttcactcttggcaaacatcagggggaagctgacccacacggcctgggaagggggttgtcttttgcatagagaccatgaccaggtctgggacagaggaaagtcaaataaatcacacattagagttagaagcagaggctcaggctgagcccaggtttattatccaaaatcaaaatgaaatgcagtgattaaaggacacaaggcctcagtgtgcatcattctcattgtggctttcaggcggctgtggaagacagggtggggatggtggcttcgggaggtgaggtgctctgggacttgggcaagtcttaggcaagccattcctgctttctgggcctggctcccatgggccattagaaatgaaaatgctttgtggactgctgaggacggtgcaagggtgaggtttcccagctcaccggatcatggccagcacccagggcatcagcttctgctttatggtggggtctgcaggtgggaagtccttggccttcagaatgacctcatgggcctcctggaagaggtcctcccccactgctgcctccacgcgctgccgccatgtggccagcttgggtcggccttcgaagacttggcagccagcacccacgggctgtggggaaaagggtacagactggggatggatggttgtgagggcagggatgggcagcatctgatttggggaccacagatctccaggaggtgtttgcacacacacttaagcacagtgccatagcccggtgtggcagcataagcaggacttcagcaactagccagggccccctgcctagtgggttcacctgcccacagcactcacatgcatcagctccgtgatggctacgaggtcagctaaggagatgtgaggaccagtaaggaaggccttgttctggaggaacttgtcctcgagcaactgcagggtcacatccaactctgccagggtggctgccagtgtctggggagatactggctcacccaggaaaacagggaacatcacctggggattgggcaggcaaagtcgggagttactggagtagggagttagttttgatttgcatttccctaatgattagtgatgctgagcatcttttcttttttttttttttttgagactgagtcttgctctctcgcccaggctggagtgcagtggggtgatctcggctcactgcaagctccgcctcctgggttcacgccattctcctgcctcagcctcccgagtagctgggactacaggtgcccgccaccacgcccagctaattttttttttatttttagtagagacagggtttcactgtgttagccaggatggtctcaatctcctgaccttgtgatctgcctgcctccgcctcccaaagtgctgggattacaggcgtgagccaccgcgcccggccaagcatcttttcttgtacttgttggccaaaatgataatattctcaacacattgggttaagtaaaatatatcaatttccttttactttttttttttcttttgagacagtgttcagctctgtcacccaggctggagtgaagtggcaccatctcggcacactgccaactttgccccctgggttcaagcaattctcctgcctcagcatcctgagtagctgggattataggcacaggccaccaagcctggctaatttttgtggttttagtagagacaaggtttccccatgttgaccaggctggtctcgaactcctgacctcaggtgatccactgccttggcctcccaaagtgctaggattattggcatgagccactgtgcctggactctttttactttttaaatgtgcctactagaaaatttaaaattacgtatgtggctcactttatacttctatcggacagcacttgactaaatgaactaaattccagagaggcataagccgttcctagatgagctactttcattccaatttcatttccttgggcccaagcaggctgggagaaagactgtcacaggcatgggcttttctgactgagcagcagtttgggaactgggggcagggatgaaaagcagagagatcttacaggcaacatcgtagttggtgattagattccaaagccatgctagactgagctagtgacctgatctcacattcaagatatttgaaaccaaagataaactgaaaccaactaaacctgcaacccagcccacctcctgattagcttagaagagaacagcctcacatcctggctacctgacacagggaagtgcaagccctttcttgggggtgtttattatgcaattcaatctctgctcttcttttatcataatgtctggcacacaaggatacatcatgaggccgggcatggtggctcatgcctacaatcccagcactttgggaggccgagatgggaggatcacctgaggtcaggagttcaagaccagcctggccaacatggtgaaaccctgtctctacaaaaatacaaaaattagccaggcatgatggcaggtgcctgtaattctagctacttgggaggctgaggtgggagaatcgcttgaacccaggaggcggaggttgcagtgagccaagatcgtgccattgcacgccagcctgggcaatggagtgagagtccgtctcaaaaaaataaaaaataatgataatacatcatgagacatgcaaagaagcaggcaaatgtgacccataatcaagagggagaaaacaacaatcaatagaaatagacccgtaggctgggtatggtggctcatgcctgtaatcccaacactttgggaagccaaggaggacgaatcacttcaggtggagagttcgaaaccagcctggccaacatggtgaaacccggtctccactacaaataacaaaagttagccaggtgtgctggtgggtgcctgtaatcccagctacgcaggaggctgaggcaggagaatcgcttgagcctgggaggtggaggttgcagtgagctgagatcgcaccattgcactcagcctgggtgacagagtgagaccccatctcaaaaacaaaacaaaacaaaaaaaccagacccacagaacacctacgtgttgaaattagttgacaaagatttttaggtaacagtgataaatatgttaaagaatttacaagaaaagacagataaaatggatgaacagatggtgaatttcatcagagaagtggaaattctaaaaaacaaccaaatggaatttccagagctgaaaaatacatatctcaaacaaagaatgtattggatgggcttaatagcaatttggcacaacagaggaaagaatctgtgaaggcaaagacaggtcagtagaaataatccaaaactgaaaagaagagactggtgcctgaacacctttggggaatgctctcgctgccgccccccacattcccagcctcaccttatgccacaaggcccggaggcagcttctccgcagagtcgtgtgctgccatgccaggtactcatccacacgggcacgggcctgcaggtcctgagggtaccagtagtcagggaccttatatttgcgcgtcaggtagagcaggatggccacactgtgggtgtgggggtcatgatgggtaagggaagggcactgtgctgggtatttcatacatagtcgcttttttttttttttgatacggagtctcgctctgtcgctcaggctggagtgcagtggtgcgatcttggctcactgcaacctccacctcccgggttcaagtgattctcctgcctcagcctcccaagtagctggaactacaggtgcgtgccaccatgcctggctaattttttgtagttttagtagagatggggtttcaccatattagccaggatggtctcgaactcctgaccttgtgatctgcctgcctcggcctcccaaagtgctgtgattacacgtataagcaaccgcacctggccttttttttttttttttttttttttttttttggagacaaggtcttcctcagtcacccaggctggagtgcagtggtgcagtctcagctcactgcagcttcaatttttataggagtgcaccaccatgcctggctaccttttttcttttttgtagagatgggatctcactgtattgccaggctggtcttaaactcctatcctcaagcaatcctccagccttggcatcccaaagcgctggcattataggcatgaaccactgtgcccagcacacttctttaacctttctgacaatttgccaaagtattagcctcattttccagagaagaaaaccaggcttagaaaggcagagacttgccctagggcacacagctcttaatggcagagctgagaatctttctgaggctaatacccaagcttttcctaccaccaggcaaaatcccacaacagaatgtcttgccaaatgtttagagacagtttctgatcagagaaccagagagagcttccaggagaacggggcatcaaagctgagctttaaagaagctcagttctttccattcggtatccactctcatctgctgggattccgaccagcctctgatggcctgactgttcaaaaaggcttccgtgtccctttgttctttctgtcattctttctgccaagaatcagctcctatctaagctgactggggtagtttggcttcctaaagtaccactcaggaagcactcctgcagctgcaggatcctagaacaacagaacagacaaggccccctggcactctcctccttccctgggttttgagggccgccatggtgatgagatgagcatggacctggaaggacacaggatgtgtccatttggagacacagaaaagctttcaggaacttggggtttcccaaaggttgggcatgcaggccaaaagggcagaaaacctctgtatctgccacgggcctatattctcttttaagctggggctacacacgtgtcccagcttaacgactccgttgtctgtgcagggtgcccaggagctccttttgctcccagccaattgttcaagccacctctgaggagggctgcaggtctctgtgagccacagacctgaaggtgagagtagtgacagaggcagagattgcacattgactctggctggtacctgggggtcacaacgctgagtgacacaaggactcaggacacctggggcaccagggaggaagacgggccctggcagaatgtcagaggaattcatcggaggtgcgtccatcctgagatttcagagatgagctttaaagcacaaactccaggttcttgttaggggaagggtgactctggtgacaaaaggggcagaactggggaaagattggcttttcctgaagaggattcaacttcttgggaccagctgtgatgtaagacgtccatatctggtggctcttccatggggaagacccatcctgggaagctgcagcccagagatggagccaccgggcagcccagatgccactgagccatcgccacacaagcttggccagaggcctgccccacggtgggcaaagctgccatcgtcctctggcctaccctgtctcaaggatactctcaccactcaccagcaaccaaagcactggtgtggaagtaaagtagatatttgcttttctaatcatcagggtgaactggaatagcaggaaggcaagggcctggggtccagtactgactctctgcaggatgcggggcacagagactctctgcctctgaagactttagtttccttgtctatgaaatagagggttagaacaggatggttccagcaggcctggcagcagtcctagggtcccagttacctctccgtcaaggtgaagtccccgtccttcaaggctggcaccttcttgagggggttcacctgggcaaaggcatcgcttaagtgctgacctgggaagagtccagcatggtgggtggtgggaggagaacgctgagcccgccatggcctgtgcccctccctgcaatgctctggccccagtttcacagttcttcttcccaccagtctgcactcctggttggcaaagactggaagggcccctgcgggaggaggaggagaccactccaccggctggtacaaaatagacaacaccccttgctaagtcctgtaggcacagcctcctcccacaggctgcccctctgcaacagagctcactgtgcagggtgtggttcctggacctttgcatgcaccctacccatctcctctttccactattgccagcttcatgaactcacaatcagagcaccccaagctgcacgataggtcacctgaggggactgactaccttgtcccttccaccattaattctaaggcagggtcatgaaacacagagaagtggtctttttctggtatctacctacttagaagcaacttctactggccccaccatgtccctttgttcaccctgccctgggcactgtggagctgtgtgtagcatacctgctaccaccccctgtgccccaaacttttattccccttacagttggggtctcactatgttgcccaggctggtcttgaactactggcctcaagtaatcttcctacttcggcctcccaaagtgctgggattacaggtgtgagccaccatgcccagcctgctaccctctcttcaccctcccttcagactgttccttcaccaggaaaaccctcctctgtctcctgggaaaacacacttccctctgcaccactacatttgacaaccagcttggacgtcctcttgtcccccattccctttcctctactccacactctgcagaggaagtccttgcgcaggacagtgggcagtttgcagaagagattatgtggagaagtttcaggcagagggccagccatggagtgggagccctgggcagaaggcttagccaagtagagtcgccttacttgccccaccagccatacctggattctgcttccaacccctcctactaccccaccctgcactgggcctgggcctgggcctgccagctgagtcctcaagggccttggaggcatgctagagaaacaaaacagggtgtagggctcatcaagccccagggtccccctgctgcttccagcatcagcagcctggggcaacctacctccccagcaggaacaagaggcagaggacaaggtttcgggcggcagaggttgcagtgagctgtgatcctgccactgcactccagcctgggcgacagagcgagactccgtctcaaaaacaaacaaacaaataaacaaaatgccttgggccaggcacagtggctcatgcctgtaatcccagcactttgggaggctaagccggcagatcatttgatgtcaggagttcgagaacagcctgaccaaaattgtgaaatcccatctctgttaaaaatacaaaaaaattagccagacatagtggcacacatttgtaatctagctactcaggaggctgaagcaggagaattgcttgaacccgggaggtggtggttgcagtgattcgagatccgtgccactgcactgcaacaaagcaaaagcaagactctgtctcaaaaaaaaaaggacaaggacaaggtcagaggcaaaacaggaggaacagaggaaggaagggacaaagagggaccccaatgcagactggacgagtgcagagggcagggatggaaagtcacgtcctgagctgtttgctgttgcagaatctcagcagctgggccataaagaagggacttgacgctgtcccagtctctacacttggcacccttgacctctctcatcccacctttccctaggccgaggtcacacctgctttcattttgtttttttttgttttttttttttaagacggggtctcgctagattgccctgacgggagtgcagtggctattcaagggcaccatgatagtgcactgcggcctggaattcctgggctcaagcgatcctcccaccccagcctctcgagttgctgggactacaggcgtgtgcccctgcacccagctgcgcccgtttttgtcctcctgtctggcttctcttcatgatccccacccctttattcggcctcaggggaaccccgtggtctattccgtgagaccgagcagagttttggggagccccgactcttggatctccctgctggctcacctttctctgttcggtctccaaaccagaccagcaatggccccaggaagaaggtggcgctgggagaagttccctaagctatgtatgcctacctgtccccttcctgacttttcggttccccaaacccgaggctggacctacctttaatcagatccacgatgcgcagctcgaagggaatgtcgttcttcttggcaaagatgtaaacagcgcggcagggctgggacagcaggtccaggtacagctccaggcccatagtggggaccgaccgacctgaccggaaaccagagggagtcagcaaactccagtgccaggactcgggtctcggacctcagaccacgcccctgcggctacgcaccccgaccgctgtgccccattgggcggcacggacgcctgggacactctttagtccaattgcgggcggcgggcggcctgtctcagggctgggcccgcctggctcctgtgggatcagggtgggtggccaagagaccgttgtctctcagggggacgcacagagaggccccagtcccatccctttcgtgcctggctcgctcatttcacttagcataatgtcttcaaggtgcatctgtgttgaagcgtgtgtcagaatttcccaccgtccgcattttagaggaggagacagacactgaatgattatagacccagaaagtctggctccaaagtccatcctcttggctcaacactgcagagtccttggtgccagcaagtggcaaagcctcagggcttacgttcagtgttttgtggtcactcgcttcactgcagtcgcactccctggaatgtcacagccttggtcttcctgcccctgccagcacagtgccatctatcgcattccctgggtttatttcttcctttctccaggcctgtgtttctccatctttaaaatgacagggaagctagagccctccagagtccttgcaagtccacccccctggattcatctgctgagccgtaagcccaggcctgccccttgctgccatggagcctgtcaaatagtatcagggtcacatgtcattttctaaaacgaatcccactgaaagtgtgtcagccaacgcataatgttttctagagaataaggaacatttctgcaaataaagtggaagtaacaactgttttattttatttagatagagtctcactctcttgcccagggtagaatgcagtggcatgatcacagctcactacagactccaactcctgggctcaagccatcctcccatctcagcctccccaagtagctgggactacaggtgcgcacaaagacgcccagctagttaaaaaaaatttttttctgtagaggcagggtctcactatgttgcctaggctgatcctcccacctctgccacctgctgggattacagatgtgagccactacaactggccagtaataatgatttttaactggaaaaaaaattaaggaaagatgagaaattcagatttccatgttaaagttttgaaaggaggtagacactcagagaaggcaatggctgccttatcctcacctctggataactccagtcagaggcccaaggaggagctgtcaggattctggttcaaggctcagcctgtcttttaagttcaaaacctaatttggggcgggagtggtggctcattcctataaccccagcaccttgggaggctgaggccggcggatcacctgagttcaggagtttgagaccagcctggccaacttggtgaaaccccatctctgctaaaaatataaaaattatctgggcgtggtggcatgcacctgtaattccagctactcaggaggctgaggcaggagaatcgttgaactctagaggcagaggttgccgtgtgccaagactgcgccattgcactccaggctgggcgacaagagagtaactccaactaaaaaacaaaacaactaatttggtccacgtttcaggattgatcattttctttgggtctgactcacataaaccaactcacaaaggctgtatttattaatttatagaaacaagataaaagtgagagtgtgtgggttggttcgtttgtttgttttttgactttgcccctctctgtcactcaggctgaagtgcagtggtgcaatctctgctcactgcaacctctgcctcctgggttcaagcgattctcgtgcctcagccacccgggtagctgggatttcaggcatgtgccaccatgctcagctaattgtatttttagtagagacagggtttcaccatgttggccaggctggtcttgaactcctggcctcaagtgacctgccagcctcggcctctcaaagtgctgggattacaggcgtgagccaccgtgcccggcctagaaagaagagaaaagtcatttagacagaatgctcccaaccattgctcagtgctctcttggcagtgtagtctcctaggaagcctcgtgggtgttactggccaggaccaggtccgttctgcccatgcacagtaaattaatcactgtgacatgagttttgcaaaagactaaagatttattcacaagggtgccaagcaaggaggtaggataatagctctcaaatccacctccccgaaaataaggcttagggataagccttgcttccaagcaataaagcacagaccccagtcacactcaaggggagggggctatacaaggatgtgaataccagtctgcctgcctcgtgggcctacaacgcagaagggccatgcacttggtttaaaactttgttgttgctgtcttgacattcttaacaatttaaaaataagggtccccacattttcatgtgtagccagtcctgtccaaggagtccaaagaggtcatgagggtggacaggtcactgtctcctctgggcagtgatggggccactagcagttgttctgtagtctcctagcccctaccccagggccacaccttccccatggtctctcacattcttttttttttttttttttttttttttgagacagggtcctgctgttgcccaggctggagtgagtgcagtgctgcaaactcagcttactatagcctcgacctcctgggctcaaacaatccttctgcctcaccctcctgtgtagttcggatcacaggcacatgccaccatgcttggctaattttttgactttgtagagagggcatcacactttgtttcccagggtggtcttgaattcctgggctcaagtgatcctcccacctcagcctcccaaagtgctaggattataaagatgtgatccgccgccccggcctctctcacattcttggcatttaaagttaccgtcattgacaaggaacatgggtacactccaatttactcaagaaaaaaactcttttctccattgaagagatatgtggcctggctgcttcctactctagttgaggtcttctttttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagcagcagccttgcctgggagcttgttagaaatatactaacaggctcccacccccaaacccagacctactgaatcagacagagtctgtattttcataagatcctcagatgatccaaatgcgccttaaactttgaggagctttgatccagaacctgggctggaggcccctgggggccactctgttcctcacagactgcaaggtatgtttttttcttgcctcttctctctgtcctaatgtctccttctctctgtgtctgaccctgaggaccctatgacatcttcccaggggagtttccactgtcaaagagctgattctctctctcttttttttttttttgagacggagtttcgctcttgttgcccaggctggagggcaatggcgtgatctcggcttaccgcgacctctgcctcccaggttgaagcgattctcctgcctcagcctcccgagtagctgggattacaggcatgcatcaccacgcccagctaattttttgtagttttagtagagacagggtttctccatgttggtcaggctggtctcgaactcctgaactcaggtgatctgcccacctcagcctcccaaaggcatgagccaccatgccctactgccagaggcctgattctctagaatctgatgggctcttctagacagcaatctctacctgggctcttgttgaagaagccaatcagctcattggttggaggtcacatgatataaaacatggccatcttccaagccctatgtgtggacaacgagatagggacaagtaggcatatcacgttctgatacctggacccacatctgtcgctgggcccacgtctgtcctcaggcccccaggatatacttttatggggagttttcctcccttcccccaatgtggtcactcataactttacacccaacagtcaaacaggagtggaagctacagagtttcacgcaaacaataggctaggctgtgggactgagtaaaaggcactggactgtggtaggtcttactccaagatggccaaatggaagggcttttagctttctttgtttttgttttatatcctgagacaaaatgttcaatttctacactttagaataaaaagagccatattttatgtttcatattttttgtatgcttcctttcatactcttttgaacaatgcaatcatattttcattatgaggtataattcacataccataatatccgctctttcaaaatatactttaaaattcaattggtttaaagccaattcattggtttttagtatattaacaaagttttgtcaccatcacaattatctaattctagatcattttcatcacccctaaaagaaactctgtacccattaaacagtcactccccatttccctcttctcctagcccctggtaaccattcatctactttctacctctgtggacagtaagtatctgcctattctggacatttcattcaaatttaataatgaaatatgtgagcttttatgactggcttctttcatttaacataatggtgtcaaggttcattcatggtgtagcatataacagtacttcatcccttcctgtggctgaattatattccattttatgtatacaccacattctgtttatccattcaccagttgatggacttttgcattgattctacttttcagctattgtgaatccccatgctgtgatgaacattcacgtacaagtttttgtctggacatatgtcttcagttgtcttgggtatacacctaggaatggaattgctggataatataattctatgttggccgggcacggtggcacatgcctgtaatcccagcactttggaaggctgaggtgggtggatcacctgaggtcaggagttcgagaccagcctggccaacatggcgaaaccccgtctctactaaaaatacaaaaactagctgggcatggtggtgcctgcctgtaattccagcctgtaattccagttactcaggaggctgaggcaggagaattgcttgaaaccaggagacggaggttgcagtgagccgagatggcaccactgcactctagcgtgggtgacagagcaagaatctgtctccaaaaaaaaaaaaaacaaaaaaaacaaaacaaaactaacccatatatatataatatgttatatatacataataatatattttatatatatgtgtatatatgtttaacttttggaggaactgcaagctgttttccaaagcggttatacattttacattctcagcagcagcacacaagggtttcaatttcttcacacatcctcaacaatacttttaatctgtcttttctgttatacccctcatagagtgtgtgaagtgatatctcattgtggtttgattggcaatgtcttgattatagtatctttgtactaagttttgaaattgggaagcatgagtcctacagctttttctttttcaaaattattttgaagattctgagtcactttaatttccaaatgaattttagggccaatttgtcagtttgtgcaaacaggccaagtggaattttaatgcagactgtgttgaatttgacatcttaacattactacaccttccaatcatgaacatgggatgtctttccatttattaaggtcttctttaagttttcccccaacttttaaattatgaaaacatttaaaatccagaaaatgaaaggactagtacaacagcactaatatatgcaaccccagtttcaacttactgttttttgaacataagataccaacatcatgacaccccacctaaggactttttagcaaaacattctaatttctctactgggattattgtttgttgtcttcctccacaataatgtgagcactaaaggtagagacttttgcgtactttgttcactactgcttcctctgcaccaaaaacactgcctggttgtgggtacttttctagttttaggaaggagaagacaagatataggtcctgactctggttctgcctctcattcatatgctactccgaggatcccttccccttgaagaacttgtttcttcatctacgaaatggggataatactactactcatcagggtggttgtgaggattaaacaaggtaagagatgtaaaattgcatgttagttatcagatagttttgttttcccatctagctccatgagggagaggatttgctctagtccgtccgtctgggctctgggcttctaatgggcagacaccttcctccatgatgtttgtagctgcaaagcctggcacagtccctcaagacaagctttttgacttgaactgctgatggtcttccatgcacaattcaacagaaacccagtagcatacacttccttgtatgcacttgcccctctttttacatttattacacattcattgctacctaataatccccgatacttatcttttactttatccaattattcaacagttttcaacagaaatacctagaagagagctattccgacttcattagaccctgagattctatttttaacatttcttccatggattgttgaatgtttccaatgattgatccaccttcccttggcct

SEQ ID NO: 516 - DNA, 81564 bp, Homo sapiens
ataaaaaagtcatgaccgtccctatcttgccaatctgccaggactccaaggggaaaaagcggataagtatccttcaggagacagagaaaaagatatcatcagctccttggctaataccacatcttgcaagacccctgccaggtactcccactgtgggtactcaggacagcctgcctcagtccaccaggcattttgcaaacctgctcatcccaataatgattttccccaacccccagcagggcagtgggacactcaggtgtgggaggtagccgcacatcatgacccagctaggacagacacacaatacagtagcctcggtgtgtgtgccgtacactctatcatctccatcagtttgtgtactgaggggtaccctgcctcctaattgcaggctccctaagggcacagtacctcagccacctgttttctcaaaggctgagcacagggtgaccccccaccccaccaaccccgccactaatgtctgggccataagtgaacatgcccctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatgcaattatcaattttttttcctctaatatttcaatccatggttgtttgaatcaacagatgcgtaacccagtgatacagggggctgactgtattattcctctgtagcttgagggaggacccagcaggatcagccattcctcatcgaccttcatggactaacaaaggctccatttcagaaggtctttttttgtgagccaaggtctcactgtcacacaggatggagtgcaatgcgcaatcatagctcactgcagcctcaacctcctgggctgaaaccatcctcccacttcagcctgccaactaagtgagactacatgtgcacaccaccatgtccggttaatttttaaaactgttttgggggatggcatctcactatgttacccagactggtctacaactcctgggtcaaatgaacctcccgccttggtctcccaaagtgctgggattacaggcatgagccaccgtgcctggacagtgtcctttcaagcttctcatgcccttacttcctcctagacatggatgtggctcaagaatatcttttacccaagaggaaactttaactcggtcacagaacgccaggtttgggttgcagacgcttcttgtgggggagggaggtcttttcccctgtattcacagaagaggaggttgccaactggagatggttcatttccaagtttgtctggggtcccccagctatgcaggacccagaaagcagatgtctagacatccaggccaatggtctttcactactctgtgagtctcccgtgaacttcacctggaacctggctgggacacaggtccaaaatacgtaacttcagaacatacccagaattccttctgaccagcctggaaaagttctagaaaatcacacttcagccacgtgtacctaccctgtcaggtgccaaggcaggtacagcacacagacaatcccacatgacccttgcactgccccgggggtgttaaaagagagccttcccggttcacagacttacacactgaggagcagagccagaaattcattcaatcctgctcgcactttgaagatggtcctaacagcaggaacctaaggggtcagggggccccaaagctccagaccctgatgtgtccttactgggcagggcaagaaatgggtttttccccctgaggcaggatcagtggctccagtctgcggcagtcccacatggatcccctactacccctacgcaccggtcctggcccagggctagctccttggtgagaaactcaaagaagtgggcgctgtggctgcggttgtcctcggcggtgcccactacgccgatggaggagatggacagctgcgcgcagggctcggtggacccgctcagcgccatggccaggcccggccgtaccgtcacgttcacgcgctgagggggacatgaaaagttttgcccgaagttggagccggccgggctacctctggggacgggacccgagcgcgcgaaagccgaaacgcgcagtgttcgcggggcagggatcccgatacgggccgcggtccctgaaggtcacgcccgggtcatgactggggagggcgacaagggaaagacgtgcggagggggagccgcgggatcgtggagcacggaaagtcagagcttggcgtgaggaaaggagtggggagtggtccctggggaaaagattcggggtcactgtcggggaggcggagcagggacagggccggacccctggcccaccaacctcccctcgccccgtgctgcccggcccacgcttacgtccgcaggtttgcccaggatggaggcagcggcggcgcagagtcgtttctccagccccgcgggcactcggttggcgggcaaattcgtgtccagctccaggaacggcatggcgggcagaggaacggaaacagctctggcggaagaaaagctgggggtacccaaggctcgcggaccagggaggaggggcgaggcgccacagcaacctggcttctcattggctggacagagactcggcgctccccgattggctgcctagggtacctcccgcttctgcaaacaaaagtcacgtgtgccggctgatttccggaagtcccatcgtctccgccctacgtgtagccccacccactacaggtctttaacccggtagtggacccaccctgtctcccccgaccctcctgcctggcgccaggtgggtttccctctcaagcttccgcgctgtggtcgcccggttcctagccctattagaggtctgaacaccacacccccgacacacaaggacacacacacacctataggggtcttccccaggctcgaccctaataaccaatacaacgggagcttaaagtttttttgaatgatttgccaccatttcgaagtcaggcaatttcatgttcagtatggaaatctgcgcttgggcagtcaggagatgtggttactcgcgggggcgcgggtagggctaggctcacgacaatacctgtccctgcctggtccccattgacatctgcctgtgtagcctcttgtgccggtggtgagccactgtccaccagggggtggcaaaatatgttctttaaaacatggaaaggccgggcacggtagctcacgcctgtaatcccagcactttgcgaggtccaggcgggcggatcacctgaggtcaggagtttgagaccagcctggccaacatgacgaaaccccgtctctactaaagatacaaaaattagccgggcgtggtggcagacgttgtaatcccagctgctcgggaggctgaggcaggagaatcgcttgaaccggggaggtggaggttgcagtgagccgagatcgcgccattgcactccagcctgggtgacagagcgagactccatctcgaaaaaacatcagaaaacatggaactctgttggcgtggcttaaacatgagtgtggtcagtgtggcaaaatcacttgaattgtacattacaaatatgactgaagttgtggtcgagcaatgtggctcacacctgtaatctcagcactttgggaggctaagaagggaggattgcttgagcccaggagttaaagatcaggctaggcaacatagcaagattctcttctttattttctacaaaaaaaaaaaaaaaaaagaaagaaatctgggtgctgtggtgtgtgcctgtagtcctagctacctgggcggctgaggcaggaggattgcttgagcgcaggagatctaggctgcagggagctatgactgtgccactgcactccaccctagatgacagagtgagacccaggctcccccctcccccacaaaaaagaaagaaaaaatttgcaagtttatatgtacaatttcaactacgtgtataaaattctctataagtgtgcatacttaaaggagcctccactgaaaggccgacagagtctctgtctgtcatgatcttgtcctattagcagtttgtttattagatgactcagatatcagaaggtctgagacacacgacaggtaaatatgacagtcctaaggggagagggcagggacaggtggcaagtctgggaccaggtgtggggcatggacaagccagtggtccgggagtggggtgtagagaagactgtggtcaaggttatgaggaggcatgggagagggccaggaaataaccagggacttcccttcctgcaaggaggttcatgaaccagccctgcaccccacttgtggaacacaacatcgccccacagtgaggagagagaccgaggagaccaaggctgatcctgattcagacatctttccaccaggtcacccctcatcgatgatacatgctcagtccgggggtatcccccgcaaggaaacactggggctgaggagcccagagaggtcgcctgacctggactggggctggggaggtcagggaagtctccctggagaagagacagggtgccaaatgccaaaagaccaggaagggcaccaggcgaagatgaggagggaacagcatgagcggaggccaagaggccaaggtgggagcccagagaggggttaggagtgtgcaggcagaaggggccacctggaggagtgggagcaaggccttgaatgcaaagttcaatgacttgtactttagcttctgggcagtgaggaaccatacaaagttccacacagaaggtcagggtcaagtaagcgtttgcccaagctcttttcagaggtcacatggaagctagaatggaatggggtaggagacaaaaggaatgcaggcatgatatctggaggaactgtggaccagagcctttgcagatatgtcttctcttcaaccaaggagacggacagctccatgtctttattctaccaacacagcatcccctcagtggctcagcaagtgtgggacacgcactcacagcaagaaaagctgcattaaggtcttcagattctctttaacagcaggttctactggaggcaggtccttggccttcaggacagctgggagggcctcctggaagaggtcctcccgcactgcagcctccacgtgttgggcaccatgctgccaccgtgggtccgctttcaaagactcagcagccagcactgatgggctaggggaagacagagtcagcggaggggctgggcatagccaagtgtaaggcagcatgacctgctttaggggttctctgattggattttccctcctccaccatgtgtgtgatgggctaggatgtccccctccctggggacacttggaagcctcttaatatagctgcggtgaggggtttgtaaagccccattttatagatgaggacactgaggctcagaaggagaagtgactcacacagggtcccacagccagaaaagacaacatgagctgggatgtcagctcccttcccggatacaccactgcccagcgggccaccgcaccccatggcactctcatgcctcagctccgtgattgccaccaagccagccacagagatacggggcccagtaaggaaggcctggtcccgcaggaacttgtcctcgagcagctgcaggcatccgtccagctcagccaaagtggccgccaacatctcgggtggcactgactcgcccaggaacacagggattattatctggtgggccgacaggcagagagaggggtcagggtctgcccaaagcccatcctggttcccaccatcatcctatcatcaccagtccttgggatttctgctcacctctgctcacttctttccactcatagccaccagtagctctcatctcctactcaaacagggacagcctcccccttctccctgggtcctcacacaaggcaaccagtgggatccttctgtaatctcaatctgcccgtaccctctcttgcataaagccttccatggctccccactgccctcatgagaaaggcctcaacacaaagccagccttctccagtgcggtagccatcccctccccacttttcacctcacctcctactaccccccacttatcaaacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaaggcagacacagttaaggtgtggaaacctccttattgcccgatggatcctccagagaggcggtcccttactttcagcagggcgcgtgtctacctgtttcatgctgtctcacacacagggtgccacccctgtgctgggcactgggtaagtgctctgtacatattaattaggagtactcatttcaaaaatatgtgtgcctttgataaataaaaacagtatgtgcatgttgtgttggtgtgtgcttccttgattattactgaagttaaacatgttttcatccatgtattgaccatttctctttgtccttcaatgaaacctctgctgatttccttcgctcatttttttcctgtgtcttcgtctgatgagtttctcttctttttgtttgttcgtttgtttgttttgagacagtctcgctcagtggcccggctggagtgcagtggtatgatctcagctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtgagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttaaccccagccttccagtcaaggttcccaccagtttgggacacctgcaagtgtcacatcccactgggtgaaactctaagatcccttttaggggatcccattcgctccctcccttccgccaccatgcagcgccgagaaacagagctctgaacgaaccctcagatgtccgtgcgctggggcctttccaggacggcggcgcccagtcgtttctgggtcagggcgacgcctggaactgggcagggtccctggcaccgggatcccgaaaagcagacctgcttctccctgtccagccggttccccttccccttgcagtcggccccctgcatccgcgtcctccctgccagtcgagggtccccagctccaactccaccctcccagctgtgcgttcatagcgaccgccctccctgtagggacgcacggatctggtggtggagtcttggccggcaggactggacaggaaccgaaggggcgaggcgggtccgggggtggtgcgctccaattgggtgctgtccccagggggtggggcctgatcccctatttcccggcgcgccgggatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaaggtgggcccagcccgtttccccgcgtgtccacaaacccagtgcacccccaggcccccgccctgctctgccctgagcgtctcgccgcccgcacagccccctcacctcctcctgcagcgtctgccaccagagaatgctgtggactgagtggccttgaagggatcacagcctctctgaaccttagcttgccttctgaaaaggaggataacgttaccttctgctctgtagggatggaaagaaaatactgaatggagttgacagagttcttgcgtggaatgcacgcatataaattcacaaagcccagaagacctcgggaagaaggacatactgttgtgagaattaagagatgggaagagatgagccaccccagtttgcctcccctcccctggcccaccagagtccggctagaaaacttctctttatccacctgctgcacctggccccacccaccaaaaccccccagctgccccggaatgtggcagggcagggaggcccagccagggagtgaggctgatccaggcctctagtcccagaccttgctgtttctcagggctgtggggctccgcttggggaggaggagggagggtgtagaggtgcagcgtttttactctgaagaccttttctgacttcttcctcttcagggcagcacaagagcaaggagttcttgcagatcaacagcctggggaaactgccgacgctcaaggatggtgatttcatcttgaccgaaaggtgccctccttccctcacccctcaccgcatccggagcccatgtgaccttggctctccccactggccccgggccccagtggccctcccataccccatggggcagcgagggaggggaaaggcgagggatctggccgggcgcggtggctcacgcctgtcatcccggcacttcgggaggccaaggcgggcggatcacgaggtcaggagaccgagaccatcctggctaacaccgtgaaacaccgtctctactaaaaatggaaaaaaaagttaaccgggcgtggtggcgggcgcctgtagtcccagctactctggaggctgaggcaggagaatggtgtgaacccaggaggcggagcttgcagtgtgctgagatcgcgccactgcactccagcctgggcgacagagctagactccgtctcaaaaaggccgggcgcggtggctcacgcctgtaatcccagcactttgggaggccgaggtgggcggatcacgaggtcaggagatcgagaccatcctggctaacacggtgaaaccctgtctctactaaaaatacaaaacattagcagggcgtggtggcggccgcctgtagtcccagctactggggaggctgaggcaggagaatggcgtgaactcaggaggcggagcttgcaatgagcagaggtcgcgccactgcactccagcctgggtgacagagggagcccactccagcctgggcgacagagggagactccgtctcaaaaaaaaaggaaagaaagaaaggagaggtatctggggagaaggtacagcttggggtgtgtccgggatgagcaggggctgacagaacatgtccccccacctctcatcttcagccttttctgagccgcagggcctctccactcccagactgaagggtattagaagagaagacaagggaacatttttccactgttgcgcatttgttcaacaaatgctagctgaaaagagcctctagtgacttgtcgcagactacccaatctacccaggccgggcctagaggccaatgccatggcccaagggcacagctcatggtgaggtccagctgctgggcaggaaaaggacaagaggtcaggtggctgcagaggtgatggctgggggcctgtcagacgggggccaaagacattcctcccctcgtgatccctgacccaagcgcgtggacatgcaagggactccacggagcatccactgtgtgccagccccatgcagggttccaggggtccagggagcctattctgagctgcaccgcctcggacaagtcacttgaccattctgaccttgagttttctcttgtgctaaaaggctaacaggagtgtctacctcacagggcggctgctggcatatcacagagatgaggttctcaaaatgcaaagcagaaggtccagccaagagtcggtgcccaaggcaacaaagacaggaggagactcgtaggaggagggggtggtgttggggagctggagatggagggcgaggctggagggcagtccttcaaatgcagagaagcccccgggccccactggcagatgggagcagttaggggtaaatgcctggtgccagtgtccttatagccactgcccatttgttcccagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgaggagagccatctggagagtgattggccatcagggagtagttggcagtaggccggggccatagactgacccactctctgcccccatcaggtgttggggccactcattggggtccaggtgcccaaggagaaggtggaacgcaacaggactgccatggaccaggccctgcaatggctggaggacaagttcctgggggacaggcccttcctcgctggccagcaggtgacactggctgatctcatggccctggaggagctgatgcaggtgtgagctcagcctgtgggcagtgtccctcttcgtgtcacacccatgaggcagacagaaacactgaggactggagaaagccagaactttgcccagaatcatagagcaagtctctggatgatctggggccagaaccctgaacttctgcctcctgcctgggtgtggggtctcaccctggctgctcttgggctctaaggctgaacatactgcctgggcccctgtggtccattcacttaggggctggggaatggaccatgtctctgatacttctgcccatggttccagcattcgggtcggcagtgacaactgggaaagttgtatgcccacaactttttcatccttgtccctacagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaaccaagagttattggttttactacattgttgtgttatacatatggagtaaaagtatgtgctagtaatcctcatcatggttaataacaaagtaacctcacaataacgagtcaacataattgtatcaccagggcaacaaaatgttaagtaagtaaccaattcgaattgcaaactgttaaaggatataggcgatgtttcacagggcatagcaacggtctttgaagtctaggaaacttaaaagatttcttttaacaagcattcatgtcttctaggacagttttgtaataactgcaaatagtaagattatacattgtcacacagacctccatgtatatccatgggatggaccccaccacaatgattttaacggagagaacttgatataaagaattggtaaccaggcattagagaactccgaagacagagagaatccagattaacacggaggtaaacactgcaagaagctaccacccctagggctgggggatcaagggaggaattaggaagaccaagatgctggaggggccctgaagaattcaaacctccaagaaaggtgttgctcatcccccctagcatcaccttccaagaagggcaggtttccccagtttgccctgaggtcttcacaggaggccatgtggctgtggatgcagttctcaaatgtgacagtagatgtcactgctgaccaataaacaggatgttccagacacactctgcgctacctgcccacatgtcttgtggctttggggcctatttcccatgcctgacctgtgcccaccatgtgccactctattgggggacctgccccaataatcacgtagattgtttcctatttttcctaagtgtcggccggcttgagaaataaagggacagagtacaaaagagagaaattgtaaagctgtgcatccgggggagacgtcacacgttagtaggatctgtgatgccccacaagccacaaaaaccagcaagtttttattagggattttcaaaaggggagggagtgtgcaaataggtgtgagtgacagacatcaagtacttaacagggtaatagaatatcacaaggcaagtggaggcagggcgagatcacaggatcacaggaccgaggcaaaattaaaattgctaatgaagtttcgggcaccattgtcattgataacatcttatcaggagacagggttttgagaccaaccggtctcaccaaaatttattaggcgggaatttcctcttcctaataagcctgggagcactatgggagactggagtctatctcacctctgcagtctcgaccataagagagaggccacgcccggggggctgtttataagccgatacctccaggtgcgtattctctttctcagggacattccatgctgagaaaaagaattcagcgatatttctcccatttgcttttgaaagaagagaaatatggctgtgttctgcccggctcaccggtggtcagagtttaaggttatctctcttattccctgaacaattgctgttatcctcttcttttttcaaggtgctcagatttcatattgctcaaacacacatcctgtacaatttgtgcagttaatgcaattattaaagggtcctgaggcgacatacatcttcctcagctgacaggattaagagattaaagacaggtataggaaatcataagggtgttgattggggaagtgataagtgtccatgaaatctttacaatttatgtttagagattgcagtaaagacaggcataagaaactataatagtattaatttggggaactaataaatgtccataaaatcttcacactccacgttcttctgtcatggcttcagccggtccctctgtttggggtcactgacttcctgtaacaccactcctagccggaagtattccaagtaaccattgcaactgtcctgccttaagggtgcctggtgatggcttctgtcttaggtcccattctggctctctcttccagtgatttctcatactttgggggacactctggcctgctttcctgggccttttccattaccaccccctctccccatcaggcactggggatggcggccacagcctatgccttcttgatccatgctggctgccttgggattgttccttattggatggttttgctttcaacagacactccaataaagtacacgaaataaagaataaagttaaacagtcagtccccgtgctgtgtaggtggcagtaagtctgggagagcgacctcagctgaactaaccatgctgtgcatcattgtcaagcgggaccagcaggatccttaggtcacctggcaggaggaggggcagggaagggtccctagaagtgatcttgagttgcacttagtgctcttggcagagggaagggcttgggctagtgctggaggcatgaagatggggtgtgttcagggctctccagcagtccaggcatgggaaggggacgctgagggccaaaggctaaggtgacactgggaagggaaccatagcaaggtgaggaatggctttcggccatgtgactgaattgcctgtgtgtggtgcgtgtgtacgtgtgtgaatgtcagtgaactgtgtgtgtgaacgtgagtgaattgtgtaactttgtttatgtgtgggtgtatatgtgtgtgatgtgagtgaactgtgtgtatgtgggtgtatatgtgtgtgatgtgagtgaactgtgtgtatgtgggtgtatatgtgtgtggtgtgagtgaactgtgtgtaagtaggtgtatatgtgtgtgaatttgaatggtgtgtaaatgtgactgagcagtgtgaatttgtgtatgtgggtgtatgtgtgtgagtgaactgtgtgattttgttggtgtgaattgtgtgcctgtgtgtgtgaggtgtgtgtgtgtgtgtgactgaactgtgtgatgactttgtattaatgtcagtgaatggtgtggttgtgtatgtgggtgtatatgtgtgtgtatgtatgtgaattgtgtgtggggttggtgtgtatgtgtgtcaatgtgagtgagttgtgtgactgttgaatatgagtgaattatgtgattgtgtgggtgtatatgtgtgtacaggagttaactgtgtgactgtgtgtaaatgttatgattgtgtgtgtgggtgtatatgtgtgaatgtgatacatcgtgtgactgtgggtggacgtgggtggatgtgtgtgtgagtgtgcgtggctgtgtgtcgaacagtgtgtgagtgtaagtgtgcaggtggtagctgtggaattaaggcacattaggggaatccttccttggctctggtccttggtttccctcctatgaaacaagttgggtgaattaggcagtctctggcattccaggatttggtctcaggtctaaacaggattttgtaaagtgaaagcagcatcccttgggcatcccgggaggtgtccctgccctccatggctcaccttctgccacatggcccagcagcagctactctgcagggccatgtgctgccatgacaggtactgatccccatgggcgcgggcctgcaggtcctggaggtaccagtggtcaggtgctttgtacatgcagctcatatagagcaagctagccacactggggggacatggcaggggcagaagacatgccctgaacactcttcagccattttctggggcattttcactatccccatgatgcagaggagggatgtgaggctcagagaggttaggtaactgcccagggtcacacagccctacacggggccagattatcatctcaactaatggcagcaaggaagaaacaaaatgtcatgaacttcagcaggggctcagggaaggcttccaggaggaaggggcacccagtgtgagtctgaagaatgagagcaagttgggtatctccccaacatatccaaagcatggacagggccaggagcaaggccagcagggagagagccttccaggtgacatggcagcattgctccccaccccgtcccatctcctgttcacctatggtgaagggttgtgcagtctgacccccagagctcatcatgcctctatgggtgttggaccatccagtgatcccaggctctgaatgtgaatccagctccaccaaggaggcactatgtggcctcggtaaaggacgccaccatgcggccaccaacctggaggctggttttggctttcatttttcccacccacctccaacccttcagcacaccctgcagttagagtttcaagaaaagtcagaaccgaccatcaccccaccaaccctgcaccaccaccaccttggtctggggctccagcgctgcatgccagatgactgcagtggctttctcacccctgccagggggatcctttatgacgtaagtcagatcacagttctcctctgctcaaaatactccagcgactcaatccccctgcggtaagagccaaagccttcccagtgtcccatgctcccctctgtcgtgacctcctgctcttcctgctcactacacccaccctggcccgttgctctccagtctgaaccccatgcattgtcccacctggagccttcgccctcactcttccctccagccagaacacccttctcctcatgccttgcacattcctacagctctctgctcagatgccacttcctccagggagtcttccctcaacatcctactcacacacccccaatcttaccctgtttattttttccatggcatccatcaacatccgatatgttccatgtttacatgggttactgtcagctcccccttctattaatggaatgtgagatccatgaggagaaggacgtagacacgttcactgctcaagccccagggcttaaatggggtctggccctggtggatgtttagcaaatagccactgaagctcgctgagtggtccctcgactctccagggaaacagcacttgccccacaggatttgtgggcaaaatggtagcactaagatgcctggtacagccgctcctcgaaacttagcactctccttttttcggaggggaaggctggcggtgaggaggcccggaagcagactgggccctgtggccttgtgcaagtccctcccctcctccagcctcagtttcctcacttgtacaatgcaggaggggacttctataacccttgtcaacactgggcaccactgcctgcctccacccattcttcaccctggggctggtgcagggcccacagtccatgatccaagccatcaacagtgaacagacagccgactggccccacaaggcccggcagcagcccacggaccggttacctctcagccaaggtgaagtccccatccttcaaggcccggcaccttcctcagggggttcacctgggcaaaggcatcgctgtgctgctggcctgcaggagagatcagagaggtgagtggggataacccagagttctctgaggtctctgcccacccccaccccaaaatcccagcagcagctttctgaggcccctatctgggaggcatcagggaagaggaagcctctctgctagtcactgggtcacagaccttgaccccatcagagggccatctttcctgtgtccagctccttgaagcatggctcaaggacaattccctggagctgtaattcacaccccacccccagccagttccatccataggtcagacccctccagcctcctccctgggctctaggcttgccccctctgattcagcttcctatcccagctggggacttaggccctactggccaggctgggtgacctgtcaataccccagagtcccagccaaacatgttcccaaccctcagaccaacctcattcttgctgggaatccctgccccattcagccactcagcccccggtggctcagctcttcttcctttcttatgccaaactctcaaggctccctccccactgggggttcccaggtctgactcactttagcattctaggccagtgctagaggccgcattaggtgcctggtgtttggatcagaggacctcagtcaagccaggctccagtctgatcataggcctacatgtgggcctctttgcccttctactgaatggacatgcacacccctgcccattctccctccacagactgcttctgtgtccagcccctgttctgtagcaggtgactcaagctggttgtaccaagggcagcagttgggaagagtcagctgagcagggtcctccctctggcctgcccagggggctctggctctgctctctgccctactgcttagttatagccctgcctcctccactgaattgtgctccagctgcatctctgtatgccagccagaccagcaaacgctggagctcagggtgagggtgctggcctcccccactgccctgccacagggccctccagcctctagcctctaggagtagccccttcagctgggtgagaagccccatgggatagagcaagtcagatgcaggaaaaagaaaagacagaagaatgccaagaaatacataaaagtggaagagacccagggccagacatggtggtgcatgtctgtgatctcaacactttagaaggaggaggcaggaggatcacttgagctcaggagctcaaggtcagcctggtctacatggcaaaatcacgcgtctacacacaccaaaaaaaaaaaaaaaaaaagtagctgggcacggggacgtgcctgtagtcccaactattctacttaggaggagtaagttgggaggatcacttgatcctgagaggtcaaggctgcagtgagccgggatcatgccactgccctctagcctgggctgcagattgagacactgtaataaataaataaataaataaataaataaataaataaacaaacaataaaaaagtggaagagacacaggcaggggtagacagggactattttacttaggaaacaacgaggcagtttgttttttccaagcacatggggtgaagatattcttgccccactccatttccctaccctcgttctgtgcctgctgtgccctctctaaacctgtattttgaagaatgttttgtattcacaagcaaagatcaagcctctattaaaatagacaaccagtggggcatggcggctcatgcctgtaatcccaacactttgggaggccaaggcaagaggatcacttgagcccaggagttctaggccagcctcggaaacacagcaagacctcctctcaataataataataataataataaattggccaggcatgtcggtgggcacctgtagtcccagctacttgaggggctgaggcgggaggatcgcttaagcctggaaggtcgaggctgcagtgagccatgattgtgccactgcactccagcctgagtgacagagttagatgctgtctccaaaaagtaaaaataataacatagataattatgtaatagtttccacaccggagagtctgattcttcgtgttagtctgcattcttggcccgactgcaaagcagcggggacaggcagggattcgtggccaatatcccctgggcctgcctgcccagcccagctttggtcagctccactgtgcgaagctcgaaggggatgccattcttggcgaagatgtagactgaacggcagggctgggacagcagacccatggcgggggcaatggggtggggcgtcggagggcagacctaaacccaggggacgggccctggggacaaacccggggacaggcccgggaacaggaactgcgggcaggaatggctggttgggggcggcggacaggaacggctgggggtaggtgagggatgggcaggaactgctgggtcaccgagcctgcagcggtgcacctcaccaggagccccgagtccggccacgccctcttcactcatcccttggctcctagaactttgggtcaatcagtggcgtgtctgctctctcaccacccctttctgggaatctaggctgcaggtatatttcccactaaaagggaagaggagaggctgggcgcggtggctcacgcctgtaatcccagcactttgggagaccgaggggggtggatcacgaggtcaggagatcgagaccatactggctaaaacggtgaaacccgtctctactaaaaatacaaaaaattagccgggcggggtggcgggcgcctgtagtcccagctacttgggaggctggggcaggagaatggcgtgaacccgggaggcggagcttgcagtgagccgagctcacgccactgcactccagcctgggcgacagagccatactccgtctcaaaaaaaaaaaaaaaaaaaaggaagaggagaaaggaggtgcagcagcctccttgcccagtgcctgggcccagtgcccaggacggaggccagagaggaagggtggctgactgcctgcggggctgccagccccacacctcatgaaggaatgagctgtccctccccagttgctggggtcatatttgttacactctagctaacgcctccccgagatggctgaggccctgtgaggcctatccagaggtttccaacagtgcctggcattgcacagtaaattaatcaccatgacacgagttttgcaaaagagaaaagatttattcacagggcaccaagcaaggatgtgggatagtagctctcaaatccaccttcccgaaaataaggcttagggataagccttgcttccaagcagtagagcacaggccccagccacgctccagggtaggggaccatacaaggatgtgaatagcagtgtcggccttgtgggcctacaacgcagaagggccatgcacttggtttaaagctttgctgttgccatcttaacattcttaacaagttaaaaataagggtccccacattttcatttatagccagtcctgtccaaggagttcaaagatctcatgagggtggacagggcactgtctgctctgggcagtgatgggaccactaacagttgttctccagtctcccagcgcctaccccagggacacaccttcccctggtctctactattctttttttttttcgagacagggtcttgctgttgcccaggctggaatgagtgcagtggtacaaacttagcttactgcagcctcgacctgggctcaaacaatccttctgcctcaccctcccatgtagctcagaccacatgcgcatgccaccaatctgggctaattttttgactttgtagagacggggtcgcactttgtttcccagggtgctcttgaattccttggctcaagtgatcctcccacctcagcctcccaaagtgctgggattataggtgtgatccaccacccctggcctctctcacattcttgacatttaaagttaccatcattgacaaggaacatgggtacactccaatttactcaagaaaaagctcttttctccattgaagacatatgtggcctagctgcttcatattctagttgaggtcttcttgttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagtagcagccttgcctgggagcttgttagaaatatactaacaggctcccacccccaaacccagacctactgaatcagacagagtttattttcataagatcctcaggtgatccaaatgcaccttaaactttgaggagctttgattcagaacctgggctggaggcccctaggggccaccttgttcctcacagactgcaaggtatgtttttttcttgcctcttctctctgtcccaatgtctccttctctctgtgtctgaccctgaggaccctgtgacatcctcccaggggagtttccactgccaaaggcctgattctctagaaactgatgggctcctctagacaccaatctctacctgggctcttgttgaagaagccaatcagctcattggttggcgatcacgtgatatacaacatggctgccttccaagccttatgtgtggacaaggagatagggacaagtaggcatatcatgttctgctacctggtccatcgtctctcctcaggcccccaggatacacgtttatggggagttttcctcccttcccccaatatggtcactcataactttacacccaacagtcaaacaggggtggaagctacagggtttcatgtaaacaataggctaggctgtggggctgagtaaaaggcactggactgtggtaggtcttactccaagatggccaaatggaagggcttttagctttctttgtttttgttttatattttgagatataatgttcaaatttacacttcagaataaaaaagagccacaatttatgcttcatattttttgtagcttcttccctatgcttttgaacaatgtaatcatattttcattatcagatataattcccataccataatatccaccctttcaaagtatactttaaaattcaattggtttaaagccaattcagtggtttttagtatattaacaaagttttgtcaccatcacagttatctaattctagatcattttcatcacccaaaaagaaactctgtacccaataaagagtcactccccattcccctcttcccctagcccctggttaccattcatctactttctacctctgtggataggaagtagctgcctattctggagatttcattcaaatgtaataatgaaatatgtggccttttatgactggcttctttcatttagcataatggtgtcaaggttcatccatgttgtagcatataacggtacttcatcccttcttatggctgaataatattcaattttatggactttttagcaaaacattctaatttttacttctctactgtgcttattgtttgtctttctccacaacaatgtgagcactaaaggcagacatttttgcctattttgttcactactgctttttctgcaccaaacgcattgcctggttgtgggtacttttctagttttaggaaggagaagacaagatataggtcctgactctggttctgcctctcattcatatgctacccttccccttgaagaacttgtttcttcatctacaaaatgggcataatactactactcatcagggtggttgtgaggattaaacaaggtaagagatgtaaaattgcatgttagttatcagatagatttgtgttcccatctagctccaatgagggagaggatttgctctagtctgtccctctgggctctgggcttctaatgggcagacagcttcctccatgatgtttgtagctgttaaggctggcgtagtccctcaagacaagttttttttttgtttgtttgttttttttttgagtcagagtatcgctctgtcaccaggctggagtacagtggtgcgatcttggctcactgcaatctctgcttcccggattcaagcgattctcctgcctcagcctcctgagtagctgggattacaggcatacgccaccacacccagctaattttaagacaagcttttggaattgaactgctgatggtcttccatgaacaattcaacagaaacccagtagcgtacacttccttgtatgcacttgcaccctctctttacatttattacacatttaatgctacctaataattccctatacttttactttatccaatcgttcaacagattccaaccgaaatacatagaagagtgatattccaacttcatcagaccctgagattctatttttaacatttcttccatggattgttgaatgtttccaatgattgatccaccttcccttggccttttctacattacagatttggtggcatgtccatgtctatgttgccaaacttgcctcatagacccagcttgaacacaagatgggtgcttgctgaagagcaggactcattctgttgaacctgcatgttttctcaggtcagattgcttggtggcgcttctttaatttctttcaacagcacattgtagtttgctgtgttgaaatgttgcttttctttggttaaatttattctattttattctttttgatggtattataaatggaagtgtggttttaattttgtttttcatcctttattgcaaatgtatactattgatttttgtgtattaatcttgtaccctgcaaccttgctgaacttattttattttattgagatggagtctcagtcagtcacccaggctggagtgcagtggcttgatcttggcacactgcaacctccacctcctgggctctggtgattctcctgcctttgcctcctgagtagctgggactacaggcatgcgccaccacgcccggctaatttttgtatttttagtagagacggggtttcaccatattggacaggctggtctcaaacttctgacctcatgatctgcccgccttggcctcccaaagtgctgggattacaggtgtgagccaccgtgcccagccttgaacttgtttattagctctaatggtttttaagtgagttaagaatttctgtaatgtcatctgtgaatagagatggttttacttctttctttctgatctagattccaccttgttcctttttcttgcctaattgccctaataagtagaagtagtgtgaatgaacattcttgtcctgttcctgatcttaggggggaaacgcttgatctttcacaatggatgaagtatggtgttagttataggtttttcatagatgctttttgtcaagttgaggaagttcctttctcgtcttcatctgctgagtaattttatcgtaaaaggatgttaggttttgtcaaatgccttctgtgcattaggatgatcatgtgactttctattaacatggtatgctacactgattgatttttgtatgttgaactgcatttgtactcctgggataaatcctacctggtcaaggtgtatgatccttttaatatgctgctggatttgatttgctaatattttgctgaggatttttacatctatatttataaggatattgctttgtaactttattttcttgtaatgtctttttctgtctttggtatcagagtaattctggcctcatagtatgagttgaaaaatatttcttcctgttttatttttttggaagagtttgtgaaggctttgtgttagttcttcaagcttttggttgaattcaccagggaagccatctggtcctgggcttttctttgtggaatttttaaaaataattaatattttaatctctttatttgttacaggcctattaaaattttatctttcttcttaagtcagttttggtagattgtgtgtttctaaaattttcccatttcatctaggttgtctaaattgtccacatatagttattcatagtatttctaaacttttgaatttctctatgaccaatgtgatgtctccattttctttctttctggtttccatttcattttttcatttttgtttttgtttgttttttgagataaggttcttctatgtgcccaggctggagtgcagtggtgcaatcatagctcggtgtaaccttgaactcttggactcgagtgatcctcccacctcggccacccagttagctaagactacaggcttgcaccaccacaccaagctaatttttttaaaaaatatattttttagaaaaaagtctcattgtgttacccaggctgttatcaatctcctggcctcaagtgatccttctgcctctgctttccaaagtgctgggattgcaggtgtgagccattgcacccagcctccactttctttcttggtgaataatttgacccttatttttttcacttggctattctaagtaaaggtttgccaattttgttgatctttgcaaagatccaatttttggttttattgattttattgcttttctattttctatttcatttatctccattctaatctttattatttcctgttttctagtggtgttgggttgagtttgctcttatttttctagttccttaaggtgtaaagttaggttattgattcaagatcattcttctttaacttatgtgtttacagctataaattttgctcttagaactgcttctgctgcatcctataaatctgggcatgttgtgttttcatttttatttgttcaggatactttttgatgtcccttgtgatttcttctttaacccatttgttgtttaagagtgtgctgtttaatttctatgtgcttgtgagttttctagttttccttctgttcttgatttttaactttattccactgtgtccagagaacatactttgtgtgatttcaatcatcttaaatttgagacttaggaccaaatatatgctctatactggagaatattccatgtgctctttagaagaatgcttattctgctcctgtcgggtggaacgttctgttcatgtctagtgtatgcgattggttaatcgtgcttttcaaattccctatttccttgatggtcttctgtagtttttctattactgaaagtggggtattgaagtcaccaactattattactcacaatgtaaccatatttaaccctttacttttaaaattctttttggaaactggaaggatctgtaaccaccacccactcccacatcagaccctatgcatatgccaactgtctgctgctcagcagctgtgatggttgttccagttctttattaggcaaagaacagttgtttttttgtttttttgtttttttttttttaacatttcctttaaggaaggtggctcagattgctaagccagccaggccctgcgggacaggctgcgcctagggtcacctgctcttcttcagcaactcagaaatattctccttgaccattgaatccaatgttgaaaagtcccagtcggccaactgcattagtcgatcatgggcctccctaaagaggccagagccaatattcagctccacctgcatacgccactcagctagcttggagctgttgaggaagacattatagttggctgccatgggctgtagatagacgaagacaaagacgtggtcagcctggggaccagccccacctgggtcctctcccacagcctcaggcccacgtccctaacatctacctatgcaaagaattaggctgctgacccccaaggcctgagcaaggggtcacagactatgtaatagatgtaggtggggatggaggatccagaatccctcagagtcctcagtcactggtcttcttgctccaagccttctgaaccatgctgagagggctcctggcccaggcacttcccacttctccagcctgcgacctcgcatgaatcctgccttcttccagggaaaccccttatcccaggtgtgtatatgtggatgagggagagaactcaggttttttcctccatgtttagcctcccactgtgatcaagctcaggggctaggatgggagacctggcgggcagtctaccctgcagtttcgctggcttactaagagtttggtttgcacccaagatctttgggaagcccaagaatgggtgtgtgtgggtgaaatgtaaggggtggggacgaagcatatggctgaacccttggggcaggccagaatgatttttcctggtgctggtctgccctgcaaacagaccaaggagactaattttcatatcagccagagatctctgggataaggaaaagaatactgcattttctggtcaatccaccaggaccccaggtccctcctctcgggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttcctcccctgttatctttgggatcagcaactggccagggttgggaagaggagggaagaggaggctgcactccagggccacctgccctgccaggtctctgtactcttgtctgctggatagatattgaacacttcccaggatataaagcagtttcacctcttttagcagttctgattggtggaagttgctgggaaccatgtgttcacaaggatttggggagctcagcaggcataagtcctgtgattgattagtgatgtctgtcacaggcatagaattcaaagtagagacacatgtactggttatttgtcatcttctaattttctataggccatactcttttttgtttttgttttttgagatggagtctcactctgtcgcccaggctggagtgcagtggcacaatcttggctcactgccaactccaactcctgggttcaagcaattgtcctgcctcagcgtcctgagtagctgggattacaggtgcccatcaccacacccagctaataattttgtatttttagtagagatggtgtttcacaatgttggcaaggtaggtcttgaactcctgacctcaagtgatctgcccgcctcggcctcccaaagtactgggattacagttgtgagccaccgtacccggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcaggtctggcgggcaccagtgcgatggtgcgctgtacttgcggcacaggtagtaaaggatggccgcgctgcagaaggggccggtcaggggcactgcccttgccttcctgagtgccactacgtcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacgtagggtagcccctggaggtgcagggaggttatggacttaatgcttaagattaggcattatataagccagggcatgaaaggatccatctctctggtgctggatggagggtgagcccgagggggcagaatggacaatgaggtggcgggccagcaactatcgggaaggttgtggtgtctggggatggtggaggccatggggacagagggaaggggacggaggggagacatgcttcggaggggatgtcctaggccttgctgattgatggctggtgtgggaacctccgcagcacaagggctcctttatcatcaccaacagcaaccatgccaaggtaaaaaggtcagggcatggagagagctatcggttaaaaagtggcaggagagacagcaactggctgcaagactcagaacttctttggatcctgatccaaacaaactgccaagaaaatatttaggagataatcagagagttttgaacaggagccacgtattagatgaaatccaggaattactgttaattttatgaggtatcttaatggtatcgtagtgatgctacgctctatcctagcccaggctggagtgcagtggcacaatcagagttcactgcagtcgtgaactcctggcctcaagcgatcctcccgtgtcagcctctcaaagtgctgggattacaggcatgagccaccgcgcccagcctgttgctttttttttttttttttttttttttttaaagaacgcttatctctaagaggtatgttcctgaacgtttattgatttatttacttacttatttttatttttgagatggggtctcactctgttgcccaggctgaagctcaatctttgctcactgcaacctctgcctcccgggctccagcaatccctccacctcagcctcctgagtagctgggactacaggtgcggaccaccatgctggctaacttttgtattttttgtagagatgggggttttgccatgttgtctaggctaggctggtcttgaacacgtgagctcaggccatcccctcacttcagcctctcaaagtgctagaattacaggcatgagctggcccctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgctcgcactgaacctcccaggaggagcagagacagatggtgcaagggccccagggaagacttacctttcacttaagataaatttcccatctttgaggctgggaagcttcctgagggggttgatgtcaatgtattctttgctgtggtggtgacctgggaggagcagggaaggtctgaggctgtgggactccaggggagagagaactgagactcccagagacacaaacgcctccctctctattttctcaagaagagaggactgaggcccggagggacatggcggctcaccccaggtcacagggcaaggcagttgcagaaccggactgggatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagttttggagtccctctgtgctcgggatggagttggagcccacccctctgaccctcactcgggagcagtggagccctgagcctttctgaacactggggaggatgggtgtagacggactgtgcacttctgccccctttgccaacctggtgggcaggtgctgagttcacaaggtcctagaatcccacaacgaagccagggtgcctggtgggagcccagggagtcccagctgctgttcattcccccttctcctcaaaaagcctgttcatctgtggcgtggggactatcattagtggggagtggctaaggtaggctaggcagggacgcagcctacaagccccgtggcatcttttccttccctgtggacctctggggtgattcccttgtctctgtccctgcttctcagaaatgcccctatcaatctgagcgtggtggctcacgcctgtaatcccagcactttggaggctgaggcggggcagatcacttttggtcaggggttcgagaccagcctggccaacatggtgaaactccatctcgactaaaaatacaaaaaatgagccgggcatggtggcgtttgcctataaacccagcaactcgggaggctgagctgggagaatcacttgaacccagtggagattgcagtgagccaagatagcaccactgcactccagcctgggtgacaaagtgaggctctaccaaaaagaaaaagaaaaaaaaagctccaatctgtgtgtcctgcctccccccaggaccaggcctgccaggcagcagtgggagctgacctttcagcagatccacaaactgaaagttgaactggatgtcatgcttcttcgagaagatgtagacggcacggcagggtgctgacagcaggtccatgtagagctccagggccatgttgagacacatgccaggccccacagctgcagctggccagccacagacctgggcctatgtctggccagagtccctggccctgtgccctctccgatctgggcccaggaccctgcattctggaacctcttgtttccctttgtgttgtcataaggccaggaagcctgcaattctcacagcatcaaggattctaaggaggcccaggagtaggctggcagaggcccgtggcaaaggtgtggcagccgtgaccctactctccccctctcacgtgtgtctgtgtcccgtggcgccacctcacagacaccctgtctgagaagggattatgcctgggaattcccagggccggactttgattgcagaacctgacgaaaggggctttgcagggtccagaatgaggaggaggcaatgagaattatccctggaggattctagaagtagaggctgggagcatccacaggtgaatggagcctgaactatgactagaaaggaattgggagaaagagacacaggaacctgggagcttcgggagcagtggggacaccaccaccaggaagtcagggggcactcggcaatgaaagtggcagatgcaataaaacttttaacatattgttgtataatgtacaataatgtaataaaaatacaccccctatacattattgttccaactctagctctatctattgccctcctcatatgaatccctctccccataccccattctctagttaatcttaactaggcctcctgtttatattagccacatcaagcctagctgtctactctatcctgtgatcaggatgagcatctaatttgaaatatgcactcatcggtgcactatgtacagtggcccaaacagtctcatatgaagtcactctagctattatcctcctatcagtcctattaataagtggttcatttaatttgtatatactcattggaacagaagaatttctctggctgctcctaccatcatgacctctggccataatatgacttatttccacactagcagaaaccagccgagcctctttagacctaacagagggggaatcagaattaatctcgggctttaacgtcgaatatgctgcaggcccatttgccctgttctttatagcagactatataaatatcattataataaatgccctgaaggccgcaagaggttcgtgggtgcagtgcacaggagaccatatctggggacagcagctgcagcagaccccaagctgggccatccctgccacttgccaggtggtgcttggcgaaggcaagcagctcccacccgcccggggaatacagcgcgacccccggcggcatgctcttcagcaccaccccaggaggtaccaggatcatctaccactggaaattcctgatggagtgttgaaacttacccgtgaccaaaacactcccaagggatctgcccaccattcccggggtcaccagccctgccagtgatgatccccccaacggaagccagccagagccacctgagcaatagtccagaagataagcagggcgggcagtgaagaagcacagttttgagatggacatttaaagcaccagccatcgcatggagcactgccaagggacccctcaggcccttcctggaggagtcccaccagccaggccttatgaaagtgatcatactaggcaggcattggtgtggggccagtcaccccagccctctctccctcactcgcggcacctgccccctcctctttgtgaacaccagcaggtacctccttgtgcctccgctgatgcaggagcagctgccccaaggggagtaacccctgccagcacaccctgcagctgagggccaggaagtggacaagaatgaaccctttcttccaaatgatcagctcttccagcccctgctgggggccccacgaccccttccttaggttgacgtgcctgggaaagctcacctccccctcttccctaagagaggaaataaaagccaccttcgccctagggcaaaaaataaataaataataaatcccgtaatcactattgtcttcctaggagcactgcataacatatatataccagaactctataccacaaatttcgtcacccaaactctcattttaacaagtctttttttatgaattcgaacatcatattcctgattccattatgatcagctcatatatctccttgaaaaaattttctaccactcacactagtactttcatatgacatatcttcatgccagtcctaacctccagcatcccaccccaaacataagaaatatgtctcacaaaagagttactttgatagaataaattacagaggtttaaacccttttgtttctagaattacaggaattgaacctacccatgagaatccaaaattctccgtgctacataatacaccacatcctatcacaccccacagtaaggacagctaagtaagctattgggcccataccctgaaaatgttggttatacccttcctatactaattaatcctccagtgtatgccatgcagaggagcccagaaacttcctggcctgggttggggctgcagtggccagactgtgcacctggtggcccaggaaggtaactagagccccacgtagaggactgagtgccactcactctatgctttgtgatttaataggtctaggctcagaaatgggactgatcccacttccagtgacagagtaagcctggagacaagcgaagagcatgcagtgtgtttattgcagacagcagggtgcagtgcagtgggctgtacccactcagtggagccactcctgcagcaactgcacctgcttctgggccagctgggggtcctgccgagcctcactgtggttcagaggctggagtatgagcttgtgggcctccaggaagagctcagtaccaagggcagccttcatatgggcctgtcacactgccagccagggccagtcttggaagaggtcgcagccaacggcagtgggctgggaagacagggcagctggggttggggctcagccccatgcccagagtccccccgagggcaggtgggtaggaaagcttcacctgcatcacctccgtcagcaccaagtcttccagggagatctgctccattgccaggaagggcctggccaccaggacccccccatccaggtgctgcagggctggcgtcagcctccccaacagccgctccagctgtgcagcatctgcaggctgtctggagaagtggggcaggagagactgggctgtgaggagaggagcaacttaacccagactcttggaagcctcttgggcctcctctccatcccttcccggctgccattcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtaccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatctgggtgacctacgtcctttccccatctgggcagctccagctggcttagactctagccaggttccagcctccagctttagcccaaaggtgcccctgggtccagcctctgcatcggagctacacaggctgaaatgaggaaggggccacagtgatttggaaagatctccaacccaaggaaagatctcccctctcgcctctgcctccccctacaactctgagccccagaacccaggcagatcctggctctgaccctgggtgggcaccaggtcaccattacctctctgctagtaggaagtcgccatctctgagggcaggcaccttccccagggggttcaccttcaggaactcaggcttcaggtgctcccctggtgggcagaaaggagagaaggctcagtgcagggcctggtccttggcacccactccatggggcccagcccagccacctggctcaccccaagccaactccactgtctgcagctgaaaagggatgtcattctgcctggcaaaagtggatagcatggcagggggctgagtgcatgtccaggaacagcttgggccccattgctgctcctcccacctgccctccccagaggtctgtacctccaggagttgctcagcccttctcggccagtgccttcccccaaaatggggccagaactctgtactcctcctgaagcctattccctccatgactggctgggaggcctgccaagcccctctccccttttctccacctctgtagagtggaggcaggggtggccagtgtccctttgggggtttcagatagaaactcaatgacaattggcttagcaaaaacaaacaaacaaaaaaaaaacaacaaaaaaaaaacaaagggagtggggtgggtggggagatttctcagaaaacttctccagtcataggaggggaggggtgtagaagccactaagagaactggaatcagaacctgtttctgtctccccacttttcctcccctctcctcctctcccctccttcccctcctgtcccctcccctcctctcccctcccctcccttccctttccttccttcccttcctcctttcctcccttctttctttgagacaggatctctgtctccctacacttttttcttttaattctctgtctctttcttgacatagaatcttgctctgtcacccagcctggagttcagtggcacgatcatggcttactgcaatctccaagtcctgtgctccagcagtcattccactacagcctctggagtacctaggactacaggtgcacatgaccataccccactagttaaaaaaaacaaaaacaaaaacaaaaaaacccttgggcctggcagggcggctcgtgcctacaatcccagccctttgggaggccaagatgggctgatcacatgagcccaggacatcaagacgagcctgggcaacgtgccgaaacccagtctctacaaaaaatacaaaaattagctgggcatggtggcgcatgcctgtagtcccagctactcaagagactgaggtggcaggatcacttgagcccaggaggcagaggttgcagtgagccaagatcacgccactgcgctccagcctaggcaacagagccagactctgtctcaaaaaaaaaaaaaagagagagagacagatagggtctcactatgttgtccaagctgatcacaaactcctggcctaaagtgatccttgggtctcagcctcccgagctgattagctgggattgcaggtgtgggctaccacgccctgttatcactccctttctctgagtcagcttttctctctcagactagcctactccatgaactcaggaaatgtcactacaggtggccccagctcccatttacctccccatagggagctcctctctccagttccaatttcaaaactcccaaggaagcattctggttcactcgcttgggccactggccagagggatgggatactctgaaagattcagctagagtcccgggcccagccctggaccatcactgtgcaccctggttagatgccagggctgggattcagggagaagaaaggaggttcccggacagtcattcctgcctcctgcggctgcgggctccctgcacagtcattcctgcctcctgcggctgcgggctccctgcccccatcctgtgcacgaagtgggagctcccgctgtctggcagcagctgctctgcaggggacagtctggacggcagaaagttcatccttaaccccagccttccagtcaaggttcccacaagtctgggacacctgcaagtgtcatatcccgctgggtgaaagtctgagatcccttttagaggatcccattcgctccctcccttctgccaccttccagctccgagaaacagagctctgaacgaaccctcagatgtccatgcgctggggcctttccaggacggcggggcgcagtcctttctgggttggggtgacacctggaaacatgtaaggtccctggcacagggacccctcccagtttcaagcgattctcctgcctcagtctcccgagtagctgggattacaggcgcccaccactgcacccagctaattttttgtgtttttagtagagatggggtttcaccgtgttagccaggatggtcgcgatctcctgacctcgtgactagcccgcctcagcctcccaaagtgctgggattacaggcgtgagccaccatgcagggccaatttttgtattttcagtagagacagggttttaccatattggacaggttggtctcgaactcctgacctcaggtgatctgcctgcattggcctcccaaagtgctgggattacaggcgtgagccaccaagcctggtggtaatttataaggggtggacatttgttggctcatggtcctgaaggctggaaagtccaagatcgaggggccagcatctggccagagctttcttgctgtatcatcccctggtgaaaggataaagagagggtaagagagagcaagaggctgaactcacagcctcaaagtccttttataatccacatcaatccatctgtaacggtggaggcctcatgagataaacacctctcattaggccccacctcccaacactgttgcattggggattacatttccaacacatgctttgtgggggacccattcaaaccacagcacagggacaccttctctttccttcctgtgatatgctgaataatgacccctaaggatatacaagtcctgatctctggaacctgtgaatattaccttctgtggcaaaagggactttgcagaattgattaagaatgttgagatggaggcattgtcttggattatctgagtgagccctaaatgcagtcacaagtatctgtgtaagaggagacagacggagatttgaaacagaagacaggagaagatggaagcagagagatttgaagatgctacattgtgggctttgaagatggaagaaggggctacatgacccaagacaggcagctccaaaagctggaaaaattgaggaaaccaattcccctctcagagcctctggagggtgtgcaaccctattggcacctgggttttggcccagagaaatagattataaagttctggtctccataactgtaagagaatagatttatgttgttttaagccaccaaggtggtggtaatttgttataccatccagaggagaggaacacagattttggtgccaggaagcagggtgctgctataaaaaagaaaatctaggctgggcacagtggctcatgtctgtaatttcaacattttcggatgccaaggtgggtggattacttgagccctggagtttgagactagcctgggcaacatggcaaaaccccgtctctactaaaaatatataaattagctggggatgggccgggagcagtggctcacgcctataatcccagcactttgggtggcaaaggcaggcggatcacgaggtcagaaggttgagaccatcctggcgaacatggtgaaacccagtctctactaaaaatacaaaaaattaaccaggcgtggtggcgggtgcctgttgtcccagctactcaggaggctgaggtagcagaatggcatgaacccaggaggcggagcttgcagagagccaagatcgtgccactgcactccagcctggggaacaaagcgcgactccgtctcaaaaaaaaaaaaaattagttggggatggtagtgcatgcttgtagtcccagctactggggagaccgaggtgggaggattgcttgaggctgggaagtctaggctgcagtgacctgtgactgtgacactgcactccagcctgggcaacagagtcagaccctgtctcaaacaaacaaacaaacaaaaatctaaaaatgtggaagtagctttaaatttgggtgatgtgcagaggccagaaaaattatgaggcccatgatagagaaaacctagattgccttgcacagattgttggtagaaatatggatgttaaagactatagggagggctcacgagtatcaactaaacatggtcagagcaagtctacattgccttacagcatacctaagtcatcataggcagctgtaggtagatatatagatattggctgggtgcagtggctcacgcctgtaatgccagcactttgggaggctgaggtgggtggatcacctgaggtcaggagttcaaaccagcctggccaacatagtgaaaccccgtctctactaaaaatacaaaaattagctaggcgtggtggcatcccagctactagggaggcggaagcaggagaattgctcgaacctgggagacggaggttgcagtgagccaagattgcgccactatactccatcctgggcgaccaagcgagaatctgcctcaaaaaaagaaaaaatagatattaaaaatcctgctgctgaggactctgaagaaatgaggaacgtgtttctggaaactggaggaaggaggatcatttcccagaaaaggagcccgtagggaggtagaaagcttagttgaattgtgtccgatagttatatggtgggtgaacttaaagcaacgaagttggatatttagctgaggagacttccaagcaaagcgttgaaggtgaagcctcatttcttcttgctgtttatggtgaaaagcaagaggaaagtgataaaatgaggaaaaagctgttaagcaaaaagaaaccaaggtttgatgatttgggaaattatcagcctgtgcagattgcaaaagatgctaaaattagaagattcgctgtttggaaaacacaactctatccctgtcctggggatcactcaagacttgtatccatagacaaccagatttctatgggcttgaactctgtgtgtgtgtgtgtgtgtgtgtgtgtgtgtgtgtgtgtgtgtgtgtgtgtgtgtgtagcaaggttgggggagcacagtggaaagaccttgaatttatttgtttattttttagacggagtcttgctctgtcgcccaggctggagtgcaatggcacgatctcagctcactgcaacctccacctccagggtggttcgagcgattctcctgcctcagcctcccgagtagctgggactacaggcgtataccactatgcccagctaatttttgtattgttagtagagatggggtttcaccatgttggtcaggctggcctcaaattcctgacctcaggtgatcaggctggtctcaaactcctgacatcaggagatccaccagcctcggccttccaaggtgctgggattacaggcatgagccaccatgcccagccttattatttatttatttatttttgagacaaagtctccctctgtcacccagactggagtgcagtggcgcaatctctgctcactgcaacctctgtctcccaggttcaagtgattctcccagctcaacctctcaagtagctgggactacaggtgcgcaccaccatgacctgctaatttttgtatttttatttatttatgtattattttattttatttttccataagttattggggtatgggtggtatttggttacatgagtaagttcttttgtagcaatttgtgagattttggtgcacctgtcaccccagcagtatacactgcaccatatttgtagtcttttatccctcaccctcctcccactcttcccctcaagtccccaaagtccattcttatgcctttgcgtcctcatagcttagctcccacatatcagtgaaaacataagatgtttggttttccattcctcagttacttcacttagaataatagtctccaaactcatccaggtcactgcaaatgctgttaattaattccttttcatgactgagtagtattccacatatacatattccatatatattcattccatatatatattccatatatgctcattccatatacatattccatatatgctcattccatatacatattccatatatactcattccatatacgtattccatacgtatgtactccatatacgtattccatacgtatgtactccatatacgtattccatgtatgtattccatacgtatgtattccatgtatgtattccatgtatattttccatatgtatatattccatgtatatattccatatgtatatattccatatatattccttatgtatatattctgtatgtatatactccatgtatatattccgtatatctatattccatatatgtattccgtatgtatatattccatatgtactccatatgtattccatatgttccatatatattccatatattccatataaattccatatattccatatatatcccatatacattccatatattccacatatattccatatacattccatatattccacatatattccgtatattccatatagattccatacatttattccatatatattccatatagattccatatatattcagatatattccatatttatattccatatatggaatatatatgtattccatatatatgtattccgtatatgtatgtattccacatatatattccatatatgtatgtattccacatatatattccatatacgtatattccagatatatactccatatgtatatcccagatatatatattccagatgtatatattccacatatatattccagatgtatatattccatgtgtgtatattccatatatgtatattccatgtgtgtatattccatgtgtattccatatatatattccatgtgtgtattccatatatatagtccatgtgtgtattccctatatatattccctatatatatattccctatatatattccccatgtacattccatatatatattccccatgtacattccatatatattccccatatatattccatatatattccccatatatattccatatatatattccccatatatattccatatatatattccccatatatattccatatatatattccccatatatattccatatatatattccctatatatatattccctatatatattccctatatattccatatatatatatatatatatatatatatatacaccctatatatatattccctatatattccatatatatatggagtctcgctctgttgcccaggctggagtgcagtggcgcgatctctgctcattgcaagctccacctcccaggttcacgccattctcctgcctcagcctcctgagtagctgggactacaggtgccagccaccatgcccagctaattttgttttcgtatttgtagtagagacggggtttcaccatgttagataggatggtctcgatctcccgacctcgtgatccgcccacctcggcctcccaaagtgctaggattacaggcttgagcctccgcgcccggcctctgaattctttttcaggtaaatcagggatttcttcttggtttggatccgttgctggtgaactagtgtgatatttgggggtgttgacgacccttgttttgtcatgttaccacagttggttttctggttccttctcattggggtaggctctgtcagagggaaggtatagggctgaaggttgttgttaagattttttttgtcccagggctattcccttgatgtagtctctcccccttttcctgtggatgtggcttcctgtgagccaaactgcagtgattgttgtttctcttctgggtctagctgcccagtgagtctagtcagctccaggctggtactgggggttgtctgcacagagtcctgtgatgtgaaccgtctatgggtctctcagccatggataccagcacctattctggtggaggcggcggacggtgcagtgcactccgtgagctttggtggtttaatgctctatttttgtgctggttggcctcctgccaggaggtggctctctccagaaagcatcaactgtagtagtgtggagaggggccagtggtgggtggggccctaggactcccaagattatgcgtcctttgtctaccactactagggtgggtaggaaaggaccctcaggtgaggacggtgctaggcatgtctgagatcagactcttcttgggcaggtgttgctgtagctgctgtggaggatgggggtgagatgcccaggtcattggagttgtgtgcctaggagaattatggctgcctctgctgagtcatgcaggttgtcagggaagtgggggaaagccggaagtcacaggcctcatccagctcccatgcaaactgaaggggcggtctcactcccaccatgtcctgcaaacagccctccatctggaaacagcaaacagtgtgtttccagatggagggccagacgaattgaaaacttgcctgaggctttccacctcccagctgccaaagaaaagggctttagttcttcctccgcctgtgaaatctgcaagccagattcacaccctcccctgggttctggcccagaggcttctcaccccattcaaattgttacaaagttcagctagagaattccttctccctgtggagctgtggagttttaccccttgctttctggccaccctcctgatggatccctgtggtgccaggcaggaatgggctgcttggggatccagtgagctcccagggcctttctgctgcttcctctgaccctgtattttgctcggctgagttttgtaacttgactcagctccaggaaaagtcggaaacttcttccacaaacaggccttcagcttctccagtgggggtgtgtgctcaggagaagcgggtctccctttcccacttccacagctggggcactcacagtatttggggtgtctcctgggccctacaggagcaagtctgcttccttcagagggtctgtggatcctctcaggattgctggtttgttctttcagtggatctgcagctaaaattcacaatgcaagcctccacatgctgctctgtccggagctgcaatctggctatgcctcccgtctgccatgatcccgaaatccctctccaatttttatatttttagtagagttggggttttgccatgttggccaggctggtattgaacttctgacctcaagttatctgcccatctcggcctcccaaagtgttggtgtaccaggacaagctgcagacaaaacctctgagacaccaagttaaagaaggaagggctttattcggccgggaacttcagcaagactcacgtctccaacaaccgagctccctgagtgagcaattcttgtcccttttaagggcttacaattctaaggggtctgtgtgagagggtcatgatcaattgagcaagcagggggtacacgactgggggctgcatgcaccagtaattagaatggaacagaacaggacagggattttcacaatgcttttccatacaatgtctggagtctatagataacataactggttaggtcaggggtggatctttaaccaagcccaaggtgcagcgccgggctgtctgcctgtggatttcatttctgccttttagtttttacctctttctttggaagcagaaattgggcataagacaatatgaggggtggtctcctaccttattggggttacaggcatgagccaccgtgcccagccaagaccctgaatttaaatcctgactctgtcattcattagctcctgacctcaagtatgccattaactactttgaatcctggtatccttgctgtcaaaggagatgagagttctgacacttataggtccactgtaagacataatttttaaaatatctgtaaaaactgggccgggcatggtggctcatacctgtaatcccaatactttgggaggtcaaggaaggcagattgcttgagcccaggagtttgagaccagcctgggcaacatgatgaaaccccgtctttaccaaaaattcaaaaaaatttagctaggcattggcacgtgtctgttagtcccatctgctcgggaggctgaagtgggaggatcactggagcccaggaggcagaggttgcagtgagccgagattgtgccactgcactccagcctggcagagtgagaccctgtctctacaaaaatgtaaaataaacttaaaaaatgtcaaagcatgataaagtacaggacataaagaccatgattaatctaacacccatcactacaatctttgcctctgttctggcattcccctatgtgtcttcgcatcaccctccttctgggtgactcctttatgttgtatttttttgtttggtttggtttttttggttagtttgttctgagacagagtcttgctctgttgctcaggctggagtgtagtggtgtgatcttggctcactgctacctctgcctcccaagtttgtacctcagcctcccgagtagttgggattacaggcatgcgccaccatgccctgctaatttttgtatttttagtagagacggggttttgccatgttggccaggctggtctcagactcctggctcaagtgacctgcccacctcagcctcctaaagtgttgggactacaggcatgagccaccacgcccggccaccccactcattttgaatgtaagtagattaccaattctgaaatgggttttgagcagtagcaacattgacacaaatttataatattttcaagaagatacttccttcaatatgtaaaatgcaacagatatcatttgcaatcatacatatgtacatatatacatacacacatataatatatatatctcaccatggaataagtctgagctgaaacatgcattacttaaaaaagaaaacacttacagacaggatcttgctccgtcatccaggctgaagtacagtggcacgattgtggctcactgcagcctcgacctcctgggctcaagtgatcctcccacctcagcctcccaagtagctgggactacaggcatgagctacctcgcctggcctgcatgatctttatgaagaatgtcatagaaagtttttgaaagcgattaaagttcacctaaacaagcagggatctatgctgtatgccatgctattattggggaggaaaaaaattctcctctacattcttagggtctctggagatctggaactaagaataaaactgaaataagacagattaacagaagaaaatcattcaagttttgctaaattttcagtgtacatgggtactttcacaagagaatgaaggcctaaagaagtcactaaagtagaaaaacaataccttttttttttttttttttaagacaaggacgggtgcggtggctcatgcctataatcccagcactttgggaggccaaggcgggcagatcacaaggtcaggagattgagaccatcctggccaacatggtgaaaccccatctctactaaaaatacaaaaaaattagccaggtgcggtggcgggcacctgtagtcccagctactcaggaggctgaggcaggagaatggcatgaatcctggaggcggagcttgcagtgagcggagatcgcaccactgcactccagcctgggtgacagagcaagactctgcctcaaaaaaaaaaaatgacaagacaaagcggcttggattatagggagtaaattgtggagaagggactaggacatacatgcggagcaaaattagaagataaggattatttttagtcgtgtgtttatacagatccattggaaccttgattcacagtcacttgtgatgacaatgttcttctcttcctggtaaagggagggtgctttcttatgggaaattgtgtggcctattcttagatagaaaagggcaggtcagagagtctttcctgcatgtgctatttctcaagtgccttcaactcaaaataattaatactccaaagcagcatatttggggtgacgtgtttttaattccttcatttcccctgctgcagactttcctagaagtttcagatattaaaagctgagttggtggctatggagataagagccagattcataacgagggatctacaaatggggagaagaacatagataagaataggaatgaataagctgaaaggaacaggtctgagcacatttccccttatcctgttaaacacacatcccattgctgggacaaggtcagtacagcagaaggaatgcacctcttttgtttgatggagagtgtttagcttgttctttaacaggtgcagcttaggcactatttgtcccagtggatttacacagaccagccttatccaccaatgatcacacaaactcctccttttgaggctgtcagtgtgtccagggtgcaacaattttggaatacagcagaagctaagctattaacttcttttgttgtggttgctgttgttgttttgagacagaatctcactttgttgagtgcaggctggagtgcagtggtgcgatcatggcttgctgcatccccagcctcctgggctcaagtgatcctcccacctcagcccccagagtagctggaactactactatgccctactaatttttaaactttttgtagagacagtctcactatgctgcccaggctggcctcgaacttctgggctcaagtgatcctccctcctcagactttcaaagtgctgggattagaggcctcagccaccatgcccagattgctttgacatcttgaggccttactgatccaggagagactgcccctccctgggccagctaattcctacagagaataaatgatttgcttatggtgtgccttcgatgggccaatcaaccgattcgtatctccaacataactttaccagccacctttcagcaggttcctgccccaaatcactccagggacaggtaccaggtaacaaaggaccactcctataacccagagcccatcacaattattaaaactagccagtcctaagtctgtttaccctgtcttgccttcttgcaaaaaacacagtaaagccttttgtccaccttttgccctcactcattctgccacctgactgaccctggtgcttccccatggccctgcatggtgtggcatgtcccccctattgtcttgggaactgtgagtaacaaactttcttttacatggctatcacctctgatctgtggcctcgccatacctgaataaagccaaaatcccaggtacattttaaaacaagtctacaagtcaaggaataccaaggatttccagcaacaccagagaggccggcccacgcccggcctgactcttactgttaatcactagttttgcatttctcttgaggaactagtcaggaggagaaaacctagacagcagctctcctggtcaagacccagtcattcagaagcctaaatggcatgcctaggtgcttggctttaaactgttagcaggtatggagtgctctgattgtgttttagaataatattctgggctgggcacggtggctcacgcctgtaatcccagcactttgggaggcggaggcaggcggatcacgaggtcaggagattgagaccatcctggctaagatggtgaaaccccgtctctactaaaaatagaaaaaattagccgggcgtggtggtgggcgcctgtcgtcccagctactcgggaggctgaggcaggagaatggcgtaaacccaggagtcggagcttgcagtgagccgagattgcgccactcattccagcctgggcaacagagcgagactccatctcaaaaaaaaaaaaaaaaaaaaaaagaataatattctggctgctgctggaaggcagccagggaggaagcaaggacattggatactgcagtaatcctggccaaaggcgacttgtgaaaaggggtgggcaactgaaggggcaggagaatgtggcccctctcagtctggagagagctgcagcactaggccaggaaggcactcttctgcggggggataggtcttaaatggggaccatgggattgggtgcagtggctcatgcctgtaatctcaacacttcaggagtctgaggcaggaagaccacttgagcccaggagttggagaccagcctgggcaacatagtgagaccctgtctcaaaaaaaaaaaaaaagacaatttaaaaactagccagatgtgatgcctgtggtcccagctacttgggaggctgaggtgagatgatcacttgatcacttgagccctggaggtcaaggctacactgagccatgatcatcccactgcactccagcctgcgcaacaaagtgagactcttatctcaaaaaaggcgacaggtgggaaccatggggaaccagagaagcaaagctattctcaagttttccagtaaccatcctcttgccaatggtctttctctgaatcttggatttgggaataggattttcctgccttgggaggctcccttgggaaatgggagtgtcacagccacaggcatcaaaagccctagagttgcacttgaatagtgggtagaaagttctgtgcaatgccaggcactgttggaaacctctgggtagggcttacagggccttagccatctgtgggaggcattagctggagtgtaataaatatgaccctcaggactggggagaaacagctcattccttcatgaggtgtggggctggcagccttgcaggcagccagccacccttcccctctggcctccatcctgggcactgagccaggcactgggtaagaaggctgctgcacctcctttctcctcttcccttttagagagaaagatacccccagccgaggatcccagaaaggcgagagcagacgcgccattgattggcccaaagttctccggagccaacctttgagcaaggagggcgtggctgggctccagtctcctagtgaggtgcaccactgcaggcttggtgacccagccgttcctgcccgctgcccccaaccagccgttcctgcccacagttcctgttcccgggcctgtccccgggtttgtccccagggcccgtcccctgggtttaggtctaccctccctcgccccaccccatcgccctcgccatgggtctggagctgtacctggacctgctgtcccagccctgccgttcagtctacatcttcaccaagaacggcatccccttcgagcttcgcaaagtggagctgaccaaagctgggctgggcaggcaggcccaggggatattggctgcggatccccacctgtccccactgctttgcagtcgggccgagaatgcagactaacatgaagaatcagactctctggtgtggaaactattacgtaattatctatgttattatttttactttttggagacaggagctaactctgtcactcaggctggagtgcagtggcacaatcatggctcactgcagcctcgaccttccaggctcaagcgatcctcccatctcagcccctcaagtagctgggactacagatgcccaccgatatgcccggccaatttattattattattattattattattactattgagaggaggtcttcctgtgttgcccaggcaggtctcaaactcctgagctcaggcgatcctctttccttggcctcccaaagtgctgggattacaggcatcagctgtcatgccctgctggttgtttattttaaaagaggcttcatctttgcttagtgaatacaaagcattcttcaaaatacaggttaagagggggcagagcagatgcagcaggagggcagggaaatggagtggggctagaatatcttcaccccatgtgcttggaaaaaacaatgaaactacctccttgtttcctaagtggagtagtccttgtttacctctgcctgggtctcttcccttcttgcctcttctttttttgacacggtctcactctgcagcccaggtagagggcagtggcatgatcccggctcactgcagccttgacctctcaggctcaagtgatcctcccacttcctcctctcaagtagagtagttgggaccacaggcacgcaaccacatccagcaatttcttttttttcctttttttttttttttttggtatttgtggagacgggattttgccatgtagaccaggctgaccttgaactccagagctcaagtgatcctcctgcctcctccttctaaagtgttgagattacagacatgcactaccatgtctggccctgggtctcttccacttttatgtatttcttggcattcttctgccttttcttttcctgcatctgacttgctctatcccatggggcttctcacccagctgaaggggctgctcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagaaggaggaacctgctcagctgactcttcccaactgctgcccttggtacaaccagcttgagtcacctgctacagaacaggggctggacacagaagcagtctgtggagggagaatgggcaggggtgtgcatgtccattcagtagaaggccagagaggcccacatgtaggcctatgatcagactggagcctggcttgactgatgccctctgatccaaacaccaggcacctaatgcggcctctagcactggcctagagtgctaaagtgagtcagacctgggaacccccagtggggagggagccttgagagtttggcacaagaaaggaagaagagctgagccaccgggggctgagtggctgaatggggcagggattcccagcaagaatgaggttggtctgagggttgggaacatgtttggctgggactctggggtattgacaggtcacccagcctggccagtagggcctaaggccccagctgggataggaagctgaatcagagggggcaagcctagagcccagggaggaggctggaggggtctgacctatggatggaactggctgggggtggggtgtgaattacagctccagggaattgtccttgagccatgcttcaaggaactggacacaggaaaggtggccctctgatagggtcagggtctgtgacccagtgactaacagagaggcttcctcttccctgatgcctcccagataggggcctcagaaagctgctgctgggagtttggagtgggggtgggcagagacatcagagaactcagggttctccccactcacctctctgatctcgcctgcaggccagcagcacagtgatgcctttgcccaggtgaatgccctgaggaaggtgccaggccttgaaggatggggacttcaccttggctgagaggtaaccggtccctgggctgctgccgggccttgtggggccagtcagtcagctgtctgtttactgctgatggcttggatcatggactgtgggccctgcaccagccccagggtgaagaatgggtggaggcaggcagaggtgcccagtgttgacaagggctatagaagtcccctcctgcattgtacaagtgaggaaactgaggctggaggaggggagggacttgcacaaggccacagggcccagtctgcttccgggcctcctcaccgccagtcttcccctccgaaaaaaagagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctacgtccttctcctcatggagctcacattccattaatagaagggggagctgacagtaacccatgtaaacatggaacatatcggatgttgatggatgccatggaaaaaataaacagggtaagagtgggggtgtgtgtcattatgagtaggatgttgagggaagactccctggaggaggtggcatctgagcagagagctgtaggaatgtgcaaggcatgaggggaagggtgttctcactggagggaagagtgagggcgaaggctccaggtgggacaatgcatggggttcagactggagagcaacgggccagggtgggtgcagtgagcaggaagagcaggaggtcatgacagaggggagcatgggacactgggaaggctttggctcttaccacaggtagattgagtcgctggagggttttgagcagaggagaactgtgatctgacttacgtcataaaggatccccctggcaggggtgagaaagccactgcagtcatctggcatgcagcgctggagccccagaccaaggtggtggtggtgcagggttggtggggattgtggtcagttctgacttttattgaaatctaactgcagggtttgctgaagggttggaggtgggtgggaaaaatgaaagccaaaaccagcctctaggttggtggctgcatggtggcgtcctttaccgaggccaaatagtgcctccttggtggagctggattcacattcagagcctgggatcactggatggtccaacacccatagaggcatgatgagctctgggggtcagactgcacaacccttcaccataggtgaacaggagatgggacagggtggggagcaatgctgccatgtcacctggaaggctctctccctgctggccttgctcctggccctgtccacgctttggatatgttggggagatatccaacatgctctcgttcttcagactcacagtggatgccccttcctcctggaagccttccctgagcccctgctgaagttcatgacattttgtttcttacttgctgcccttagttgagatgatagtctggccccgtgtagggctgtgtgaccctgggcacttacctaacctctctgagcctcacatccctcctctgcatcatggggatagtgaaaatgccccagaaaatggctgaagagtgttcagggcatgttttctgcccctgccatgtccccccagtgtggctagcttgctgtgtatgaactgcatgtacaaagcacctgaccactggtacccccaggacctgcaggcccgcgcccgtggggatgagtacctgtcatggcagcacatggccctgcagagtagctgctgctgggccatgtggcagaaggcgagccatggagggcagggacatctcccaagatgccaagggatgctgctttcactttacaaaatcctgtttagacctgagaccaaatcctggaatgccagagactgcctaattcacccaacttgtttcctaggagggaaaccaaggaccagagccaaggaaggattcccctaatatgccttaattccagagctatgagcagttaatcctatgctcttttgcatactccaggttgcctgggaatcttgcctttagggggagaaaataaacaaaccctcactttgctacacacataattcgtagatggagaagtatgaagtgaaaaaagtcaaactaggaagaagtgaggagacatttcaataaacgtttgtctgatgtctcggtatgaaaggactttctaaccctcagaacagtgggagaactcaacaaagaaataaccactacatgccagctgcggtagcatctgtaatgagcacacctgtaatcccagcactttgggaggccgaggcaggcagatcacctgagattgggagtttgagaccagcgtgaccaacatggagaaaccccgtctctaccaaaaatgcaaaattagccgggtatggtggcgcatgcctgtaatcccagctactcgggaggctgagtcaggagaattgcttgaatctgggaggcagagattgcagtcagctgagatcacgccattgaactccagccttggcaacaagagcaaaactctgtctcaaaaaacaaacaaacaaaaaaacatatacaaggacatgttgtgtaagaaaaaatggattaaacataaaacaagcaaaaaaccgggaaggatcttgataaaagatatgtcagaaggaggtaatgttctttaagatgctcttagaaacccttaagagaggcctggtatggtggctcacccctgtaatcccagcattttgggaggccaaggtgggcagatcacttgaggtcaggagtttgagaccaccctgggcaacatgatgaaaccccatctatattaaaaatacaaaaattagttgggtgcggtggcacactcaggagactgagacaggagaatcacttgaacctgggaggcggaggttgcagtgagctgacatcataccactgcactcaagctccacttagagcgagactgtctcaaaagcaaacaaagaaaaataagagaaacccatcagacaagagacaggaaaaaaatgagtcatagctcactgcattctagatctcctgggctcaagcgatcctcctgcctccgcccaggtagctagaactacaggtgcacaccacaacactgggattctttttttttttctttttttttgtagaaaacaacgaagggaatcttgctatgttgcctagcctggtcttgaactcctgggctcaagcaatcctcccttcttggcctcccaaagagctgagattacaggtgtcagccactttgcgtgaccacaatttcaatcatatttaaaatgtacaattcaagtgattttgccacactaaccacagactcatgtttaagccacaccaacggatttccatgttttaaataacatattttgccaccccctagtggacagtggctcaccaccggcacaaggggctacataggcagtcaatgggaaccaggcggggacgggaaatgtcgtgaacccaacggtccctgcccagccccacccgcgtccgcaacgtgtaaccacatctcctgactgcccaagagaagcgcagatttccatactgaacatgaaattgcctgacttcgaaatggtggcaaatcattaaaaaaaattttaaactcactttgcattggttattagggtcgaacttggggaagacccctacaggtgtgtgtgtgtctgtatgttaggggtgttcagacctttaatagggctagaaaccaggcaaccacaccgcggaaagcttgaggagagggaaatccaccagacgccaagcaggagggtcagggaagagacagggtggggccactaccgggttaaagacttgtagtgggtggggctacacgtagggccgagacgaccggatttccggaaatcagagccggcacacgtgacttttgtttgcagaagtgggaaggtaccctaggcagccaatcggggagcgctgagtctctgtccagccaatgagaagccaggttgttttagcgcctcgcccctcctctccggtccgcgagccttgggtatctccagcttttttccgccagagctgtttccgttcctctgcccgccatgccgttcctagagctgcacacgaatttccccgccaaccgagtgcccgcggggctggagaaacggctgtgcgccgtcgctgcctccatcttgggcaaacctgcagacgtgagcgtgggccgggcagcactgggcgaggggaagttggtgggccaggggtccggccttgtccctgctctgcctccgcaacagcgaccccgatccctttccccagggaccaccccccaccccattccgcaggccaagctctgactttccgtgcttcacgatcccgcggctccccctccgcacgtctttcccttgtcgccctccccagtcatgacccggacgtgaccttcagggacctcggcctgtactgggatccctgtccccgcgaacactgcgcgtttcggctttcgcgcgctcgggtcgggaccccagacgtagcccgactggctccagcttcgggtaaaacttttcatgttcccctcagcttgtgaacgtgacggtacggccgggcctggccagggcgctgagcgggtccaccgagccctgcgcgcagctgtccatctcctccatcggcgtagtgggcaccgccgaggacaaccgcagccacagtgcccacttctttgagtttctcaccaaggagctagccctgggccaggaccggtgcgcaggggtagtaggcccggaatattattctaaaacacaatcagagtactccattcctgctaacagtttaaagccaaacacctaggcaggccatttaggcttctgaatgactgggtcttgaccaggagagctgctgtctaggttttctcttcctgaccagttcctcaagagaaatgcaaaactagtgattaacagtaagagtcaggcagggcgcggtggctcacgcctgtaatcccagcactttgggaggccgaggcgggcggattatgaggtcaggagatcgagaccatcctgactaacacggtgaaactccgtctctactaaaaatacaaaaaactagccggacgtggtgggcgcctgtagtccccgctactcgggaggctgaggcaggagaatggcgtgaacccgggaggcggagcttgcagtgagccgaaattgcgctactgcacaccagccggggcgacaaagcgagactgtctcaaaaaaataccaaaaaacaagcaaaagaaaacaaaacaaaaacagtaagagtcgtcccaacgcagtggcttatgcctgtaattccagcactttgggaggccgaggcaggcagatcacctgtggttgggagttcgagaccagcctgaccaacatggagaaaccctgtctctactacaaatacaaaattagctgggcgtggtggtgcatgcctgtaatcccagctactcagaaggctgaggcaggagaatcactttaacccgggaggcggaggttgtggtgagctgagattttgccactgaactccagcctgggcaaaaagagcaaaactccttctcaaaaaaacaaacaaacaaacaaaaaaaaaaaacacacacacacacaatccaaaaaccagtaagggtcatgtcctgggaggctaactcagccgactgttaggtcaccatgcttatagccaagaaatgtgggatgctgctgggccctgagcggtcagataaactactttctctgataattagaaggctacaggaaatgttttgttttgttttgttttgggtttctttgtgtgtttttagagacaggatcttgttctgttgccccaggctggagtgctatggctcaatcagagctcactgcagcctcgaactcctgggctcaagcaatcctcccacctcagcctcccaagtagctagaactacaggtatgcatcaccacgcctgactaattaaaaaaaaaatttcttttggttgcgtgtggtgtcttggcacccgtaatcccagcactttgggaggtagaggtgggagcatctcttgagcacaggagtgcagggctagcctgggcaacatggcaagaccctgtctctacaaaaataaaaaagaaatgagctgggcgtggtggggtgcacctgttgtcccagcttcttaggaggctgaggtgggaatattgcttgagcctgggatgtcaaggctgcagtgagccatgactgtgccactgcactccaggctgggcaacagagtgagaccccatctctgaaaaaatatttttttggggagccaggcacagtggctcatggtaatcccagcactttcagaggtggaggtgcacagatcatttgaggtacagagtttgacaccagcctggacaacacggtgaaaccctgtttctactaaaaacacaaaaattagccaggtgtgatagtgcgtgcctataatcccagcttctggggagactgaggcaagagaatcgcttgaacctgggaggtggaggttgcagtgagctgtgatcatgccattgcactccagcctgggcaacagagcaagacactatctcaaaaaaaaaaaaaaaaaagtttgttttgaaatcctggactcaagcaatccccccaacctggacctcccaaagtactaggattataagtatgagctaccacactcagccactttttttttttttgagatggagtctcgctcggttgcccaggctggagtgcagtggcgcgatctcggctcattgcaaggtccgcctcctgggttcatgccattctcctgcctcagcctcccgagtagctgggactacaggcacccaccaccacgcccggctaattttttgtatttttagtagagacggggtttcaccgtgttagccaggatggtctcgatctcctgacctcgtgatccccctgccccggcctcccaaagtgctgggattacaagcgtgagccaccgcacgcggcctcagccacatttattaatttcactcttggcaaacatcagggggaagctgacccacacggcctgggaagggggttgtcttttgcatagagaccatgaccaggtctgggacagaggaaagtcaaataaatcacacattagagttagaagcagaggctcaggctgagcccaggtttattatccaaaatcaaaatgaaatgcagtgattaaaggacacaaggcctcagtgtgcatcattctcattgtggctttcaggcggctgtggaagacagggtggggatggtggcttcgggaggtgaggtgctctgggacttgggcaagtcttaggcaagccattcctgctttctgggcctggctcccatgggccattagaaatgaaaatgctttgtggactgctgaggacggtgcaagggtgaggtttcccagctcaccggatcatggccagcacccagggcatcagcttctgctttatggtggggtctgcaggtgggaagtccttggccttcagaatgacctcatgggcctcctggaagaggtcctcccccactgctgcctccacgcgctgccgccatgtggccagcttgggtcggccttcgaagacttggcagccagcacccacgggctgtggggaaaagggtacagactggggatggatggttgtgagggcagggatgggcagcatctgatttggggaccacagatctccaggaggtgtttgcacacacacttaagcacagtgccatagcccggtgtggcagcataagcaggacttcagcaactagccagggccccctgcctagtgggttcacctgcccacagcactcacatgcatcagctccgtgatggctacgaggtcagctaaggagatgtgaggaccagtaaggaaggccttgttctggaggaacttgtcctcgagcaactgcagggtcacatccaactctgccagggtggctgccagtgtctggggagatactggctcacccaggaaaacagggaacatcacctggggattgggcaggcaaagtcgggagttactggagtagggagttagttttgatttgcatttccctaatgattagtgatgctgagcatcttttcttttttttttttttttgagactgagtcttgctctctcgcccaggctggagtgcagtggggtgatctcggctcactgcaagctccgcctcctgggttcacgccattctcctgcctcagcctcccgagtagctgggactacaggtgcccgccaccacgcccagctaattttttttttatttttagtagagacagggtttcactgtgttagccaggatggtctcaatctcctgaccttgtgatctgcctgcctccgcctcccaaagtgctgggattacaggcgtgagccaccgcgcccggccaagcatcttttcttgtacttgttggccaaaatgataatattctcaacacattgggttaagtaaaatatatcaatttccttttactttttttttttcttttgagacagtgttcagctctgtcacccaggctggagtgaagtggcaccatctcggcacactgccaactttgccccctgggttcaagcaattctcctgcctcagcatcctgagtagctgggattataggcacaggccaccaagcctggctaatttttgtggttttagtagagacaaggtttccccatgttgaccaggctggtctcgaactcctgacctcaggtgatccactgccttggcctcccaaagtgctaggattattggcatgagccactgtgcctggactctttttactttttaaatgtgcctactagaaaatttaaaattacgtatgtggctcactttatacttctatcggacagcacttgactaaatgaactaaattccagagaggcataagccgttcctagatgagctactttcattccaatttcatttccttgggcccaagcaggctgggagaaagactgtcacaggcatgggcttttctgactgagcagcagtttgggaactgggggcagggatgaaaagcagagagatcttacaggcaacatcgtagttggtgattagattccaaagccatgctagactgagctagtgacctgatctcacattcaagatatttgaaaccaaagataaactgaaaccaactaaacctgcaacccagcccacctcctgattagcttagaagagaacagcctcacatcctggctacctgacacagggaagtgcaagccctttcttgggggtgtttattatgcaattcaatctctgctcttcttttatcataatgtctggcacacaaggatacatcatgaggccgggcatggtggctcatgcctacaatcccagcactttgggaggccgagatgggaggatcacctgaggtcaggagttcaagaccagcctggccaacatggtgaaaccctgtctctacaaaaatacaaaaattagccaggcatgatggcaggtgcctgtaattctagctacttgggaggctgaggtgggagaatcgcttgaacccaggaggcggaggttgcagtgagccaagatcgtgccattgcacgccagcctgggcaatggagtgagagtccgtctcaaaaaaataaaaaataatgataatacatcatgagacatgcaaagaagcaggcaaatgtgacccataatcaagagggagaaaacaacaatcaatagaaatagacccgtaggctgggtatggtggctcatgcctgtaatcccaacactttgggaagccaaggaggacgaatcacttcaggtggagagttcgaaaccagcctggccaacatggtgaaacccggtctccactacaaataacaaaagttagccaggtgtgctggtgggtgcctgtaatcccagctacgcaggaggctgaggcaggagaatcgcttgagcctgggaggtggaggttgcagtgagctgagatcgcaccattgcactcagcctgggtgacagagtgagaccccatctcaaaaacaaaacaaaacaaaaaaaccagacccacagaacacctacgtgttgaaattagttgacaaagatttttaggtaacagtgataaatatgttaaagaatttacaagaaaagacagataaaatggatgaacagatggtgaatttcatcagagaagtggaaattctaaaaaacaaccaaatggaatttccagagctgaaaaatacatatctcaaacaaagaatgtattggatgggcttaatagcaatttggcacaacagaggaaagaatctgtgaaggcaaagacaggtcagtagaaataatccaaaactgaaaagaagagactggtgcctgaacacctttggggaatgctctcgctgccgccccccacattcccagcctcaccttatgccacaaggcccggaggcagcttctccgcagagtcgtgtgctgccatgccaggtactcatccacacgggcacgggcctgcaggtcctgagggtaccagtagtcagggaccttatatttgcgcgtcaggtagagcaggatggccacactgtgggtgtgggggtcatgatgggtaagggaagggcactgtgctgggtatttcatacatagtcgcttttttttttttttgatacggagtctcgctctgtcgctcaggctggagtgcagtggtgcgatcttggctcactgcaacctccacctcccgggttcaagtgattctcctgcctcagcctcccaagtagctggaactacaggtgcgtgccaccatgcctggctaattttttgtagttttagtagagatggggtttcaccatattagccaggatggtctcgaactcctgaccttgtgatctgcctgcctcggcctcccaaagtgctgtgattacacgtataagcaaccgcacctggccttttttttttttttttttttttttttttttggagacaaggtcttcctcagtcacccaggctggagtgcagtggtgcagtctcagctcactgcagcttcaatttttataggagtgcaccaccatgcctggctaccttttttcttttttgtagagatgggatctcactgtattgccaggctggtcttaaactcctatcctcaagcaatcctccagccttggcatcccaaagcgctggcattataggcatgaaccactgtgcccagcacacttctttaacctttctgacaatttgccaaagtattagcctcattttccagagaagaaaaccaggcttagaaaggcagagacttgccctagggcacacagctcttaatggcagagctgagaatctttctgaggctaatacccaagcttttcctaccaccaggcaaaatcccacaacagaatgtcttgccaaatgtttagagacagtttctgatcagagaaccagagagagcttccaggagaacggggcatcaaagctgagctttaaagaagctcagttctttccattcggtatccactctcatctgctgggattccgaccagcctctgatggcctgactgttcaaaaaggcttccgtgtccctttgttctttctgtcattctttctgccaagaatcagctcctatctaagctgactggggtagtttggcttcctaaagtaccactcaggaagcactcctgcagctgcaggatcctagaacaacagaacagacaaggccccctggcactctcctccttccctgggttttgagggccgccatggtgatgagatgagcatggacctggaaggacacaggatgtgtccatttggagacacagaaaagctttcaggaacttggggtttcccaaaggttgggcatgcaggccaaaagggcagaaaacctctgtatctgccacgggcctatattctcttttaagctggggctacacacgtgtcccagcttaacgactccgttgtctgtgcagggtgcccaggagctccttttgctcccagccaattgttcaagccacctctgaggagggctgcaggtctctgtgagccacagacctgaaggtgagagtagtgacagaggcagagattgcacattgactctggctggtacctgggggtcacaacgctgagtgacacaaggactcaggacacctggggcaccagggaggaagacgggccctggcagaatgtcagaggaattcatcggaggtgcgtccatcctgagatttcagagatgagctttaaagcacaaactccaggttcttgttaggggaagggtgactctggtgacaaaaggggcagaactggggaaagattggcttttcctgaagaggattcaacttcttgggaccagctgtgatgtaagacgtccatatctggtggctcttccatggggaagacccatcctgggaagctgcagcccagagatggagccaccgggcagcccagatgccactgagccatcgccacacaagcttggccagaggcctgccccacggtgggcaaagctgccatcgtcctctggcctaccctgtctcaaggatactctcaccactcaccagcaaccaaagcactggtgtggaagtaaagtagatatttgcttttctaatcatcagggtgaactggaatagcaggaaggcaagggcctggggtccagtactgactctctgcaggatgcggggcacagagactctctgcctctgaagactttagtttccttgtctatgaaatagagggttagaacaggatggttccagcaggcctggcagcagtcctagggtcccagttacctctccgtcaaggtgaagtccccgtccttcaaggctggcaccttcttgagggggttcacctgggcaaaggcatcgcttaagtgctgacctgggaagagtccagcatggtgggtggtgggaggagaacgctgagcccgccatggcctgtgcccctccctgcaatgctctggccccagtttcacagttcttcttcccaccagtctgcactcctggttggcaaagactggaagggcccctgcgggaggaggaggagaccactccaccggctggtacaaaatagacaacaccccttgctaagtcctgtaggcacagcctcctcccacaggctgcccctctgcaacagagctcactgtgcagggtgtggttcctggacctttgcatgcaccctacccatctcctctttccactattgccagcttcatgaactcacaatcagagcaccccaagctgcacgataggtcacctgaggggactgactaccttgtcccttccaccattaattctaaggcagggtcatgaaacacagagaagtggtctttttctggtatctacctacttagaagcaacttctactggccccaccatgtccctttgttcaccctgccctgggcactgtggagctgtgtgtagcatacctgctaccaccccctgtgccccaaacttttattccccttacagttggggtctcactatgttgcccaggctggtcttgaactactggcctcaagtaatcttcctacttcggcctcccaaagtgctgggattacaggtgtgagccaccatgcccagcctgctaccctctcttcaccctcccttcagactgttccttcaccaggaaaaccctcctctgtctcctgggaaaacacacttccctctgcaccactacatttgacaaccagcttggacgtcctcttgtcccccattccctttcctctactccacactctgcagaggaagtccttgcgcaggacagtgggcagtttgcagaagagattatgtggagaagtttcaggcagagggccagccatggagtgggagccctgggcagaaggcttagccaagtagagtcgccttacttgccccaccagccatacctggattctgcttccaacccctcctactaccccaccctgcactgggcctgggcctgggcctgccagctgagtcctcaagggccttggaggcatgctagagaaacaaaacagggtgtagggctcatcaagccccagggtccccctgctgcttccagcatcagcagcctggggcaacctacctccccagcaggaacaagaggcagaggacaaggtttcgggcggcagaggttgcagtgagctgtgatcctgccactgcactccagcctgggcgacagagcgagactccgtctcaaaaacaaacaaacaaataaacaaaatgccttgggccaggcacagtggctcatgcctgtaatcccagcactttgggaggctaagccggcagatcatttgatgtcaggagttcgagaacagcctgaccaaaattgtgaaatcccatctctgttaaaaatacaaaaaaattagccagacatagtggcacacatttgtaatctagctactcaggaggctgaagcaggagaattgcttgaacccgggaggtggtggttgcagtgattcgagatccgtgccactgcactgcaacaaagcaaaagcaagactctgtctcaaaaaaaaaaggacaaggacaaggtcagaggcaaaacaggaggaacagaggaaggaagggacaaagagggaccccaatgcagactggacgagtgcagagggcagggatggaaagtcacgtcctgagctgtttgctgttgcagaatctcagcagctgggccataaagaagggacttgacgctgtcccagtctctacacttggcacccttgacctctctcatcccacctttccctaggccgaggtcacacctgctttcattttgtttttttttgttttttttttttaagacggggtctcgctagattgccctgacgggagtgcagtggctattcaagggcaccatgatagtgcactgcggcctggaattcctgggctcaagcgatcctcccaccccagcctctcgagttgctgggactacaggcgtgtgcccctgcacccagctgcgcccgtttttgtcctcctgtctggcttctcttcatgatccccacccctttattcggcctcaggggaaccccgtggtctattccgtgagaccgagcagagttttggggagccccgactcttggatctccctgctggctcacctttctctgttcggtctccaaaccagaccagcaatggccccaggaagaaggtggcgctgggagaagttccctaagctatgtatgcctacctgtccccttcctgacttttcggttccccaaacccgaggctggacctacctttaatcagatccacgatgcgcagctcgaagggaatgtcgttcttcttggcaaagatgtaaacagcgcggcagggctgggacagcaggtccaggtacagctccaggcccatagtggggaccgaccgacctgaccggaaaccagagggagtcagcaaactccagtgccaggactcgggtctcggacctcagaccacgcccctgcggctacgcaccccgaccgctgtgccccattgggcggcacggacgcctgggacactctttagtccaattgcgggcggcgggcggcctgtctcagggctgggcccgcctggctcctgtgggatcagggtgggtggccaagagaccgttgtctctcagggggacgcacagagaggccccagtcccatccctttcgtgcctggctcgctcatttcacttagcataatgtcttcaaggtgcatctgtgttgaagcgtgtgtcagaatttcccaccgtccgcattttagaggaggagacagacactgaatgattatagacccagaaagtctggctccaaagtccatcctcttggctcaacactgcagagtccttggtgccagcaagtggcaaagcctcagggcttacgttcagtgttttgtggtcactcgcttcactgcagtcgcactccctggaatgtcacagccttggtcttcctgcccctgccagcacagtgccatctatcgcattccctgggtttatttcttcctttctccaggcctgtgtttctccatctttaaaatgacagggaagctagagccctccagagtccttgcaagtccacccccctggattcatctgctgagccgtaagcccaggcctgccccttgctgccatggagcctgtcaaatagtatcagggtcacatgtcattttctaaaacgaatcccactgaaagtgtgtcagccaacgcataatgttttctagagaataaggaacatttctgcaaataaagtggaagtaacaactgttttattttatttagatagagtctcactctcttgcccagggtagaatgcagtggcatgatcacagctcactacagactccaactcctgggctcaagccatcctcccatctcagcctccccaagtagctgggactacaggtgcgcacaaagacgcccagctagttaaaaaaaatttttttctgtagaggcagggtctcactatgttgcctaggctgatcctcccacctctgccacctgctgggattacagatgtgagccactacaactggccagtaataatgatttttaactggaaaaaaaattaaggaaagatgagaaattcagatttccatgttaaagttttgaaaggaggtagacactcagagaaggcaatggctgccttatcctcacctctggataactccagtcagaggcccaaggaggagctgtcaggattctggttcaaggctcagcctgtcttttaagttcaaaacctaatttggggcgggagtggtggctcattcctataaccccagcaccttgggaggctgaggccggcggatcacctgagttcaggagtttgagaccagcctggccaacttggtgaaaccccatctctgctaaaaatataaaaattatctgggcgtggtggcatgcacctgtaattccagctactcaggaggctgaggcaggagaatcgttgaactctagaggcagaggttgccgtgtgccaagactgcgccattgcactccaggctgggcgacaagagagtaactccaactaaaaaacaaaacaactaatttggtccacgtttcaggattgatcattttctttgggtctgactcacataaaccaactcacaaaggctgtatttattaatttatagaaacaagataaaagtgagagtgtgtgggttggttcgtttgtttgttttttgactttgcccctctctgtcactcaggctgaagtgcagtggtgcaatctctgctcactgcaacctctgcctcctgggttcaagcgattctcgtgcctcagccacccgggtagctgggatttcaggcatgtgccaccatgctcagctaattgtatttttagtagagacagggtttcaccatgttggccaggctggtcttgaactcctggcctcaagtgacctgccagcctcggcctctcaaagtgctgggattacaggcgtgagccaccgtgcccggcctagaaagaagagaaaagtcatttagacagaatgctcccaaccattgctcagtgctctcttggcagtgtagtctcctaggaagcctcgtgggtgttactggccaggaccaggtccgttctgcccatgcacagtaaattaatcactgtgacatgagttttgcaaaagactaaagatttattcacaagggtgccaagcaaggaggtaggataatagctctcaaatccacctccccgaaaataaggcttagggataagccttgcttccaagcaataaagcacagaccccagtcacactcaaggggagggggctatacaaggatgtgaataccagtctgcctgcctcgtgggcctacaacgcagaagggccatgcacttggtttaaaactttgttgttgctgtcttgacattcttaacaatttaaaaataagggtccccacattttcatgtgtagccagtcctgtccaaggagtccaaagaggtcatgagggtggacaggtcactgtctcctctgggcagtgatggggccactagcagttgttctgtagtctcctagcccctaccccagggccacaccttccccatggtctctcacattcttttttttttttttttttttttttttgagacagggtcctgctgttgcccaggctggagtgagtgcagtgctgcaaactcagcttactatagcctcgacctcctgggctcaaacaatccttctgcctcaccctcctgtgtagttcggatcacaggcacatgccaccatgcttggctaattttttgactttgtagagagggcatcacactttgtttcccagggtggtcttgaattcctgggctcaagtgatcctcccacctcagcctcccaaagtgctaggattataaagatgtgatccgccgccccggcctctctcacattcttggcatttaaagttaccgtcattgacaaggaacatgggtacactccaatttactcaagaaaaaaactcttttctccattgaagagatatgtggcctggctgcttcctactctagttgaggtcttctttttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagcagcagccttgcctgggagcttgttagaaatatactaacaggctcccacccccaaacccagacctactgaatcagacagagtctgtattttcataagatcctcagatgatccaaatgcgccttaaactttgaggagctttgatccagaacctgggctggaggcccctgggggccactctgttcctcacagactgcaaggtatgtttttttcttgcctcttctctctgtcctaatgtctccttctctctgtgtctgaccctgaggaccctatgacatcttcccaggggagtttccactgtcaaagagctgattctctctctcttttttttttttttgagacggagtttcgctcttgttgcccaggctggagggcaatggcgtgatctcggcttaccgcgacctctgcctcccaggttgaagcgattctcctgcctcagcctcccgagtagctgggattacaggcatgcatcaccacgcccagctaattttttgtagttttagtagagacagggtttctccatgttggtcaggctggtctcgaactcctgaactcaggtgatctgcccacctcagcctcccaaaggcatgagccaccatgccctactgccagaggcctgattctctagaatctgatgggctcttctagacagcaatctctacctgggctcttgttgaagaagccaatcagctcattggttggaggtcacatgatataaaacatggccatcttccaagccctatgtgtggacaacgagatagggacaagtaggcatatcacgttctgatacctggacccacatctgtcgctgggcccacgtctgtcctcaggcccccaggatatacttttatggggagttttcctcccttcccccaatgtggtcactcataactttacacccaacagtcaaacaggagtggaagctacagagtttcacgcaaacaataggctaggctgtgggactgagtaaaaggcactggactgtggtaggtcttactccaagatggccaaatggaagggcttttagctttctttgtttttgttttatatcctgagacaaaatgttcaatttctacactttagaataaaaagagccatattttatgtttcatattttttgtatgcttcctttcatactcttttgaacaatgcaatcatattttcattatgaggtataattcacataccataatatccgctctttcaaaatatactttaaaattcaattggtttaaagccaattcattggtttttagtatattaacaaagttttgtcaccatcacaattatctaattctagatcattttcatcacccctaaaagaaactctgtacccattaaacagtcactccccatttccctcttctcctagcccctggtaaccattcatctactttctacctctgtggacagtaagtatctgcctattctggacatttcattcaaatttaataatgaaatatgtgagcttttatgactggcttctttcatttaacataatggtgtcaaggttcattcatggtgtagcatataacagtacttcatcccttcctgtggctgaattatattccattttatgtatacaccacattctgtttatccattcaccagttgatggacttttgcattgattctacttttcagctattgtgaatccccatgctgtgatgaacattcacgtacaagtttttgtctggacatatgtcttcagttgtcttgggtatacacctaggaatggaattgctggataatataattctatgttggccgggcacggtggcacatgcctgtaatcccagcactttggaaggctgaggtgggtggatcacctgaggtcaggagttcgagaccagcctggccaacatggcgaaaccccgtctctactaaaaatacaaaaactagctgggcatggtggtgcctgcctgtaattccagcctgtaattccagttactcaggaggctgaggcaggagaattgcttgaaaccaggagacggaggttgcagtgagccgagatggcaccactgcactctagcgtgggtgacagagcaagaatctgtctccaaaaaaaaaaaaaacaaaaaaaacaaaacaaaactaacccatatatatataatatgttatatatacataataatatattttatatatatgtgtatatatgtttaacttttggaggaactgcaagctgttttccaaagcggttatacattttacattctcagcagcagcacacaagggtttcaatttcttcacacatcctcaacaatacttttaatctgtcttttctgttatacccctcatagagtgtgtgaagtgatatctcattgtggtttgattggcaatgtcttgattatagtatctttgtactaagttttgaaattgggaagcatgagtcctacagctttttctttttcaaaattattttgaagattctgagtcactttaatttccaaatgaattttagggccaatttgtcagtttgtgcaaacaggccaagtggaattttaatgcagactgtgttgaatttgacatcttaacattactacaccttccaatcatgaacatgggatgtctttccatttattaaggtcttctttaagttttcccccaacttttaaattatgaaaacatttaaaatccagaaaatgaaaggactagtacaacagcactaatatatgcaaccccagtttcaacttactgttttttgaacataagataccaacatcatgacaccccacctaaggactttttagcaaaacattctaatttctctactgggattattgtttgttgtcttcctccacaataatgtgagcactaaaggtagagacttttgcgtactttgttcactactgcttcctctgcaccaaaaacactgcctggttgtgggtacttttctagttttaggaaggagaagacaagatataggtcctgactctggttctgcctctcattcatatgctactccgaggatcccttccccttgaagaacttgtttcttcatctacgaaatggggataatactactactcatcagggtggttgtgaggattaaacaaggtaagagatgtaaaattgcatgttagttatcagatagttttgttttcccatctagctccatgagggagaggatttgctctagtccgtccgtctgggctctgggcttctaatgggcagacaccttcctccatgatgtttgtagctgcaaagcctggcacagtccctcaagacaagctttttgacttgaactgctgatggtcttccatgcacaattcaacagaaacccagtagcatacacttccttgtatgcacttgcccctctttttacatttattacacattcattgctacctaataatccccgatacttatcttttactttatccaattattcaacagttttcaacagaaatacctagaagagagctattccgacttcattagaccctgagattctatttttaacatttcttccatggattgttgaatgtttccaatgattgatccaccttcccttggccttatctgcattccagatttggttgtgtgtccatctctgtgttgccagacttacctcacagacccagcttgaacacaagatgggtgcttgctgaagagcaggactcattctgttgaacctgcatgctttctcaggtcagattgcttggtggtgcttctttaatttctttcaacagcacattgtagtttgctgtgtttaagtgttgcttttctttggttaaagttattctaagtattttattctttttgatgctattgtaaatgaaagtgttgttttaattttgtttttgatcctttactgcaaatgtatactattgatttttgtgtattaatcttgtatcctgcaaccttgctgaacttgcttatgagctctaatggtttttaagtgagttccttaggagttcctataatgtcatctgtgactaaagatagttttacttctttctttccgatctggattccaccttgttcctttttcttgcctaattgccctaataaatagaagtagtatgaatgaacattcttgtcctgctcttgatcttgaggggaaacactcaatctttcacaaggaatgaagtatggtgtttataggtttttcatagatgctctttgtcaggctgaggaagttcctttctagtcttcatctgttgagtaattttatcataaaaggatgttagattttgtcaaatgccttctctgcattaggatgatcatgtgactttctattaatatgaagtgctatatggattggtttttgtacattgaaccacatttgtactcctgggataaatcctacctggtcaatgtgtataatcctcttaatatgctgctgaatttgatttgctaatattttgctgaggatatttacatctatatttataaggatattgctttgtaactttattttcttataatgtgtttttctgtctttggtatcagggtaatgctggcctcatagaatgagttgaaaaatatttcttcctgttctattttttagaagagtttttgaagggttggtgtcaattcttcaagcttttggttgaattcaccagtgaagctatctggtcctggacttttctttgtagggatttcatttattgatttattgatttattttttgagacggagtctcgctctgtcacccaggctggagtgcagtggtgcgatctcggctcactgcaagctccgccttcctggttcacaccattctcctgcctcagcctcccgagtagctgggactacaggtgcccaccaccacgccccatctaatttttttgtatttttagtagagatggggtttcactgcattagccaggatggtcttgatctcctgacctcgtgatccgcccacctcagcctcccaaagtgctgggattacaggcatgagccaccgcgcccggctttttggtaggattttaaaaaaattaatattttaatatctttacttttacaggtctattcaaattttatcttccttcttaagtccgttttggtagattgcatgtttctaaaattttctcatttcatcgaggttatctcatttgttcacatacaattattcatagtatttctttataaacctttgtacttctctaataccagtagtgatgtgtccattttctttctttctggtgtctggttttttggtttttgttttttttgtttttttttttgatataaggttttcctatgttacccagactagagtgcagtggtgcaatcacagctcaatgtaaccttgaattcctgggctaaagtgatcctcccaccttagccacccaatttgctaggactacaggcgcgcaccaacacactcagctaattttttctttcttttttttttttgagacgaaattttgctcttgtcacccagggtggagtgcagcagtgtgatcttggctcactgcaactctgcttcttgggttcaagcgattctcctgcctcagcctcccgagtagctgggattacaggcgcctgccaccatgcccagctagttttttatttttactagagatggtgtttcaccatgttggccaggctggtctgaaactcctgatatcaggtgatccgcccgtctcagcctcccaaagtgctgggattacaggcatgaaccactgggccttgcctcctagctaattaaaaaaaataaataactctttttgtagaaacaagtctcactatgttgcccaggctggtctcaatctcttggcctcaaatgatcctcctgcctcggcctcccaaagtcctgggattacaggtgtgagccattgcacccatcctccactttcttggtgaataatttgagtcttattttttcacttggccattctaactaaaggtttgccaagttttgttgatcttttcaaagatccaatttttggtttctttgattttctctattgtttttctgttttccatttcatttatctccattctaatctttattatttcctgtcttctattggtgttgggtttattttgctcttatttttctagttccttaaggtgtaaagttaggttattgattgaagattgttcttctttaacttaggtgtttacagctataaattttgctcttagcactgcttctgctgcatcctataaatttgggcatgttgtgttttcatttttattcattcaagatactttttaatttcccttgtggttttgtctttgacccattggttgtttaagagtgtgccgtttaatttctatgtgcttgtgagttttctagttttccttttgttcttgattttaaactttattccactgtgtccagagaacaccctttgtatgatttcaatcttcttaaatttgagacttaggaccaaatatatgctctatactggagaatattccatgtgctctttagaagaatgcttattctgctcctgtcgggtagaacgttctgttcatgtctagtgtgtgcaattggtttacagtgcttttcaagtcctctatttccttgatggtcttctgcagtttttctattactgaaagtgggggccaggtgtggtggctcacgccccgaatccctttggggattcagggtggctcagcactttgggaggctgaggcgggcgatttgcctgagctcaggagttcgagaccagcctgggcaatacaatgaaaccctgtctctactaaaatacagaaaaaaattagctgggcatggcggcatgtgcctgtaatcccagctactcaggaggctgaggcaggaggattgcttgaacctgggaggtggatgttgcagtgagctgagatcgcaccactgcactccagcctgagtgacagagtgagactccatctcaaaaaaaaaaaaaaaaaaaaaaaaaagtcaggtattgaagtcaccaactattattactgacaacgtaatcatatttaaccctttacttttaaaattctttttggaaactggaaggatctgtaaccaccacccacttccacatcagaccctatgcatacgccaactgtctgttgctcagcagctgtgatgttgttccagttctttattaggcaaagaacagttgtttttttagcatttcctttaaggaaggtggctcagatcattgagccagccaggccctgcaggatgggctgcgattagggtcacaagtacttctcccgaaactcacagattttcctcgtgaccattggatccaatgttgaaaagtcccagtcggccaactgcattagtcgatcatgggcctccctaaagaggccacagccaatattcagctccacccgcatacgccactcagctagcttggagctgttgaggaagacattatagttggctgccatgggctgtggatagacaaagacgaagatgtggtcagcctggggaccagccccacctgggtcctctcccacagcctctggcccacgtccctaacatctacctatggaaagaattaggctgctgacccccaaggcctgagcaaggggtcacagactatgtaatagatgtaggtggggatggaggatccagaatccctcagagtcctcagtcactggtcttcttgctccaagccttctgaaccacactgagagggctcctggcccaggcagctcccacttctccagcctgcgacctcgcatgaatcctgccttcttccagggaaaccccttatcccaggtgtgtatatgcggatgagggagagaactcaggttttttcctccatgtttagactcccactatgatcaagctcaggggctaagatgggagacctggcgggcagtctaccctgcagtttcgctggc
